United States Patent 6,812,339 (POLYMORPHISMS IN KNOWN GENES ASSOCIATED WITH HUMAN DISEASE, METHODS OF DETECTION AND USES THEREOF) - sequence listing, part 105

SEQ ID NO: 164615 - DNA, 601 bp, Human
gaaagagtaatagtttgatagaaatgcagatatactaatatcaacagtctaataccaagatggtcaactgctatttcttaagtgtctactacattatcattatcatattaggtaatggggagatcaaaccaagtgaaaggcatgtgtgctacttcatgtgccttgagagctaacactacatatttcctgaactgccatttctcagaacaactcaattgaggtaagtatgttgttagacacattttacagctctagaagtggagtcttagggtggtgaggtacccagcatgtacaacaaggwgctggtagtctgggcagtgttaccccagagacgcattcccaactaccattaccattgtcgtgggtcccctgacgagtgctgtcggctctctcttagccagtcttgcaactcctttaatgcttcatgcaagctggaattttccttgtcatattgcatagttctgtgaaagttcaagctaccaagtcagctaaaaagcttttctgatgccatggactggatgtccagccaagaccttttcattgtggtgagctttcagtctggacatgggcagcctattgttcccttagcctgggcctgatc

SEQ ID NO: 164616 - DNA, 601 bp, Human
tttggaaccctttggagtgttgcactgcacaacttattaccgccttatcatcatagaatgggtctgtaaaaatatttaacccaatctgttcagaaagttactgtagctgcctttaagagccgaagacggcagctttgaacaattcctgctaccatcatgtagccagagtccaaatagtgtttaactctatctttgcagaattgtaaatctagaaatttaaaacactgtagtttggatagagaattacagcaagtaacaaagagatgtggcaaaaacataaacactcttaaaaaaatgtaarcctctgaatttgcaacataagttaataaaacagcaatgtgttatgtctgtatatgagtatcacttggtctaattagaaagtgaatctaaagccagggcaaataatatttgcatgaaacttgacatcgtcattcattttacatgtggcttcctaagaaggttagacttgcttgttccaaatagaaaagaggaccaaaaaaaagtgcccgattaagcagaagcagcacatttgttacagattcacttaccatcttacatactgcttgggtctacggtgaatagttgaaaattatgaacaaac

SEQ ID NO: 164617 - DNA, 601 bp, Human
agctctgtcatgatccagagtatagttgtctgaaagatgatcagcccagcagattgaaatcagcaccagaagaagtagactcttcatctttatagcccaaagaatcttcttcactgcgagagcatcacatacaaagaggcttgtgagatttggaaccctttggagtgttgcactgcacaacttattaccgccttatcatcatagaatgggtctgtaaaaatatttaacccaatctgttcagaaagttactgtagctgcctttaagagccgaagacggcagctttgaacaattcctgctacmatcatgtagccagagtccaaatagtgtttaactctatctttgcagaattgtaaatctagaaatttaaaacactgtagtttggatagagaattacagcaagtaacaaagagatgtggcaaaaacataaacactcttaaaaaaatgtaagcctctgaatttgcaacataagttaataaaacagcaatgtgttatgtctgtatatgagtatcacttggtctaattagaaagtgaatctaaagccagggcaaataatatttgcatgaaacttgacatcgtcattcattttacatgtggcttcct

SEQ ID NO: 164618 - DNA, 601 bp, Human
aaatagctagacatagacaaattcagaattctattttggtagtcataatacgtacaggaaaatacttctagacagatttacactatcatttgaccttcacaagtcatacttttcacagtgaatgcagtttactgaggctacgcttttgaccttgaagatgtaacttagagttttatgtctcttagcaaacttatcatgcctctggtaccccaatggagtttatctaaaattatcatcatctgcttaaactgttaagttctataattccttttttaattattcagcatccaagggcaaggaragaactgttcctcttattgcataagtctcagctttcttaatgcaggatgtccctcatctgaagctgggactgaggaaatagctgcattgtactgcagcctcaaatcctgctacagctctcaggcttaggaatcagctgagctgaacagaaatgtgcaggggcaatgtattggtctataggagctaaagcttaactgaagcagattataatagggtaaactactttttcctggacaatagcttgtctaattttcattttatttatattgtttctcttaatgattaaacagttactctaaca

SEQ ID NO: 164619 - DNA, 601 bp, Human
atttaacaaatgctcattatggtagtgacaatttagaagtatctcattaccttcatcattcatttgttcactcacttattcaacaaacatacattgagcacctactatgtgcctggcactgctctatagttggagttagttacaaagctgagagacaatctgatgagggagggaggcatgttagcaggaagtccgtgtgaggactgaaccagatttgaagaaggggaggcaggttcaggacacgcagcaggaggaggaatagtgaagctgagagaggagtgtgcacttctgccagcggttmtggatagactttatttttttctacttacagacataaacttctggcaattccttattaagtaaatctacttgttttatttgttgacaaaagtgacaattacttttacttattaaatagaaggacacagttttcatttctgggagttcctcttgttctgccttacaaaaatttaaagtagcggatctgtgctcacatagtaaatacattaagggaaaatattacttatgtttggagaactttagtttctaccaggaaagtaaaaatggtcagataatatttaatgtgactggggaggctggg

SEQ ID NO: 164620 - DNA, 601 bp, Human
agcatttcagtgaccaaatgtaaatccaatactcttcaaagatgcatacatgcatgaggaagattgctgcaacttgtctttggcggactctcatggagtatcagatgctgcatgttatgtgggagccatgcacaagaccaaacaaaatttgcaacccaaattcataattctcttgttcatctgctgcttctcattccatgaattgaaaatatttccctgggatttggaaaggctgaaccaaaacttgattagaaaaaacaactggattttggtcctggatttatttagcaaacatgtattsatcacctactatgtgccagttgttgggtttatgtgactgggatgcatcacacaaagattcctgccttcatgaagctgttcaatattcttgtggtagagacagatgacaaacaattacataaaaataagtagagtatacagccagtgctacagagagaaagaaaagaagggtgagagagattaggataccagagggggacagattgcaatagtcagggtgacttcattaaaaaggtgagaaataagctcagatttgaagtaaaggaaggggttaactagataaacggacttttatcagcca

SEQ ID NO: 164621 - DNA, 601 bp, Human
agccaaataatgagttataagaaaaaaggccgaagttcaggaagctttattttagaacacactttgattttaatatattgtgggaggtctataaaatgctgttaccatatgcatcttttagaataaggtattctgtttatacggaaacatttaaaggaagcattatctatctaatcagctttttagtactttggtactttaagctcttaattaagaccctttgttaatgactgtgataaaagacaaatcaaaatgaggatatgaaaataatcatatgcagatttttggagatttaaaaccygacagcataattgacaacatttttcaagagaaagtaagaattgttcataacccatataatactggagaagaaaatttgaaaatttaaaaatttgtaatttacctttctgtgctgaagaaaccaaaaagaaaaaaaaagagaataaaaagccttgtataaaagtgttcattattttttgccagcaatattattagtcatagataatcgtgaaatcattctgaacaaatatagtcatctagaaagaaaatatattcgtgtcatatatcttgtaatgtataaggctacattatacatatcttt

SEQ ID NO: 164622 - DNA, 601 bp, Human
aaaccatgtgaatgtaccacccatgcataaactaaataaaaatcttataaaaataaatgtagaagttgagggaatttaacaaatagacaagaaccttttatctagagtctctctacacaagaagctggtagccataattatactatattattataattgaaggattatattttctcagtatacctattgctgtgttactaaaaatgttatctttaaacatgtatttaaaacacgaaatacatggtatcacatttccctattttttaaagatactattgctgaagatagtaattgttgtctrgttttgaaccataaaggaaaaaaatctaatgctgaaaataggataagtggagatctttgatataaagtgattggtgctgtttttcatcatctgtgacctgccttttggtctcacaggctacgagattgtactcctcccatccagcccacttcccaaccctgccaggggctaccttctctgcacccactgtgtagtcttcatgctctgctctttgctatcaatctacagctaaattgtgtttttataatttctcaaatggcatgttttgccttcctgttgagatctgcattatcacatgtg

SEQ ID NO: 164623 - DNA, 601 bp, Human
aaattttaaaccatgtgaatgtaccacccatgcataaactaaataaaaatcttataaaaataaatgtagaagttgagggaatttaacaaatagacaagaaccttttatctagagtctctctacacaagaagctggtagccataattatactatattattataattgaaggattatattttctcagtatacctattgctgtgttactaaaaatgttatctttaaacatgtatttaaaacacgaaatacatggtatcacatttccctattttttaaagatactattgctgaagatagtaattkttgtctggttttgaaccataaaggaaaaaaatctaatgctgaaaataggataagtggagatctttgatataaagtgattggtgctgtttttcatcatctgtgacctgccttttggtctcacaggctacgagattgtactcctcccatccagcccacttcccaaccctgccaggggctaccttctctgcacccactgtgtagtcttcatgctctgctctttgctatcaatctacagctaaattgtgtttttataatttctcaaatggcatgttttgccttcctgttgagatctgcattatc

SEQ ID NO: 164624 - DNA, 601 bp, Human
aatttttttctgtggttaactgtaaaccatcttgcagtattttagaagtgtaggtttctgattttgtttttgttttatttctactccagcattgtgaatagaggatgacttgtgtggtataatgttgaaaattaagcaggcaccaaacatccactgaccctcacccaaaatagttttttaacaagcctatcgaaatgtataaaattctaccattctcattcactttggggtgtgtgtgtgtgtgtgtgtgtgtgtgttgaagtaatagatgccagaagtctctggctgaaattcaaagaamcctagcaaaggtatgtaacatatttagtgactaaggccattaaggttccttaggctaaacctccaacatggccttgagaataatgtttttgtttgtttgtttgcttttagaagatctacacttcagattacacagctctgagcattttggagaagtggtctattgcaggctctcccatgccttagctgttggactctgctaagtctacctcatgagaatcttgagcttgcagttctcatcaggtgctatgtcacaggttgtcgtcacagagaccagccaggaaacacactgaattagaca

SEQ ID NO: 164625 - DNA, 601 bp, Human
gtctaaatgttttataaattaaagggttaaggcaaagatcaaaactctggtataagggactcagacttctaatttttttctgtggttaactgtaaaccatcttgcagtattttagaagtgtaggtttctgattttgtttttgttttatttctactccagcattgtgaatagaggatgacttgtgtggtataatgttgaaaattaagcaggcaccaaacatccactgaccctcacccaaaatagttttttaacaagcctatcgaaatgtataaaattctaccattctcattcactttggggggtgtgtgtgtgtgtgtgtgtgtgtgttgaagtaatagatgccagaagtctctggctgaaattcaaagaaccctagcaaaggtatgtaacatatttagtgactaaggccattaaggttccttaggctaaacctccaacatggccttgagaataatgtttttgtttgtttgtttgcttttagaagatctacacttcagattacacagctctgagcattttggagaagtggtctattgcaggctctcccatgccttagctgttggactctgctaagtctacctcatgagaatcttgagcttgc

SEQ ID NO: 164626 - DNA, 601 bp, Human
gttcgtcaatataaacccaaacatttcaaggtaaggtaaacccagctgggctttctaatacaagaagtttatattgtacttacaggcaaaatatgaagcaacatgattcactttcattgtacagttctggccaaagaactcagaatatcctcacatttatggcttctagtcaaatatacacctgtgttaggctcttctgaaatatttcaggaaatatgtattttgttttcacaggaagtttagacaaaggtaattttaataaatgctttcgacaaattccagaagattttgaaatgtattyctcaaaatttggatgttaaaaacgtatccaaagttatacttcttttctgattaaccaaatacttatttgcttctttactcccttaaatatccttctattctctctctttgctttctgctatgtcttgttttgcagttatcttattacttccacctttcctttccttgtccttttgttttcctccaagtccttcctccaaggactctattgccttccaaagagcaccacaatatcctgagcctgccaagtcagcaggtctgccgttttctacataccagctgttattttcagattttggct

SEQ ID NO: 164627 - DNA, 601 bp, Human
aattttagaaacaaaataaaaaaagtacacagtctgaatttctcaataaccatataatggaatttagatgattttgaataacataaggcagtatctgaaaactgttaattcagttccactgcacgtttctcctagttacaaatagcttcaattttgcacataagcattgtgtatgcatttcaaacatgaaagctggaatcataggcagactgtagaatacaaaagaataagatgccaggcaaggactttggtttttcactttattactgtgttaaccactagacattactcttcatgaaaraaaaagcaactattaatgaccatttatacgttgaacatgacttatagatacataccttgtaagtccagtgctaccacaacagtatcatcttctaatccttcaatcacctcacacttatatctcccataatcttccagagtgaggtctgtgatgaccagagaagcatcactatcactgcctcccttcagaaacactctaccctggtagcctccataggtttttttgtggtatcccatggaaacaaaaacatccacttccttgaggtaatccgaagttagcttggtccacttaattcggatt

SEQ ID NO: 164628 - DNA, 601 bp, Human
tatcatgatactttttgaagctggatgatgatatatggattcattacactattccttttacttttccaaatgtttgaaattagcgacaatgaaaagttaaacattcttatcccaccctgccaccaacgtgagacttaatgcaggcaagctggaatgctgtcggtggtatctgttgttcacatttttgctttgagtaatttctctctcttatctatgatgccctctctcctgctttttcatgctcattaccttttgaaaggcttacattcatggtccaaatcaagtatctggtttttttttktttgtttgtttgtttttttgagacggagtctcgctctgtcacccaggctggagtgcaatggcgcgatctcggctcactgcaatctccgcctcctggattcaagcgattctcctgcctcagcctccagagtagctgggattacaggcacgtaccaccatgccaggctaatttttgtatttttagtagagatggggtttcaccatgttgaccaggctggtcgcaaactcctgactccaagtgatcaacccgccttggcttcccaaagtgctgggattacaggcgtgaaccaccatgcccggc

SEQ ID NO: 164629 - DNA, 601 bp, Human
tagtaaaattctttagtgtaaatagcatttaagctggtattaaaggaccaactcaattaaagataatgtgcaattacagttggaaaagcagctcagtcaaggcatttaaaatgagatgcttccctggccctttggtgcatgttagaagactgacagggagtttgagtaccactgcctgattggtagatagtcacatgtaaggatgtcattgataatgaaaaaggttaaaaatgagaacgagagctaataagtgataaccagaaggtatgtcttttgccgtgtgtggttcagcacagatttyaaactcttatgcatataatctgctgcatcttgagtttctatcccagaatacatggagagtgtccttagcttatgtcaagttttctcaaattttatttttatggcttttattttattcttgtggctatctgaatttgttgtaaatttactttgaaatatcaatcctcatcttactctgaagtatatttagacaaaataatatcccatctgagtttttcttgaaaattattcagtggtagtgggagtaagaaagcaaaataaaataagattggctatatcatgatactttttgaagctggat

SEQ ID NO: 164630 - DNA, 601 bp, Human
gcagagacccaagaaggcttcctgatctcattctgccttctcaggttcttggctgaaggatctataagctgaatcagagccaaaaggaaggagtaaaagcctctcttggttgccactaactcctgtggtgaggggtgagggaaggcctggagatggttctatctaaggagggctctgcccaggcactgagctgggaacccagtgagtgctgggaaataactattatggtgccctggtccctcatatcttttatcctctttcctcagcaaccctgggagtgctgatgaaaaggaaaatattygatttattcagtagagattccttttagctagatcttaagtgacagaaaatctcaaagtatctcaacctgaggagagaaagaaaccagtggggttgacttccatttccaaaatggctgaagatggtaacattggagaatgcagaatattttaatttatactaattttaaagacctggaaaatctttcaggtttaaattcactgtagtgtattttggtggactctcataaacatcgggacaagtttttctctagtaatttgtccttgattaaccactgaacattacttaaatacgatttagt

SEQ ID NO: 164631 - DNA, 601 bp, Human
ggccttaaatcaagtcacatccactgaaggcctcggtaggacacgtttgtctctgtagggcaatccagctggcaccatccatgaaaggcagagacccaagaaggcttcctgatctcattctgccttctcaggttcttggctgaaggatctataagctgaatcagagccaaaaggaaggagtaaaagcctctcttggttgccactaactcctgtggtgaggggtgagggaaggcctggagatggttctatctaaggagggctctgcccaggcactgagctgggaacccagtgagtgctgggwaataactattatggtgccctggtccctcatatcttttatcctctttcctcagcaaccctgggagtgctgatgaaaaggaaaatatttgatttattcagtagagattccttttagctagatcttaagtgacagaaaatctcaaagtatctcaacctgaggagagaaagaaaccagtggggttgacttccatttccaaaatggctgaagatggtaacattggagaatgcagaatattttaatttatactaattttaaagacctggaaaatctttcaggtttaaattcactgtagtgtatttt

SEQ ID NO: 164632 - DNA, 601 bp, Human
acttttaatgtagcccttaatcttattttttttccctgcccttaaatagcaggactaaaacaagggctttcatttaaaagtatttccattactatttttcaacttccacatgtatatattgcaaactgaaagtaaggggtttgaaacatttttattataaacaggaaaaaaaaacttccctaagcttgtcctgtaaaaggtaggtacagaatagacatccattgattgactaatgccaaataattaagttaaatattttgaggacaaaagttccttagcaaatgtaaacagtgtgacttcrtatttgattttgcctaggaaggtgtatggctttccaaaacatttcttttggtcaaataattatgggaggtgaccaagctgtctcacaacactctgcccattttctttaaaggctaaggattaccacataagaaagcaaagttgcatcacttgctggactttgaaaaggactaatgtgtcaaagtatttctcccatggttattaaaagataagtaattttgaatcattattcaagggcttgccttgaattttttaatataattagaaataactagtattttggcatctggaatgcaaacat

SEQ ID NO: 164633 - DNA, 601 bp, Human
ttccccttcaagcagcctctcagttctgagcatctcatgatcagctttttaattttataacttcagtgatttactgctttagctaagagttcaactcaagtcttaaaattctcctttctgaagagatctgtctacagtttacagtttccaaatagccctccccaggaacttaccatttgctgccagttactaacactataatgggttactactgagctctgtcacctagggaaaaagtcaatattgaatactaagagttggtggcaaatatagaaatagtcattgttgaatactaagagcrgaggggatgtagtgctccaagagaggtacttatcaaaattcacaatgtttttcttagtgtttttcctatataattagtaattagttttatgtagtcttttaaatgtataaacaagcatattaacaaattattcaaatgtagatatataactttttacatgttcttctaataacttgcagataagtaaccttcacttaggggggactcttatttggagaaatgtgaaaacaagcttgtccaacccatggcccatgagccacatgtggcccagaacagctctaaatgcagcccaacaaaaat

SEQ ID NO: 164634 - DNA, 601 bp, Human
tcctgactccgggcactgtgttctgccccccacagggctctctgggctttgtgatgggatattgcacagagccatcactgagccagccggcattgcaccagtccagcccgccccgccaggcgtcgtacagctggtcgaaggaggcgatcacagcatcctggtccagacacgcctgctgcgcctcgtgaaaattgagattgtagcgccccagtcgtggaaagtaagggaataccacacctgtccaaaggagaaagcaaggagttgttagaagccccaaaactaacaactctgagcaaatgcyacctagttggtgaaaaacctaacagaccctccatcagatgagacagtagtttttcgtcaactagcaactgtttctcatgatccctttccccttcaagcagcctctcagttctgagcatctcatgatcagctttttaattttataacttcagtgatttactgctttagctaagagttcaactcaagtcttaaaattctcctttctgaagagatctgtctacagtttacagtttccaaatagccctccccaggaacttaccatttgctgccagttactaacactataatgggttactactga

SEQ ID NO: 164635 - DNA, 601 bp, Human
tactgggaatatgtacttttgcttgacttgtgtggatatttaaaaattatgacactcaagaactttttatatctttttaaactacagcaaaacttcaaagcttgtttttgtttgtttttctaagaagataagattaaaagccaagtgtagtgttatagtatggaatagtctgtgagataggaaagaaggcagtacagttattatcttaccattgaaattggatgtaaaacagaaaacatcatatctgcttttatctttatcccaaaatccgtagttcctgactccgggcactgtgttctgscccccacagggctctctgggctttgtgatgggatattgcacagagccatcactgagccagccggcattgcaccagtccagcccgccccgccaggcgtcgtacagctggtcgaaggaggcgatcacagcatcctggtccagacacgcctgctgcgcctcgtgaaaattgagattgtagcgccccagtcgtggaaagtaagggaataccacacctgtccaaaggagaaagcaaggagttgttagaagccccaaaactaacaactctgagcaaatgccacctagttggtgaaaaacctaacag

SEQ ID NO: 164636 - DNA, 601 bp, Human
gtgcccctgcctaggcctcccaaagtgctgggattataggcgtgagccacagcacccagcccacattttcattttacaccgggctgcacaaatgatgtggctggttctgaagacagcaagagaagggctgagaggtgtatgaataaaatgaatcagtcatcaacactgctgcaacctttccttctgctttcaccttgagagttagttctattttctttttcttgcttactccccactttgtcctgagctctgttgatcacctatgaataagtgtatatgtgattgtgattgagagagggaragcatgggtaataatgaaggcacgcttactttgattgacagaaccatatcctacggagggcacacactggcagcatcatctttgacaataggtaacagacctcaagccacataacagtttcaattatttcatataaaaatgggatgaaataaaacgtaggagtactgggaatatgtacttttgcttgacttgtgtggatatttaaaaattatgacactcaagaactttttatatctttttaaactacagcaaaacttcaaagcttgtttttgtttgtttttctaagaagataagattaaa

SEQ ID NO: 164637 - DNA, 601 bp, Human
tttcttatacatcttagttttaggtcgaatctaatcagactctcttgcctgattagacatgtaatatgatgttcccctgaccctcattagatataggttactgaagtataaattaatgcttgccagttctttctagactgagatgatgtgatttggagaaagggtagtggccactggaatattaactagaggttaagtacaatcatctacaccagagttcagcaaactatagctcatgggtcaaaattggcctcctacctgtttttgtaaatgaagttttattggaatgctgccatctccmtctgggtttagtattttgatggctgtttttgtgctacaacatacacatttacaatgagcctttgcagcagacaccatatggccagcaaagccaaaaatatttactatatggccctttacagaaaaagattgtcggccaggcacagcggctcacgtctgtaatcccagcactttaggaggctgaggcaggctgatcatgtgaggtcaggagttggagaccagcctggccaacatagtgaaaccccatgtctacattaaaaagaagaaaactcacaaaaccaaaaaacaaaaattaagtagg

SEQ ID NO: 164638 - DNA, 601 bp, Human
aaggtagaagtctttttcattggttaaatattatctgcttatttatgtgtcatgcttcatataaatgggattattgaggagttttaactgtgcttgttactatggattggaatccatatgaatttttttttttttttttggtcagaaaggcaggattttaaagagtaaaatattctgcctattagagacttgaaatattaacttttagaaaggtatagattgttcccttgtgaaactgagttttgtataacctctcagtttatgtaaagaagcctgtatttcaaatgtgttgctctaattwgtttattgtagtgcatttcaaaattgtacaaatgtgtaaagtttgtgcttgtggaacctgctgctctgagtagctttactttccttaatttaatcctagcaattcttaagctattgcatgccccgttcatgaaaggatactttgttgggatgatacagcttaaacagtttggctctaagtctccttacatagagcttcccttaaatttatattaatttataatatatattgaatgatagctttacaaaaaacaaatcaatgaattgatctttatgaaaatgactctttacagtaagtaaa

SEQ ID NO: 164639 - DNA, 601 bp, Human; identical to SEQ ID NO: 27712

SEQ ID NO: 164640 - DNA, 601 bp, Human; identical to SEQ ID NO: 27713

SEQ ID NO: 164641 - DNA, 601 bp, Human; identical to SEQ ID NO: 27714

SEQ ID NO: 164642 - DNA, 601 bp, Human
ccaggcccagctcaggtgggcagggcccgggcctggggtccaggtgcttcttgtagatctgcatggcgatgggagcagcccaggcatctgcagccagacctgcttgcagtgtgctctgggtgcttctcaaagccactccagcctcctcagcctcctcttccaccaggtctttctgtgggataaatactgtcagtatggctaccaggtggccacacctgcagctgcagtcctcaggtccttgtcactcaatcgtatgggttttgataaaaaaaaaaaaaaaaaaaaaagagatggggtctcrctttgttggcctggctggtctccaagtaggctcaagtgatcctcccgcctcagcctcccaaagtgctggtgttacaggtgtgagacactgtgccacagctcttggtctttctacaacttactttttttctgagacagggactcattctgtcacccaggctggagtgcagtggtgcaatcatggctcagtgcagcctcaacctcccaggctcgtgatcctcccacctcggcctcccgagcagctgggattacaggtgtgtaccaccatgcctatcttgctatgttgcccaggctggtctcc

SEQ ID NO: 164643 - DNA, 601 bp, Human
tcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttggrccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctg

SEQ ID NO: 164644 - DNA, 601 bp, Human
tgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcstggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaagagcgcatgggtccccagctgatccgtgctatgaggcagggccgggccatcctgccctcagaccgggatactcgagctggc

SEQ ID NO: 164645 - DNA, 601 bp, Human
cagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggargagcgcatgggtccccagctgatccgtgctatgaggcagggccgggccatcctgccctcagaccgggatactcgagctggccttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgagacagtggggtttcagacaggagggcgggtggggggtgctcctcactgctagttgatgggggac

SEQ ID NO: 164646 - DNA, 601 bp, Human
ctctgttgcctcagctggagtgcattggcacgatcttggctcactgcagcctccacctcccgggttcaagcgattctcctctcagtctcctaagtagctgggatgacaggtgctcgccaccatgcccagctaagttcccataagtccaaagaaggaaatggggccttttttgggtatggccctcttagggtaaagcaccccttgggcagcccactgggcacccctgaccccagcacctcccttgtagactcaggaaatcactcagcccttttgatcatcccgcccctgctcacagtcaacrgggttcctatgcgtccagttaggcccggccatggggatctggccttgtgcccccgtagggaagaccaatgcagagggccagtcacgggattggtgagtgttacctggtacctcctgccagggacactgcagcccccaactgggcctagcctgcccacctgcaggccgtgtgagcagcgcacagggctcctctgcccacacccagagggggcagaaggtgaccctgcctttgttccctcacccagaacatggctctctatgctgacgtcggtggaaaacaattccctgtcactcgaggcca

SEQ ID NO: 164647 - DNA, 601 bp, Human
gttcccataagtccaaagaaggaaatggggccttttttgggtatggccctcttagggtaaagcaccccttgggcagcccactgggcacccctgaccccagcacctcccttgtagactcaggaaatcactcagcccttttgatcatcccgcccctgctcacagtcaacagggttcctatgcgtccagttaggcccggccatggggatctggccttgtgcccccgtagggaagaccaatgcagagggccagtcacgggattggtgagtgttacctggtacctcctgccagggacactgcagcycccaactgggcctagcctgcccacctgcaggccgtgtgagcagcgcacagggctcctctgcccacacccagagggggcagaaggtgaccctgcctttgttccctcacccagaacatggctctctatgctgacgtcggtggaaaacaattccctgtcactcgaggccaggatgtggggcgttatcaggtgaggggccaatggttcccttgctagggggctccctgctcccgggtgtgacctgaagccccaggggtggccggtcaaccagggccaggggccgtgggctctggctgccggagt

SEQ ID NO: 164648 - DNA, 601 bp, Human
gcccaggcccggtgtccccagaaatgttcctgggaggggcagggtagggcaggatggctgtggccaggcccaggacatacaggctgcagcctccctcatggcagacactgccccagatagcccggggtccgcaggaagtgtccgtgctcttcctgcctgtgttcctgagataagcggctcctgggccttcctccaggcgctgctctgccctgagtcgcagcggccccactcctggtcggcatgtgaccacacacccagggcagcatctctctgtggagggcaggaggggccagagaagggkctgctcccacctctcaccctcgggggctcaccccggggtcccaccaggcacacccaggaaccatctccagtctggcacccctccctgccccttccctgacccctcccccagccagctctcctggtctgctcttctcctgggacactcctacactgaggccccctgtgccaggccctgagagacccaaactgctggggcccatggggcaggagcaggcctccccgcacccctgaagcctgtgttgtctcttgacacccctggcttctcccagcacccccgctgccttgccccagtgcttcc

SEQ ID NO: 164649 - DNA, 601 bp, Human
acccctccctgccccttccctgacccctcccccagccagctctcctggtctgctcttctcctgggacactcctacactgaggccccctgtgccaggccctgagagacccaaactgctggggcccatggggcaggagcaggcctccccgcacccctgaagcctgtgttgtctcttgacacccctggcttctcccagcacccccgctgccttgccccagtgcttcctcgccctggagctgggcgccagcatggagctcacccctgcctcttcgctgacttgctccttgctcagcccgcggctrcctggctctttcccccagctgcggagggttcctccttgcagccggccctggctgcccaaggcaggttttctctccctgtctggtcccttggggcacacggtggcctcactcctctcacctgacttagatctctcttgtctgggtggtgggcgcaggggcgcgctgtgacacagcttccgccagccttccagctcccgcggcctccctccctcccctgccctctctccatccctgccccctctgtgactcacagtccctctgttagcgctcttgcggctttccaggacctgccccccttca

SEQ ID NO: 164650 - DNA, 601 bp, Human
gcccatggggcaggagcaggcctccccgcacccctgaagcctgtgttgtctcttgacacccctggcttctcccagcacccccgctgccttgccccagtgcttcctcgccctggagctgggcgccagcatggagctcacccctgcctcttcgctgacttgctccttgctcagcccgcggctgcctggctctttcccccagctgcggagggttcctccttgcagccggccctggctgcccaaggcaggttttctctccctgtctggtcccttggggcacacggtggcctcactcctctcaccygacttagatctctcttgtctgggtggtgggcgcaggggcgcgctgtgacacagcttccgccagccttccagctcccgcggcctccctccctcccctgccctctctccatccctgccccctctgtgactcacagtccctctgttagcgctcttgcggctttccaggacctgccccccttcaacaatctacatgcatataaagtaggagatgaaagaattctgtccttgtgtgcttgtgcgtgcgtgcatgcacccctccctgcctcttgctccagctcttggacactgtctttgtccctcc

SEQ ID NO: 164651 - DNA, 601 bp, Human
cccatggggcaggagcaggcctccccgcacccctgaagcctgtgttgtctcttgacacccctggcttctcccagcacccccgctgccttgccccagtgcttcctcgccctggagctgggcgccagcatggagctcacccctgcctcttcgctgacttgctccttgctcagcccgcggctgcctggctctttcccccagctgcggagggttcctccttgcagccggccctggctgcccaaggcaggttttctctccctgtctggtcccttggggcacacggtggcctcactcctctcacctsacttagatctctcttgtctgggtggtgggcgcaggggcgcgctgtgacacagcttccgccagccttccagctcccgcggcctccctccctcccctgccctctctccatccctgccccctctgtgactcacagtccctctgttagcgctcttgcggctttccaggacctgccccccttcaacaatctacatgcatataaagtaggagatgaaagaattctgtccttgtgtgcttgtgcgtgcgtgcatgcacccctccctgcctcttgctccagctcttggacactgtctttgtccctcct

SEQ ID NO: 164652 - DNA, 601 bp, Human
ccagcccctggaggtccagcctctgctgaagctcgggcagccggtcagcgccgtggcagctctccaggcagatgggcacatgatagccttcctgggggacacccagggccagctgtacaaggtgagggcccggccttgctgtccggctgggtgtgcccctggccacggaggctcaggaaagcccccagcaacttccacctcttagcccgcatcccacggttgggtcaggggactttgccacacagtgactgctggctgagcactgccccctgcagcccggccttcaccagctggtggtggstcacggtgaaggtggctggggtggctgggtgaggtgggcagggtgtggtgcctcctggtgaccttcctgtctccccatagctgccctcccacctggcagaactgtccctggtacacggggcctcacccagggtgccgctgctgccccggtgtcatggttccctggagagtgtcctaggcctgagggtgctgagtgggggaagtgatgtgtcctccctcgatggcccggcaggaaggggaactggctctaaaaaggagcccccactaggaggagggcgtgtccctggaacaggcaaccttt

SEQ ID NO: 164653 - DNA, 601 bp, Human
ggcctccaggctcagccatcagcccagacctgctgctggacagcagtggcagtcacctctatgtcctgactgcccaccaggtgagggccatcctggggctgaaggggccagcacacgcggcccaagtctcgtgcccattgcctctctgctctgctgcccctccaggtggaccggatacctgtggcagcctgcccccagttccctgactgtgccagctgcctccaggcccaggacccgctgtgtggctggtgtgtcctccagggcaggtgagcacggggcctgtgcctaggctagggccaaygggtggtgtgtgccacgaggctgcccctggaagtagccctaggcgtgccgggaggccaaccctgcctgttggagagactcagggccaccacggaggtcacccatcctgccccatctcactgagccgtcaatctggttggcaccccccttttccgacaccacccggcctgtggactcctcatcccagcagccccagccagggtccagaaccccacacagctgtcctccagccggtgctccacacggcagcccctggaatcctttaaggcagccctgagtcactgtgcgtccctcagcccag

SEQ ID NO: 164654 - DNA, 601 bp, Human
cgggggaccccatctgccatcatttgcctgctgcaggtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggtgaggcacttggagggtgaagatgggtggggaggccctcagagatggccacccagagataaggaaggcctgtggccaagaaacctggggcactcgggtcaggggaggggtgagctgtcccctgcgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagggtaggagggagggccaggaaggacaggcacctagtaaggatgtcaagctgggtctgcggggagcaggaagcaccgctgcatgtctaggagggaagccatggcat

SEQ ID NO: 164655 - DNA, 601 bp, Human
gggaccccatctgccatcatttgcctgctgcaggtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggtgaggcacttggagggtgaagatgggtggggaggccctcagagatggccacccagagataaggaaggcctgtggccaagaaacctggggcactcgggtcaggggaggggtgggccgtcccctgcgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagggtaggagggagggccaggaaggacaggcacctagtaaggatgtcaagctgggtctgcggggagcaggaagcaccgctgcatgtctaggagggaagccatggcatgtg

SEQ ID NO: 164656 - DNA, 601 bp, Human
ggaccccatctgccatcatttgcctgctgcaggtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggtgaggcacttggagggtgaagatgggtggggaggccctcagagatggccacccagagataaggaaggcctgtggccaagaaacctggggcactcgggtcaggggaggggtgggctgtcccctgcgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagggtaggagggagggccaggaaggacaggcacctagtaaggatgtcaagctgggtctgcggggagcaggaagcaccgctgcatgtctaggagggaagccatggcatgtga

SEQ ID NO: 164657 - DNA, 601 bp, Human
gaccccatctgccatcatttgcctgctgcaggtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggtgaggcacttggagggtgaagatgggtggggaggccctcagagatggccacccagagataaggaaggcctgtggccaagaaacctggggcactcgggtcaggggaggggtgggctgacccctgcgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagggtaggagggagggccaggaaggacaggcacctagtaaggatgtcaagctgggtctgcggggagcaggaagcaccgctgcatgtctaggagggaagccatggcatgtgag

SEQ ID NO: 164658 - DNA, 601 bp, Human
accccatctgccatcatttgcctgctgcaggtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggtgaggcacttggagggtgaagatgggtggggaggccctcagagatggccacccagagataaggaaggcctgtggccaagaaacctggggcactcgggtcaggggaggggtgggctgtaccctgcgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagggtaggagggagggccaggaaggacaggcacctagtaaggatgtcaagctgggtctgcggggagcaggaagcaccgctgcatgtctaggagggaagccatggcatgtgagt

SEQ ID NO: 164659 - DNA, 601 bp, Human
cttggagggtgaagatgggtggggaggccctcagagatggccacccagagataaggaaggcctgtggccaagaaacctggggcactcgggtcaggggaggggtgggctgtcccctgcgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagrgtaggagggagggccaggaaggacaggcacctagtaaggatgtcaagctgggtctgcggggagcaggaagcaccgctgcatgtctaggagggaagccatggcatgtgagtggaggtgggcagccaggccagtctgaggcacgaagctctcaggatctgttgccctgggcacttggtggcaccgtttcctgggtgggaagcctgggacaggagcagtgagcgcaggggtgggttctgcccaaagaggcaactggatttgagagtttagagctccaggtctgggggctgtaagctgtggtgg

SEQ ID NO: 164660 - DNA, 601 bp, Human
ctcagagatggccacccagagataaggaaggcctgtggccaagaaacctggggcactcgggtcaggggaggggtgggctgtcccctgcgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagggtaggagggagggccaggaaggacaggcrcctagtaaggatgtcaagctgggtctgcggggagcaggaagcaccgctgcatgtctaggagggaagccatggcatgtgagtggaggtgggcagccaggccagtctgaggcacgaagctctcaggatctgttgccctgggcacttggtggcaccgtttcctgggtgggaagcctgggacaggagcagtgagcgcaggggtgggttctgcccaaagaggcaactggatttgagagtttagagctccaggtctgggggctgtaagctgtggtggggaggaggctgtcccaagggggacagagt

SEQ ID NO: 164661 - DNA, 601 bp, Human
gagtcctcgctggggcccccaggcagggggcacccagctcaccatccgaggtcagcacctccagacaggtggcaacaccagtgccttcgtgggtggccaaccctgtcccatgtgagtcccggcctggctgccgtcgggtggtgggcactcccataggcctcagtgggggtggtacatttagagaagtggttgctgtggccacccccagtggtccctgcccttgtcaaggcaggcaaagcagggcttctcctacgggggttgggccagggctggggtagaggggtggtagagccgagatgasagaccccactacccatcctgcagcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggtgagggtcagcccgcaggccagcctgtgcaccacgcaggagggaaggtgggatgcgggctgggctatgttgcccaccgcccgcccacacccgactgcca

SEQ ID NO: 164662 - DNA, 601 bp, Human
caagcgacacctgaggtcacagcgtaaaacagagacagagacaacagccccatcactgacttgaagcaaccgatctgtgccttccctagggtcccatgtccaggcagccaccctcactcccctgagcaccctcgtggtcaaagcccacagctatggggctgcgggtcagagtttgggacaaagctaaatggcacgtggggtcagtgggcagctttcctatcacacgctgatcagtgagccggtgggccaggccagaagcgccctgtgatatctttggggatcccgctcaccagatccttcyacaggacccaagaggtgctgatctcattctagaacactccaggcagggcaggggccctccccacccccgtcaagagaggtctgtcagggagcacagctcctggtgtgacgacaaacctgcggctcctcatctcacccacgagtcctggttccgccccctgaaagcacacgagcaagctctcctcccttctcccagcttttcaatgtgacagctgctctcagtcacccctgaatcatctggggggtgtcatgtaacccaatccttgggcccctcatcctggaaatgctggctctcagctgg

SEQ ID NO: 164663 - DNA, 601 bp, Human
tgcaaccccgactctgtgcctctgagctggcctgggtgagatctcagcaagcagacggcagaaggaactgaggcccctccacatgactcaagacgcaagatgggtcccccaggacgtgacagggcatggggggattcctgtggggtgggaaggcttccacacagggatgctgtgatattgtgatataatacagactattcagtttggtggccaaaagtgttgtgagaccatagaagaggaaaaacagtgttttttttccatattcaggtgtgcacccagggccaggcggctgaccatggtygggaatgcatgccccactgcactctggtcccacccagtctcacactgtcacccccagggctcaatgcggaaccgtgtgcaaggctagcccttatccaaagcacaactcccagcctgggtagcacagggagaccccgtctctacaaataattttaaaacactggctcagtgtggtggcatacacttgtggtcctagctactcaggaggctgaggcgggaggactgcctgaccctcagagtttgaggctgcagtgagctgagaccgcaccactgcatcccggcctgggcaacagagcaagac

SEQ ID NO: 164664 - DNA, 601 bp, Human
agccatggggatgagacccggcctctgctctgacctcccggacttcctctggtctcctaggtgatggtccaccagcatccctccctgcccctgctgccacacctatggtactccagaacattcttgcaagccagaggcagcagtctcagcagagctgtgacagaagcttctcaaaagctcatgagggtgaggcgaccaccaagaaagagggaaatcagaccttaggcactgctttgcttccacaggatggcacagccagccttcagctgggaccaggcccctccctcatgtcctcaaactygactcccctcacacctggcaggccagggcttccccgaaaacctcctcctatgaggggtccctcagaggattcaccacactctttccagaaaccccaaactgggggccaggtgcaaccccgactctgtgcctctgagctggcctgggtgagatctcagcaagcagacggcagaaggaactgaggcccctccacatgactcaagacgcaagatgggtcccccaggacgtgacagggcatggggggattcctgtggggtgggaaggcttccacacagggatgctgtgatattgtgatataata

SEQ ID NO: 164665 - DNA, 601 bp, Human
acgaagccataggctgcacacccagggggaatgtcccccctcacggctgggatgaaccactggttggttgctggggaacagaaggaggcagaagtcagaacacccgggagcccccattcctctcattccccaaatgtgccagccgtcaagcttggtgagaggggctgagccagcaccatccctgcgggcgctctagcaactccagctgcgctacctgggccatcttccaaacccctcgacttcaggccagtgcaaaagagcctgtgaccaccctgcttctcgccaaggtcatcttaatgarcgggaagttactgtgcaagatccctcatcagctactgggaatctagccactgccttccttccctagcactcagtgatcagacatgaatttctccccaaaataccctcttggtgggcctgtgctcctcctccctggagcccacatttttgtcccttcatcacagggtcaggacagccagagcccagagcagcactttcaagtggccaaaacagtgaccgctgcaggctacgaagagccatggggatgagacccggcctctgctctgacctcccggacttcctctggtctcctaggtgatgg

SEQ ID NO: 164666 - DNA, 601 bp, Human; identical to SEQ ID NO: 32264

SEQ ID NO: 164667 - DNA, 601 bp, Human; identical to SEQ ID NO: 32265

SEQ ID NO: 164668 - DNA, 601 bp, Human; identical to SEQ ID NO: 32266

SEQ ID NO: 164669 - DNA, 601 bp, Human; identical to SEQ ID NO: 32267

SEQ ID NO: 164670 - DNA, 601 bp, Human; identical to SEQ ID NO: 22807

SEQ ID NO: 164671 - DNA, 601 bp, Human; identical to SEQ ID NO: 22808

SEQ ID NO: 164672 - DNA, 601 bp, Human; identical to SEQ ID NO: 22809

SEQ ID NO: 164673 - DNA, 601 bp, Human; identical to SEQ ID NO: 22810

SEQ ID NO: 164674 - DNA, 601 bp, Human; identical to SEQ ID NO: 22811

SEQ ID NO: 164675 - DNA, 601 bp, Human; identical to SEQ ID NO: 27709

SEQ ID NO: 164676 - DNA, 601 bp, Human; identical to SEQ ID NO: 27710

SEQ ID NO: 164677 - DNA, 601 bp, Human; identical to SEQ ID NO: 27711

SEQ ID NO: 164678 - DNA, 601 bp, Human
aagtggtttttaagaccaaaagaagcaagacctagctctagggtgaatggcatgggattgtattttgggcatgtttctgttacctcaagtttggtaccattagaagggatgtagcagggatactttggatgcataattttttaggattagttgcagataatctttaaataggtagatttttttctaaatcttccagaatatacagcaacttacatctgcttttcacattgtatttgatttgttggatcatcttttgcatcagggtttggatctggattccaacaagtttgagggacaacacaacattgacagcgctggttcccctgttatagtttgactggatcattgtattcaacagaggttttaggcggatgtagttttcttcacttacctctgtggcagagaaggaaggaaataagaaacacatactcagaaaatagtaagacttgcagcaggggttatataaaaatatttagtaacagatatggcacagacctagaccaatccagtggctgcagactgtgttggtggaataatacaaaggtgggtcttgaacccacccccatgccagacattactcctttaacaaccaacatgaaaa

SEQ ID NO: 164679 - DNA, 601 bp, Human
tcagttcaaacttagtaaggcaatcaacaacataaatagtaacaacaacaatacagataaccttatgactggacccgtgcttacacctccagcctcctgttatgtttcccaaggactctgtgctggtcatgccgaacaccttgaccttaaaatgcctaacattcttttgtgcttttgggtctttgtcctcactgtcgtctctcccttgaaagtcctctagccctgagtcagcctggaaaatatctattcatactgatgatgcagtaaagttttttttttttctgtaaaccttccttgatcrcttcttatatcatccccttagagtttgtaaatcaatggctgaatgaatgcaggaataaagtctcagacctcaaagagcatatgcacgacagtgtaggtgctgagtgtgagttttgagaacaacagcccaggtcccatcccaatctacaccactttctggttttgtgagattagttagattactgacacagttactgtgactcatgctcctagtttaggaaatggaggtgatggggtagtttgctcttatcagcgggggatacattccaagacctacagtggatgcctgaaaccatggata

SEQ ID NO: 164680 - DNA, 601 bp, Human
tgtcactggtataccataacaagtttttgttttatgtattcctaaaatggtagtagtgtataaccaacaatcacagggtgacagcaaggcaagctcagcctcagggaatgttgcctgcctctcccaagtgtctcagaatggaagactttctcttttccaatcgagacctgaccgcagctcctgagtccatactagactggatgcttgtgcttctggggttagaataaaaagcgatccaggctctggggaagagatggttgatagctccccaggtctgtaccatcctccttgctggaacagrgcaggctcctgagtgatagggcaggcgcctgagcggccttttctcgttaaagttgtttctcagtatcttgaaatgtctctgtaagttgcactttgcaatgaatttcatgtacttgtattagtttagtattgctgttccttgactgtttgtcttaataggtaactcctacatatttcagtatgtttttcattttctatgattgtaataaaaagggcgaggttggagatattttttctgattgtctgaaacctaagatggtcctatacacacagtagacatttagtaaacattatttaactt

SEQ ID NO: 164681 - DNA, 601 bp, Human
cactggtataccataacaagtttttgttttatgtattcctaaaatggtagtagtgtataaccaacaatcacagggtgacagcaaggcaagctcagcctcagggaatgttgcctgcctctcccaagtgtctcagaatggaagactttctcttttccaatcgagacctgaccgcagctcctgagtccatactagactggatgcttgtgcttctggggttagaataaaaagcgatccaggctctggggaagagatggttgatagctccccaggtctgtaccatcctccttgctggaacagggcrggctcctgagtgatagggcaggcgcctgagcggccttttctcgttaaagttgtttctcagtatcttgaaatgtctctgtaagttgcactttgcaatgaatttcatgtacttgtattagtttagtattgctgttccttgactgtttgtcttaataggtaactcctacatatttcagtatgtttttcattttctatgattgtaataaaaagggcgaggttggagatattttttctgattgtctgaaacctaagatggtcctatacacacagtagacatttagtaaacattatttaacttgaa

SEQ ID NO: 164682 - DNA, 601 bp, Human
cagtattccattttgagtttcctggttctgaggtgttccttgcccatgtcagtggttctggatctgggagagaaagcacaggtccctactgccctaacaaagggaggactgaccgttggtgctggcccccacctctttgaatcccttgcttggagagagaactgattttttcaaagttgaagctgagtctaactctgctggacatgtccttccttcactatatcaactctaataatctccccagagattcccattacgcctatggcatgaaacaggtttttcttattgatggggattgccsttgctccccgggagctggtgaaacaggcagaatttcaagccccatcctcacccactgagacccaccaccgactccttaagctgaatgtgaattttaatgaggcccccaggtgattttgcagtaaattaaagttcggaaatagtctaatagtaccagctcatatcctggcttcccagtcctttaagatagcgctagccaatagagaatgtgtaatttaaaattttctagtagccacattgaacaagtaaagaaacaggtgaaatcaattttaatatatttaacacagcatgtgcgaaatat

SEQ ID NO: 164683 - DNA, 601 bp, Human
ctgaccgttggtgctggcccccacctctttgaatcccttgcttggagagagaactgattttttcaaagttgaagctgagtctaactctgctggacatgtccttccttcactatatcaactctaataatctccccagagattcccattacgcctatggcatgaaacaggtttttcttattgatggggattgcccttgctccccgggagctggtgaaacaggcagaatttcaagccccatcctcacccactgagacccaccaccgactccttaagctgaatgtgaattttaatgaggcccccrggtgattttgcagtaaattaaagttcggaaatagtctaatagtaccagctcatatcctggcttcccagtcctttaagatagcgctagccaatagagaatgtgtaatttaaaattttctagtagccacattgaacaagtaaagaaacaggtgaaatcaattttaatatatttaacacagcatgtgcgaaatatttcaatgtgtcatcgacataataatgacacgtttttccttttttggtactaaattgtcaatcaggtgtatattttacattatagcccatctcagtttggattagccac

SEQ ID NO: 164684 - DNA, 601 bp, Human
tatttgtgtatgttctgaatagaatgctttcatttatgcctgaattgtgatgaatatgcattatttaaatgaagtatatactttccctagaaaatactgattaaatcaaatcttaccaatttgatttcagtcaaatccatgccactctaaactgccatcatttggagaaaacaaaattcttaatagagaaaatagtgtgagttaaattgtccattcttttttcattctgctcggctgcctctaaattatctttaaaaaataaggagtatggaaatttgaggcctgttgcacaattaataarcattaagtttttttagatggcaattagagcactacgaattaaaattcctggaatgtgtatggcgtcttctgctgagctcccccttgtgcatttagctccccttgtctgttctcccctagtcccctgcacctttattggagctctcacatactgcctgtgctctggttcatcgtttctatgtcttattaccactggggcctagtatggaaatagaacctgtaaagtagtaccgtttgctctcagttgccatatttaagtctcagatgtcacatatgtttgaaattgcatacaaattcagtt

SEQ ID NO: 164685 - DNA, 601 bp, Human
tttaggggaaaaaaatgtggattatctcttgaaagtctctcattggagccataagctctcatggtttaaggttttaagagcaaaatgatttccagtcaatgatgcatgctttaaaatgataaacttaaaggcttgaaggcttaatcattctcctctttgaaatataggagaacatattgctttaaaatatctttcattcgtcagaaaatggaagttagtatttaggtaatattttgatgttatttttcatgataaacgtatactaaaaggaagggatcaactttggaagggctagatcacyacggcttaagaatatagaagcatctgacagcttctaagccaagtgctaatgttctgggcaaattttatatgtggattaacaccctcctttcagacttcaatgtatttgaagcagatgtgatgaccattgttccagggaaccttttgattaattcagatctgggttgtttagcttaaatggctaaaacctcgtgctaattagatggcgggcctaagcgaggtacctttgggaattagccatacaccatgagaaattctcttctgagtccacaaacttgcacacattctagtcttgaaatgg

SEQ ID NO: 164686 - DNA, 601 bp, Human
aatggagaccagtgggatgtgttcatcccaatttctggataagagcaaagaagatattttacttttgatcgtcttcatatatgaagttttggtggtaggtatcagcgcctgaaccttaacccaggtggtaactaatggaactagcataaagtagctttattaagtattttttatttagaacttgaagagaaagggatttcaaaatcattacgagtcattaacacattcaaggacatccctgaaagatgagaggcatatttctattataattaattattctgatttagcttctccttatgtktattctaccaaagatgtactattctttcggccacctgttttatatcacttcagtgtttgaaatgaacctagccaaactctattctagactattaaaaagaaaaaggtttggtgcggtggctcacacctgtaatcccagcactttgagaggccaaagtaggaggatcacttgaggccaggaattggagaccagcctgggcaacacagcaaaacttcatctttactaaaaattaaaaaacgagctgggtgcagtggcgcatacccatagtcccagctactcaggaggctgaggtgggaggat

SEQ ID NO: 164687 - DNA, 601 bp, Human
ctgctgcaaactgaaaaaaattttgttgcatgtttgacaaaaagctgtcatctcactggcgttttgaagtggacacctgtttgtttcaggtatgtaaacactgcagtaggagtgatgagtccagatgtgtgtggtctgattctggagtcagctctgctattttgtaaggagtcaagggcagattccctgcctcctgttgcccagagaagtagagaaacagtgtccatgtcctgagattgccacagtggcctgcttctacctagccctccttgcctggtctgcccctgcattctggcccacrccccgtctccagcgtgttcgtccttagagtgaggccgaccagcttatttctcagttccaaaactatcatcggttccctgttgcccacagagtgaaatccattctcttggtatggcctaaaagtccttctgactcctccaaccttgactcacatcacttcttcccaagtgcattgttctcaaactacgcagagcctttccttctcccatcatgcatgtgccattctcacggaacctggatgccctttctccacccctttcagaagctgctagtcatccttcagaacctacctcaagagcca

SEQ ID NO: 164688 - DNA, 601 bp, Human
ctcttcacagcagaggtaatcaccatccaaaagttggtatttctcactcgtggtcatttcacacatccctttttaaaatagaatggaatataggaaatgtggaggaagctaaaggaatgggggcttttaaggcttccagtggagcagatcctaacccttggtcagtataatttggctctaggttcaggactgctggcagggtgagaaacatgttggatatagagttttcattttctgaagacaagtcagaaacagcacattcttcctggattaaattcaaggacaaatttgttgtttggcytttctctaaaagatagtgacacagtgattcaattcttcaggcagtgtattacccaaagattcttgaatccttttcaatttgatggctcttttgttgattctctataaagatggagcatacagtgttaacttttagttggtaaaagtgcttctgtgaagaactatataatgtggcctactttgtttttctgatgagttgccagtgcaaaggtaatatttggagaatcaagacgagtaggcagtttacatgtctgtcaaactctgtctcaaatacctggttatgaaatggctttcagatggg

SEQ ID NO: 164689 - DNA, 601 bp, Human
cagccagttaatttttgtatttttagtagagacattgtttcattatgttggccaggctggtctcggactcctgacctcaagtaatctgcccacctccgcctcccaaagtgctgggattacaggcgcgagccactgcacccagccttgcccaagtatctttatttgaaaacaccttcttgtattcctgctaccactgatactatcatcctctttcttccccttattgcacaaacttctttaaaaattagtccacacatgctgcttccacttccgtactattgactccttacttcttgtggtytggcttctgttccctattgaaactactttactgctcaattccagtggccttggttgagttcttgacttttaaatttctatgcagggattgattctgttgactgctccttcctttatccttttccctatacattcctggctctcctctcatttctgcctcttgccttctatgcggctcattttttctttcctacctcctaaatattattttccccagagttctgtcctcaccctcttttttctccattgtcagttgctttccaattctctagctccagttccaatctttcattctgtattc

SEQ ID NO: 164690 - DNA, 601 bp, Human
tttaaatttctatgcagggattgattctgttgactgctccttcctttatccttttccctatacattcctggctctcctctcatttctgcctcttgccttctatgcggctcattttttctttcctacctcctaaatattattttccccagagttctgtcctcaccctcttttttctccattgtcagttgctttccaattctctagctccagttccaatctttcattctgtattcattgagtatctgagagtccagtatgtgttaagcactatgccaggtgctaggatatgatggtgagcacmgcaaacagtttctccctcacgaagcttatagttctcatgggattgataaacattcttctgatagtcacgccaatatataataacaagctgtgatcagtgttgcgtgggagtagtacaggggcacaacagtttgaggagcctgggaaattgtcctgagaaaatgcttgacctggggtctgaagaatacatataagttccctagatgtgagtcaggggctggggaggtgagaagaagctgagagaacagcatatgagaggacctgagaccaaaggaagcatgaaaaatgacagtatggctga

SEQ ID NO: 164691 - DNA, 601 bp, Human
tgcaatcatagctcactgcagccatgacctcctgagctcaagcagtcctcccacctcaacttcctgagtagctaggactatagctgcacactaccatggccagctaatttttgtattttttgtagagatagggtcttgctgtgttgcccaggctggtctcaaactccttggctcaagcgatccgcctgcctccgcctcccaaagtgctgggattgcaggcataagccaccatgcccagccctttaatttattttttaattgacaaaaattgtatatatcgtgtgcaacgtgttttgaaatrcatacacattgtagaatgagtcaatcaagctacttaacataagcatggcctcacatacatattttgtgtggtcagaacatttagaatttactctcagcaattttctagtacacaatagttgttagttgtagtcactttgttgtacagtagatctctggaacttactcctcctattaactgaaattttgtctcctttgaccaacatctccccattgccttccccaggatgatgatgatgatgatgatgatgattattattattatttttgagatgaagtctcgctcttgtcccccggctag

SEQ ID NO: 164692 - DNA, 601 bp, Human
tgaaccctagggcccagtagagtttctgttacttagtgtatgagacagacagacagacagagacagagagagagagagagaaagaaagaatgcattattttaggttatttaactcccctattttcatgtcaattactttaggtagttagaagtacaaggcatagacttttgagttagaatgggcctttgaaaatccttaaatatttaatgatatttagatactgatgactcaggtatccagaaagttcagctaatttgcctattcctggatcttgcagtttggcctgctgggttatctgaycttgaatgtgtcattcagggagaatgtagcaagtaaccttattagacggtgggtgcctttggtcagaagctggctggttctcctcagcgacctgttttctttttttctgtgtagggccagggctctttgagctatacagtttcctctgtacagagacaaagagtagcaaggtgttagctcacttttaattcttccacttttttcaaacatccttgcttccatgttgatgctagagtatcagacttatttagtgtctattctgtgtattttatgtataaatttgacatttaagaatacagt

SEQ ID NO: 164693 - DNA, 601 bp, Human
ggggatacttcacctatatcctggaacggttgtgaggataaaatgagatgatgcgtgcaaagcccctaatgtagtacctggcacagaagagaggtatttcctacatggcagctgctgtgatgatctcctggtgatgattgtgctattacttgactaacatgattccatcatgccagcagtcttctagaccacttgcacccagcgttggatagcaaatgatggagaagccttgctgtgcattaaggcccttctgctttgggaaatgcacgcatgccagagacaagcaccatttccagatgcktggtctctagtgggggaatacatatgtgtaaattcgtggtaacaaggcagagtgaagcaagtggttaacagcagtcggaatcaagtgctatggaacttctgaggaaaaagtgatgaattctgcctgatctaattgggaagcaaggcctcattagaggtgatgcttgctgagccaaggcgaaagtcatggggacaattttggtagctgggaaagacagatcattctaggcaaagggaacaccctgagcaaagcaggtggcttgatcgtagatgaagcatctgaagaatgaagaagtttact

SEQ ID NO: 164694 - DNA, 601 bp, Human
cttgactatttacgaacaaaaggcgtaggaacaactcaccaagcataattctgaaatgttacatatgtatattttttggagttagcatgagcccaaaggtgatggcttagaacaatgttgtagcacaaccttttaactaaattgtctccccagaaacactgacgtcacagagtcatattccattttctcagtaacaaacctgacattgatataaaggaaatctgcttcggtgagataaaagactcactgtcctgtctctcataggtcaactttcgcctgcagtcaataaccatgatacaaycgcatttctctcttgaaacaagtagttacaactcctataaatttggctatgccagcaatgcacatagagatttctgcttgccagtagcaactttcccatggtagatacaagtcccagaggatgttgtccagcagcaggagaaaggtagttctgaatatgcaaattcttaccctgcaggccccataccaacccctggtgcctgtgtggagtctttcaaacaaaaaaaagtgaagtaaaaccataccaccacaaagccttctctttccttccccacctcactcccatgtactcgccttaaag

SEQ ID NO: 164695 - DNA, 601 bp, Human
aaaaatatatgacttgcatgagggcttaaaatgtcagtcatttaggaagagagcttctgtattttaatgacatgtttgacaatgttgagattatatttgatagcaggtactctttagaaaagttgtttgaataaaatagttttataattaaaaaaaatatcagggccggatgtggtggcttgacacctgtaatcctggcactttgggaggccgaggcaggcagatcacctgaggtcaggagttcgagaccagcctggccaacatggagaaaccccatctctactaaaaatacaaaaaattrgctgggcgtggtggtgcgttctgtagtcccagccactcaggaggctgaggcacgagaatcccttgaacccaggaggtggaggttgcagtgagccgagatcatgccactacactccagcctgggccacagagtgagactatgtctcaaaaactaaattaaataaaataaattttaaaaaatttaaaaatacctcagaacccagtgaaagtagatggatcatcgtagatgttgtgcaaggcaaggtttgatttttttttcctttttataaaatgaattttagctctgtcttctccttagtgc

SEQ ID NO: 164696 - DNA, 601 bp, Human
tcttattaactttgccttgatggtttcgtttagtttaaagtcgtcactgctatgtagatgacttctaaatctaaccctgatattgtccttgagtgagtccaatgagtctaaccctcaaattccttcctctgggagtctgagaatcatgagctcatctggcgcagtggctcacgcctgtaatcccagcactttgggaggccgaggaggatggatcacttgaggtcaggagttcgagaccatcctggccaacatggtgaaaccctgtcctactaaaaatataaaaatattagctgggtgtagwgctgggcacctgtaatcccagctactcaggagtctgaggcaggacaatcgcttgaacccgggaggcagaggttgcagtgagctgagatcgtgccattgtactccagcctgggtgacaaaagcaaagctccatctcaaaaaaaaaaaaaaaaaaaaagtagaatcacaaacttcttgttgccctgacctctttgcagttcatgaaacctacctttcatcctatatgtcctgcaagtttgaggatccccagttgtttaggtttgataacttgaagtcagcttttcagttccccccctgctat

SEQ ID NO: 164697 - DNA, 601 bp, Human
catttcatgtcttgtgttgggtggtgtcaggatgcagtgggggcagtcaaggatttagtagtgtgtaggatgagtgatacctagtcccattgagggatgtgacagtcaaacagtagtgatgtgacaaatatgtttagccccaacataagatagtatacattcatttgtgcaagagaaacgcaaaggaaatccacgggggactcacaggaagaagagaccacatctaaccaaaattggaaaggcctacatggaattgatagttgttagtatagggccttgaagaatggatttaatttccagygaaggacttctgaggtctggggcttgagtgatgagggtggggcactgtccacagagtagggaagtcagaaaaagattttatttgcagaaacaggtggaagaaaggggaagggggaggaacaatgagttctgttttggacacatagcatttcatgtattttgacagaattgacagcaagccactgaaggcctgcccctcagtaaagagtctagagatatagatttggaatagtggttcttaagtcatttgaagttatgggctcctttgagaatacgatgtaaattatagtttcttttcccc

SEQ ID NO: 164698 - DNA, 601 bp, Human
tgaaggacttctgaggtctggggcttgagtgatgagggtggggcactgtccacagagtagggaagtcagaaaaagattttatttgcagaaacaggtggaagaaaggggaagggggaggaacaatgagttctgttttggacacatagcatttcatgtattttgacagaattgacagcaagccactgaaggcctgcccctcagtaaagagtctagagatatagatttggaatagtggttcttaagtcatttgaagttatgggctcctttgagaatacgatgtaaattatagtttcttttcccytcaaacatgcagtcatgtacaaaaccttacctaaaattttagaggacttctggcccctctgaagcccctttgtagggccctggtaaagtaatcctggtatgtaatagagaagtcctgaaccagaatcttgggagaggccatcttttagggagtgaagataggaaaggagccagaaaacggaatggttacagaggcgagggaagagcctggaaaggattaacaggatgtcatgggtgtcagtgctgggagagctggggagatggatcacaagctccctagggacctgaccctaactgacct

SEQ ID NO: 164699 - DNA, 601 bp, Human
tatcgagtgaatatactaatgtaaacagagcgaattaatcggaatcagtagcaaccaagacatcaatgagaatattctgctttttagaaatagcatttattcaataaatatttactttttaatttaagttgtaaataggtaatatatgttcatgattgacaattcaggaactgtaaaagggtatacaggaaaaaatctccctcccggcacacttcagctacctcattgccctcctcatagacaacccaggtttcagtttattgtgtctccacccagtgatagtttaggcctatacacttarctgattcacatgccttcccccttaaccctaatggtagagagctatatacactgtcatgtacctatttccatccaccaatagacattgcccagtgaatgtgcttctccaccctatgatcttcattccatgtactaccttaattcctcattgccatatatggtaacgtaacacaggtttgagggattaggacatggacatctttgggaagacattcttcttcttatttttttaaacagagtcttgctctgttgcccaggctggagtgcagtggcacaatctcagctcactgcaacctccgcc

SEQ ID NO: 164700 - DNA, 601 bp, Human
atcagactcaacatctgtttggtccgtggtctctagggccagacctaaagaaaaggtacaatgtctgtccccaaagcaaacacccacatagctcacttttgtgtgtgtatctgtgcatttgtgagaatggggagagaatattccaccacctctggatcttttccatactaaatacaattttgtgggggagatgataggatgggaggtgtcttctgtgtctccctgtcacattagcagtctgcttaaaatgcaaatgactgtatttctcacacaaactatagggcaatcatcgattccgaayaacttgattgaaaaaaaactcatcggaggtggcgaaatgagcctccccagagggatcttcctttacttcccctcatgattttcttcatgagctcagcctctttccactttggagcagactgaagcattcactctattttgagcagggagaggaagttgcctgatctcttttctaccctcagttagagccagattaagatgaagcagggtatttttttaggggatgggaggggtgcatgggcgggggatgaacttgggtttatctgtgtggtacaggtagtaaagaatatgtggacacaaa

SEQ ID NO: 164701 - DNA, 601 bp, Human
aaggattggtaagatctagcagcaagccgcttctatttttgtggcggtacatcgtgatgaattaatgtggaactgtgctaatgtctgtttttaccagaaacattagcgatgagtaataaagtatatttttccttttattttttcacttattttcagttatttatgaagagaactctagtttcaagaatctctttgaaaatcaccataactatttaaaaaccacatgtgtagagaagcaggaagaggagaaagtggcccacttaaataataaattgcttatttattagctaataactttttwaaaacaacactgtgaatgtttactgtctacttaccagtgatactatttagagcacgctctaaagaaatatttctgcctaactatattttcttgcctagagtctttagagaccaagatctctggcttttaacataggtctccaagtttgaaacctaaatggatggtagccttacttctgcaggaaacctttttctgtgactacctccaggaaaaaacaaaaacaaaaaacaaaaaaaaacctaagtttctttggcccttctatccatggctacaagcttatattccttccattgttgttaa

SEQ ID NO: 164702 - DNA, 601 bp, Human
acaccatgcatttggggtagtgatgggccgtccacctggtggtgtctagcaggcaggctttctgcaaagtagaacccaaaatagagacttaacacagagatgttggtttggcagtcagctattgggcaacaaacgcaagcaaagccctttaatgtagattctgagagaggatgtgtggggaaaagatcagaggactttgagtggagctttgggcctgtttgtattcagggcaggaggtgagaagtggagctcagtgaaggaggcataccagagaaatggacatcaaaggaggatattggarggtaaagaaagggtcttaagaagaaagggtcagtggtacttgaaggaggtttattagcgaggtcctttatgaccttgggggtgtctagtgatgtggtgggtgtgagtgagaaaatagaggtaatgaatatcaactgttcttttaataagagagagagttaaggaagggggaagtgttgaggatcatatgactatgagaagggcttttcaagtcatgggaagcttcagcctgttttgtagacaaagagaaaagatttacttcaggaatttttttaagggaaataatcacacaggtctgaaa

SEQ ID NO: 164703 - DNA, 601 bp, Human
atagtaaccaaatgctagaaacaaccaaatgtctatcagttgatgaatggataaataacgtggtctatctatatacaatggaaggttatgtgaccatgagaaggaatgaagtactgattcgtgctacaacacaaatgaaccttgaaaacatgatgctaagtgaaagaagccaatcacaaaaggccacctattgcattatcctatttatgtaaaatttctagtaaaggcaaactatagagacaggaagcaaatcagtagttgcctggggctcaaggtgggagaaagattgaccttagatggyacaagtaaactttttgggtgatgcaggtgttctacaactacattatggtgataattgcacaactgtataaatttgctaaatcttattgcactcacactcaggatgggtatattccattgtttataaagtatgtttctgtaaatgcatgaatcatcaaaaaatgacatcatagcaataacttgttatatacataaatttattgatacttctaagtctcaaatttttactagaatactttcactttaagtaccctactgattatgagccagataagagttgatatattgccaatttaaaggt

SEQ ID NO: 164704 - DNA, 601 bp, Human
gtagggacatggatgaagctggaaaccatcattctcagcaaactgtcgcaaggacaaaaaacccaaacaccgcatgttctcactcataggtgggaattgaacaatgagaacatttggacacaggaaggggaacatcacacaccagggcctgttgtggggtggggggagggatagcattaggagatatacctaatgctaaatgacgagttaatgggtgcagcacaccaacatggcacatgtatacatatgtaacaaacctgcacgttgtgtacatgcaccctagaacttaaagtataatttwaaaaaaaaagaagaaaagaaaacaaatgcagcgtctgtagaggacgatcaacagatcctgcagctcttagtgtttccttttgataaatctttgttctggacgttaatattttaaagcatggctttttctaagtttaaaaactatcaaatgtaagcagtatcttataactccctactgactcacgtatttttctttgtcagctcgttttgacaggagccattcaagtagcagacaaagtttcttcagggaagagttcagtgcttgtgcattgcagtgacggatgggacaggactgctcagc

SEQ ID NO: 164705 - DNA, 601 bp, Human
atggatgaagctggaaaccatcattctcagcaaactgtcgcaaggacaaaaaacccaaacaccgcatgttctcactcataggtgggaattgaacaatgagaacatttggacacaggaaggggaacatcacacaccagggcctgttgtggggtggggggagggatagcattaggagatatacctaatgctaaatgacgagttaatgggtgcagcacaccaacatggcacatgtatacatatgtaacaaacctgcacgttgtgtacatgcaccctagaacttaaagtataattttaaaaaaaragaagaaaagaaaacaaatgcagcgtctgtagaggacgatcaacagatcctgcagctcttagtgtttccttttgataaatctttgttctggacgttaatattttaaagcatggctttttctaagtttaaaaactatcaaatgtaagcagtatcttataactccctactgactcacgtatttttctttgtcagctcgttttgacaggagccattcaagtagcagacaaagtttcttcagggaagagttcagtgcttgtgcattgcagtgacggatgggacaggactgctcagctgacatcc

SEQ ID NO: 164706 - DNA, 601 bp, Human
tttaaagcatggctttttctaagtttaaaaactatcaaatgtaagcagtatcttataactccctactgactcacgtatttttctttgtcagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctgtragtaaacaaagctaatttctaaaaatagatcactaccattcaggattttaaaactagttgttaaattacatattcagtattacaatgaaaatctgaggagtgtaataaaaactttacgcgtttgaaaatgcatgatgccttgggtagtgaaagtctttttaagagatatgtttatccatctgcactgtttgcagtttcacttgaaagcaatacaaagaatcttcatagaaatgtttacattgaaatttcataagagaaggaagacagacaattctttctcaaataatatagctattagag

SEQ ID NO: 164707 - DNA, 601 bp, Human
ggaagacagacaattctttctcaaataatatagctattagagtcaaatatattttatagacttttagttgaggctttttatttctgatatgcattttaaaaatcatcgagagatgaataagttcaaaagagctattgtataacatgatgactgtagttaatatatttttgaacaatgttaaaagaatggatgtaaagttttcttaccacaaaaatggtaactatgaggtaatgtgtatgctacacattaaacagacagtcaatatatataaatttctctctcaattaaaaataaataaaawttttttaaaataacccccccaagaaaatttttttaatgaaatcatcaaaagaacatactaaaattcatattcctaggtcttatttccagatgccctctgaatatacattttgacccagctccccagtgattctcatgaaggggatctgtaggctaccctttcagaaacactgctatgtatccttttagccttcacccaggtttcatagtgtgaataacattttcaagtagaaagaatcattgtgtttttttgcttgtttgtttgtttgtttgtttgtttttgagatggagtttcgccctt

SEQ ID NO: 164708 - DNA, 601 bp, Human
tgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttytagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttcttctgcttggaggatttggttttttggtcgtcct

SEQ ID NO: 164709 - DNA, 601 bp, Human
gttaaaaatgtcttctataagaaaccctggctcttcccccctcttggacaacaaaggaacaacaaagaatatcattctaaattttccatttcagtggaaatatgtttagtcttagtttctaaatatatattttcttctggtaggtgctttaggatgacctaccaagttgggatttaagttttaagaaaatgcgttagaaataattctgagcatatttgagtaactgaggctaagtagacttttttagagtgttgcaaattttattcttctgaaactttagaaaagtttgcaccctataatyctttaactggttacagttaaaaggggtaatgaagcatatattttaattcaggtttagatgtcagaggaatctaagacactaaagaagtgggtccatcgacaggacaacagatggtatctggcactgcagtggcaacttgaacagtttcacatttcacccatcaccttaatttctatcttaccttatgtcctctgtaaaaggcaatttcttctacattggctataattctcgagtgcacataccgcaaatagccttttctatgtgcttcctctgccaccagtttgccaaatttgggagaac

SEQ ID NO: 164710 - DNA, 601 bp, Human
aaaaagccagacaaagatatggaggaaatagaacccttacacattgctgttgggaatgtaaattgaaagaactttttttggaaaactgttttacaaaatctgctaaagctgaacctatgcatagcctgtaatctagcagttttacttctagttaagtactcacagatatgtatatacatacaccaaaagatctggacaaaaatgttcttaacagcgctattactaatacccagcaaactggatacaatctaatgtctgctaacaacagaatggttaaataaaatggtatagtcatacaacrggatgctatatagcaaagtcaataaatatgctatggttatactcagtaacactgatgaagctcataagcataatactgagtcaaagaagctagtcataaaagagtatgtattatataatactatttatgaaattttcaaactagcaaatactacttgatagtgaggtcattatactttgtgacaactcattaactggtacactaatgattatgcccatattggcatatatgctatactttaaacaattgtagtcacttttatgcatacctaattagagttttaaagtacgcctttgatat

SEQ ID NO: 164711 - DNA, 601 bp, Human
taattttgtagaagcgtaaatattttccaaatgatttttaaaaaatcatatatatcatggtgaaaagcacattggcaaaatatttcaatagggccattctctattaggcattctcagaaatttaacacattttgaggggtaattggagactttctacattaatattaatatttttctcagcataaaggtctctgatgcttagaattctttttgtctcacactaacttttcttctgcaaataatttttaattttttaaaaattttatttatttatttatttatttatttatttatttatttattttttatactgagtcttattctgtctcaggttggagtgcagtggcatgatcttggctcactacaacctctgcttcctgggttcaagcgattcttgtgcctcagactcccgagtaactgggattacaggtgcccaccacaatgcccggctaatttttgtattttttagtagagacagggtttcaccatgttggccaggctggtctcgaactcctgacctcaggtgatctgcccacctcagcctctcaaagggctgagattacaggtatgagccaccgcgcccagcctgcaaatggttttt

SEQ ID NO: 164712 - DNA, 601 bp, Human
tttgtggaatataaaacatatgttgaggaggtggtttatagaggactccttcatacacaggccagagcccacttagaattctgaagagagaacttttcccacaaccattgggaccagttatcaaaagatgcattccttcttctacctaaagtaagaaataaaattacaaactgcaatagtttaaaatgatttattttggcagcacctaaaagtaaattatttttttaaaatgttcgaaaacatgataacctaggttgggcaaaagatcaaggaaaaatatttcagggttgagaacaagttyggcttttgactattctctgaagctaaaagcatcataaaataattcaattccaaagaaaatggatcttcttgaaatgggcactggctttccaaaattgtaatttgttatcagataccacatacacatagagaaaaacagctgcctgggaaataagacaaatcataaaaatttaactaaaaatatattacattatattttgatattaatattggattaaatttacattgaattcaaatacaactgaaaattaactgcaattaatagctacaaagcacagttatccaaggagtcagctgggct

SEQ ID NO: 164713 - DNA, 601 bp, Human
ctgcgggggccgcttcaggtgagtggcgggtggtgtcggagggtcgggtccaaccagaggctggggctgaggggcgttcgagacggctccaggtcagagggagatgctggacagaaagtggagagggtagggccgccctatggggtttgagggccatttgcttccggggagatcatcgtctctggcctggggtctttctctgttggaaggtgaaaaggtgtggggcaagggtgggggcaccccgacggtatttgggtgcttaggttagttagatgggaagaatgctgagggacccaaagarcatcaaagccgatcgctctaaaactcggcgtgtttcagctaaacgaggtatccaaggaaaggtggtcgagccaggtttgcttgaacacttccttttaacatccacatgtgccctaggacccgatgagttccccgatgcactggagatgtggggtgctctgaagaaacagggccctggaaatgctttgttggctggagataaaagggaaagggtagcattgtaagatattagggatagaaggaccagtggtccttctaaaggaaagtgaggaaactagccttttggcaaaagctccctgga

SEQ ID NO: 164714 - DNA, 601 bp, Human
ctctaaaactcggcgtgtttcagctaaacgaggtatccaaggaaaggtggtcgagccaggtttgcttgaacacttccttttaacatccacatgtgccctaggacccgatgagttccccgatgcactggagatgtggggtgctctgaagaaacagggccctggaaatgctttgttggctggagataaaagggaaagggtagcattgtaagatattagggatagaaggaccagtggtccttctaaaggaaagtgaggaaactagccttttggcaaaagctccctggaggtggcaaattggaayagggtctgtggtgaagagggaatggaaggagattcctatttgccttggtttctggacaatatgaagttctgaattggcttagtttggggcagttcctcttggagaaatcaataaattaattagcagttatcgttatttgcttcagttgtgcaatgattttccagataatacagacagattagccagactttggccttgtccacagggagtttggaatatagcaagagaaagataatgtgcgcacataaccctagtcataagggttacagagtcattcacgcctttgacaggtatttagct

SEQ ID NO: 164715 - DNA, 601 bp, Human
cgctcaaatccaggaggcagaggttgcagtgagccgagattgtgccattgcactccagcctggacaacaaaagcaaaactctgtctcgaaagaaagaaagaaaattcttgaaaacaaaatgtgaagaagtgaaaagttaaaacttttttcttatagtaattactaagtgatgtcaacctcaagccctaaatttatgttcacaagtccagtttaggctgatctgctttccccagtgcaatgtaagttccatgagggcaggggcctggagcatagttcacaagtccagtttaggctgatctgytttccccagtgcaatgtaagttccatgagggcaggggcctggagcatagttcacaagtccagtttaggctgatctgctttccccagtgcaatgtaagttccatgagggcaggggcctggagcatagttcacaagtccagtttaggctgatctgttttccccagtgcaatgtaagttccatgagggcaggggcctggagcatagttcacaagtccagtttaggctgatctgctttccccagtgcaatgtaagttccatgagggcaggggcctggagcatagttcacaagtccagtttaggc

SEQ ID NO: 164716 - DNA, 601 bp, Human
ttttaaattttttgtagagatgaggtctcactatgttgcccaggccaatctggaactcctgtccccaagagatcatctcgtcttgacctcccaaagtgctgggattacaggcatgagccactgcacctgacccctattatcttcttttgaaatgagtcatctgctaattcacttcataaatatctgctgaatattgtgtgttaggtactgtgcccttccttgaggatatgaaggtgtgtaagaatcaggccttgctttcccctaagagaagttataactatgaagggaagacagctacgtrcacagcaattagaatttcataataaaaatacaggcaatatgtggtgctggactaagatgtgattgacttaactcttttgggggttctggtggaagacatcacagaagagaggacatttgggcaggtctgagaggtttagtgtgagtagaccatctgggggagaaagacattccagaaggaatgaagagttgatgtgcaaaggcaaagaattatggattatcatacttagtgtattaatttccaagggctgttacagtgaagtgccacaaactcatggcataaaacaacagaaatttattc

SEQ ID NO: 164717 - DNA, 601 bp, Human
tagtgtattaatttccaagggctgttacagtgaagtgccacaaactcatggcataaaacaacagaaatttattctttcatagttctggggactagaagcctgcaatcaaggtactggcagggccacgatctctctgaagactctcagggaggatctgttccatgcctttctcttcgcttctggagttgccagcagtccttggcattttggcttgtagatgcatcacttcagcctctgcctccgtcccttcaatctcatgtgatactctccctccctttgtgtctctgtcttttctcttaakggtaccagtcatagtggatgaacgagtatgacatcatcgtaactttgttgcatctgccaagaccctgtttccaaataaggtcacattcacagggacccagggttaggactttgacatatctttttggggaacacagtacaacccacagcacctggagaactgaatgtaggtgcctgttgttggaacataacttgtgaggggtgtaatggaaggaagggggtgaggttgtaaggttataatggcctctttttgtcccttcccaacaatctccagcttctgggtttatgcttgacctaggat

SEQ ID NO: 164718 - DNA, 601 bp, Human
gctgaagtgcggtggtgcaatcactgctcactgcagccttgaccaccttgagcctctgggctcaagtgcctcccacctcagcgtcctgagtagctagaactgcaggtgcgcaccaccatgcctggctaattttttaattttgtggagatgaggtctcactatgtcgcccaggctgatctcgaactcctgggttcaagcaatcctctcatctgcgcctgccaaagtgctgggattacagatgagagccaccatgcttggaccctttaaatttttaattaagttttcagtttttttcagtttrcgttttgggtggacttcagttctagctgtttatttacatgcttacctattgagaattttctgtttttcacttagagaagttaattttagtaatgggtgaatttccttttttttttttttttttttttagaatttgacattaaaagtatacaattattaaatgaatgaattttccaattaatttctcttggtcctttttgtattttaagaattttttgattggtttactaataagccagtaaacattaggggctggaattctgtcagttgctgttaagagtcacataagtaacctcccttg

SEQ ID NO: 164719 - DNA, 601 bp, Human
cctaatttcaacaaaaatccctgttgatattttgttggaatttcacctgatgttgagataagcctggggaaatctgtcatctttattatagagggtctttccatccttcgcatccttctggaaagatgctttatatttccagtttaggtctcatatctttcagtaaattcttatagcttttttcaaatgatctgacacacttttattagatttactactcgatagagaattttgttattactagaaactaattgattactatagtacctaggaatggattttaaaattattattattatatattattattattattattattattgcactgagtaatatttagctcatgagtatctgtatttatctgggcacctctctgaagtctggtaaacttattcacctgtctggatctaggcaggaggttgactgggctcagctggtggggatgggggtgtcacagctgtcacatctctttgtaccagaggctggctgagcctcaccatcatggtgatggcagaagtgcaaaggcagaatttatttcctcgtattttgaatttttatatctatgaatccttcctaagctcttgtagtactggtagct

SEQ ID NO: 164720 - DNA, 601 bp, Human
tctcttaaaaattttatgattagttgtttgctgctggttaaaggaaatgcagtggactttttgcacctttcctaaagtattttattgattctaataattatctgcagattattagctctctgggggaaaaaaatcaaaaaaaacccttctttgatcccccgtgtcttctccaaatgtggcctcatttctgtgtttcattttacaacaaaactcctgcaaatgaaattgttctcttgttaacatctcctacttcctcacttccaattttctcattaacttatggctgctagagatcataggrgcagcagtgtccacagcttgtcaaatccagtggttaattctctggccttgtcttactaaacttcataacgtttcactgcttcctttttgaaaacttgcttctggatttctgggactccatgctctctctcttttttgccatgcttgactgactgctcatttgcagactttgtcttcttctggcttctaaaagttagagttcttctgggtacttgctgtgcatctgcactcaatcgtcttctgtatctgtacctgaaactcagatgttcttctcagtctggggactttgaatactgtaaca

SEQ ID NO: 164721 - DNA, 601 bp, Human
tgtgtataattaaaaaaaatttttttagagacaggttctcactctgccaccaggctggagtgcagtggcatgatctatagctcactgcagccttgacttcctgaactcagataatccttccacctcagcctcctgagtagctaggactgcaggtgtgtgccataccacacctggctaaattttttttttttttttggtagagatggggtctcacgatgatgcctaggctagttttgaactactagcctcaagcgatccatctgcatcggcctcccatagtgtttgggattacaggtgtgartcactgtgcccaacctatttttatttttttgtagagatagggtctcacagtgttgcctaggctggtctcaagctcctggcctcaagcgatcctcccagctcagcctcccaaagtgctgggattacaggcatgagccagtctggctagcctgagtttttatttagaaaaacatgaacaacctgtatatggctgctgtaaaccaatggactttctttgttcttgaaccaagctaggcatccacacggcacctattcatctgaggggatagagtcagtgttcagatgtctttgaaagaaaggt

SEQ ID NO: 164722 - DNA, 601 bp, Human
agtatgagtcaatattcatgatgaatctttttctttgtatttctttcgaatttaagaaattagatcaaaattttctgatagagacgaaactttggaatgcagaaatatttttagtattggtgccaaaaatttaagtcacttactttaacacttagaaattacaagatcatatatggaaagtttgttattggtttggtgtattagaatcatttgtggagcttttaaggacaccaatgcagtgctggattccactcaagaggggtttgtgttagggccacatcatctgtattttttaaagctytgtggatattttgatgttaatctgagaaccctgtatcaggggtttgggtaggggctttgttagcatattttgtgtcttgcttatttagttaacctttttgtttaaagctgttaaagcaaaggccagaataccagcaggttagcgatttggtcatcacagtgaaaccatttgaattttcatgtgaatttaaactataaaacaaaattcaatagcagttcagtctgggcttgtatcattagagggctggttaaataaaatatgacttgttcacagagcagagtactatgtagctataaaagg

SEQ ID NO: 164723 - DNA, 601 bp, Human
ctaaagaatttgttgctagcagaacaacccttaaaattggctaaaggaagttctttaagccgaaaggaaatgatagtagaaggaatcttggagcattaggaaggaagaaggaacaatggaaaaatagaaatatgggtacataaaataatagactgtcgcaggccgggtgcagtgccaacgcctgtaatcccaacactttaggaggccgaggtgggtggatcacctgaggtcaggagttcaacaccagcctgaccaacatggtgaaacctcgtctctactaaaaaaaaaaaaaaaaaaaaaattagctaggtgtggtggcagatgcctgtaaccccagccacttgggagactgcggcaggagaatcgcttgaagctgggagggggaggttgcagtgagctgagattgtgccattgcactccagcctgggcaataagagtgaaactctgtcttaagataataataataataataataataataataataataataataataatagactgcccctttcctcccaagtttcatcagtcctatttgatgatagaataaaaaatataaaaccatctaacactgaagatgatgatatttaaatcaaga

SEQ ID NO: 164724 - DNA, 601 bp, Human
acaaatcaagctggaatccgtgatgattaattttacatatcaacttgactgggttaaggaggacctagatagcaggtaaagtattctttctgtgtgtatctgtgagggtgtttccagaagaggttggcacctgaatcagtgaactgagtaaagattacccctgcctaatatgggtggccaccatccaattgtttgagggcgtagatagaacaaaaaggcaaatctcatttctcttctggagctgtgacacctgtcttctcctctccttggaaatcggaactccaggctctctggccctcasacttcaggactagcacgagcagtctcccaggttcttggacctttggcctcagactgagttacaccaccagctcccttggttctcaggctttgggcttgtcctgcactgtgccattggcttccctggctctgcagcttgcagatagcctgtcgtgggacttctcagctcctgtaattgtgtgagccaatttccttaataaatcctctcccatatacccaatttgttctgtttttctggagaaccctaatataggactctaaaaaatgttcaagtgacctataagaaggcaagaagagaaga

SEQ ID NO: 164725 - DNA, 601 bp, Human
cctccacctcccaggttcaagcaattctcctgcctcagcttcctgaatagctgggactacaggcgcgccaccacgctcagctaatttttgtatttttagtgaaatacgaaaattagttttagcgaaacggggtttcaccatgttggccaggatggtctcgatctcttgacctcgtgatccacccgtctcggcctcccaaagtgctaggattacagacatgagccaccgcgcctggtgaaagttaaaaatcttaaagcaaccagtggattgagacacattatctttacacaagcaagaaaaaggctgggcgtgatggctcatacctgtaatcccagtactttgggaggctgaggcgggatgattccttgagcccaggagttttgagaccagcctggtaacatagtgagaccttgtctcagttttaaaaatttattttcttattaaaaaaaaaaaagcaaggacaagactgaaaactaccttcttattataaacaatggaaacccaaacaatggaatgacagttttaaagtgcagaaaagaaaataaatgccagcatagaattgtataccaagagttgacaaactttctttttaaagggccag

SEQ ID NO: 164726 - DNA, 601 bp, Human
atcagggatgcaagttataatttctagggtaatcactaatagtagtaaaagtaaaggtaatagcaaaataaaagtaaatagtaaaaggatgcataacataatagtttataaagaaaaaaatggaataataagaatatttaatccaaaaaaaggtaaaacaagataggaaaaggaacatagagtaagtaggcagatagaaaacaaatagcgagacagtagatttaatgccagttatgtcagcactggaatgaaaactgactcaagataccagttcaatgacagatttgtctaagtgggtttrggaaaaccaatgaactatgatacaaaactgtacttaactgtaatgagtcaaaatattgaaagcaaaaggatagagaaaaaggtatatcacactcttaacccacagacagctggtttatgtctatatctgacaaaatagacttaagaaggattgctagaggcaaaatagtaacgtttcataatgatgaaagcacagtctaccagaaaaaatgattctaaatgtgtgtgtacctaataatgtaaccttatgttatataaagtgaaagatgtcagaggtacatgttaacaatttttttttttt

SEQ ID NO: 164727 - DNA, 601 bp, Human
tagtttataaagaaaaaaatggaataataagaatatttaatccaaaaaaaggtaaaacaagataggaaaaggaacatagagtaagtaggcagatagaaaacaaatagcgagacagtagatttaatgccagttatgtcagcactggaatgaaaactgactcaagataccagttcaatgacagatttgtctaagtgggtttaggaaaaccaatgaactatgatacaaaactgtacttaactgtaatgagtcaaaatattgaaagcaaaaggatagagaaaaaggtatatcacactcttaaccsacagacagctggtttatgtctatatctgacaaaatagacttaagaaggattgctagaggcaaaatagtaacgtttcataatgatgaaagcacagtctaccagaaaaaatgattctaaatgtgtgtgtacctaataatgtaaccttatgttatataaagtgaaagatgtcagaggtacatgttaacaatttttttttttttttttggagacaagagtcttgctctgtcgcccaggctggagtgcagtggtgtgatctcggctcactgcaacctccagcccctaggttcaagtgattcgtct

SEQ ID NO: 164728 - DNA, 601 bp, Human
gattgacttggcgatgtgggctcttttttggttccatatgaactttaaagtagttttttccaattctgtgaagaaagtcattggcagcttgatggggatggtattgaatctataaattacctttttcaccatattgattcttctatccatgagcatggaatgttcttccatttgtttgtgccctcttttatttcgttgagcagtggtttgtagttctccttgaagaggtccttcacgtcccttgtaagttggattcctaggtattttattctctttgaagcaattgtgaatgggagttcaytcatgatttggctctctgtttgtctgttattggtgtataagaatgcttgtgatttttgcacattgattttgtatcctgagagtttgctgaagttgcttatcagcttaaggagattttgggctgagacgatggggttttctagatatacaatcatgtcatctgacaagccccagtgagatgaacctggtacctcagttggaaatgcagaaatcacccatcttctgtgtcgctcatgctgggagctgtagactggagctgttcctattcagccatcttggaaccaccctcaggaggatatta

SEQ ID NO: 164729 - DNA, 601 bp, Human
ttgggtgaaagttagaattaggtttggtctggtgatgcccttgattgggtggagtttgagaattctggacccaggtagacgatgcaactctgaatgggcttaaaccatttatcctttgtaactagaggagaggcatagtacgtgcatttagtcatgggaaaaaaatatatagttctctcctcattagttattctttctacaactattcactgagtgccattagaatgccaggcatacttttaggcactggaaatagtcaacagaacaggcaaaaatccatgctgttgtgaagtttacattscactggaagaaagtagatatgaaacaagtaagatatcagctaattatcagctaaaattgaagagagggaagaaggtttagcaaattgagagaaaataaggtgtaaaaagtgaattgaccagggaaatgaattattgattgacccacagtgcggagagtctgtatgagatgtgtgtttataagtgtgaaaagagaccaaatagcataatattttgtctctagccttatctagctgcttgttggtatataagagtaagcagagagttgggcttctccaggtttagagttgccatacgtataa

SEQ ID NO: 164730 - DNA, 601 bp, Human
gattgacccacagtgcggagagtctgtatgagatgtgtgtttataagtgtgaaaagagaccaaatagcataatattttgtctctagccttatctagctgcttgttggtatataagagtaagcagagagttgggcttctccaggtttagagttgccatacgtataactgcagcttaccaaggtgccattgagtgtaaaatgcactcttattttgtgaactgagaaaaaacactgtcatttaaactgtggcatgccatagattttataatatatcctgatttctgagctattagttttaaaaktgttcattttagaattagtaaaataagtagttgggatacttttgattggaaacaacagaaaacccaaactcagatgcactttaataataaggaggagccaagggggatatgaagaaaatggcagcctgaatgaggcctgcttccttgactccctcagctacctactagctctctggttctcttgagccagcctgctgcggggccctacagaaaactgtaggatctggttttctgttcttgtgttagtttgctgagaatgatggtttccagcttcacccatgtccctgcaaaggacatgaa

SEQ ID NO: 164731 - DNA, 601 bp, Human
tttgggttggttccaagtctttgctattgtgaacagtgccataataaacatacatgtgcatgtgcctttacagtagaatgaattataatcctttgggtatatacccagtaatgggattgttgggtcaaatggtatttctggttctagatctttgaggaatcgccacactgtcttccacaacggttgaactaatttacactcccaacagtgtaaaagcgttcctatttctccatgtcctccccagcatctgttgtttcctgtaatctgtctaccttttaagtttaaattccccatgaaaaaagagttttaaaagttatgccatagaaaaagattaatagcacgagaaaaggctaattattaggtttaaaaaataggttacatataatatgtacaatattatctccactttaaaaaaaatctatttatccatgcataggaaaaaactactaagccatacaccaaagtgcatatgtggttatcattaggaatcataagtttaaataatttgagaattctttttactttttctccattttccaaattttctgcactgaccatgcagaaaccattgcaatgaccattgcttttacaatgagaacca

SEQ ID NO: 164732 - DNA, 601 bp, Human
aatcccagctacttgggaggctgaggcaagagaattgcttgaacccaggagacggaggttgcagtcagccaacacggtgccactgcactccagcctgggtgatgaagtgagactccgtctcaaacataaaaaaaaaaattaaacaaatttttaacaactcagcaggcttagtctgctttctttcacagtctgcattttttgggccctggagccccaggagtcttcgtagcttcccactcaggttaagatacagcacatatttccagcttctacaggtggcctctttgcacatagaatcgtracctttattttcaacatctgaagcattgctacttatctatattgattaacttagctgagttctcctctaccatctaattagatttggtttcttcacagtggagcacaggctatcttcagtgtgttctgtacatacaagcaactttataaccatctttgtatccatactttgttagactggtttttgtgttgtgggaatgactgattcactaagatgtccaggatgttggcaatccagttgagggacgtggtataacgggacccagcactgcattcgaatttcatccttggacaagacaag

SEQ ID NO: 164733 - DNA, 601 bp, Human
aaaaaaaaaaattaaacaaatttttaacaactcagcaggcttagtctgctttctttcacagtctgcattttttgggccctggagccccaggagtcttcgtagcttcccactcaggttaagatacagcacatatttccagcttctacaggtggcctctttgcacatagaatcgtgacctttattttcaacatctgaagcattgctacttatctatattgattaacttagctgagttctcctctaccatctaattagatttggtttcttcacagtggagcacaggctatcttcagtgtgttcygtacatacaagcaactttataaccatctttgtatccatactttgttagactggtttttgtgttgtgggaatgactgattcactaagatgtccaggatgttggcaatccagttgagggacgtggtataacgggacccagcactgcattcgaatttcatccttggacaagacaagtaacttctctgaccccaaatttctaccggttgctcccctgcctgcaggctccgtgcttggtatctcagaaaaccttcccgaggaaaaagcccataagggacaagtcccggcccaacttaaaatcaca

SEQ ID NO: 164734 - DNA, 601 bp, Human
taaaatgggaaatgtgcaaatccacaattatagttgcagatttcaacatttgcctttcaatatcaataaaacaagtatacagaaaaataagaaggttatagaagacttgaataacactgtcaattaacttgacataattggtacttagagaacatgatacatatcaactgcagattacacattgaagtgcccttggaacattcagtaaaatagactatatgctggataatagaacaagtctcaatacatttaaaagatttgaaaccatatgtcatgtgttctgttttgaagacagggtctygcttgctctgtcacccaggctgaagtgttgggattgtagctcactgcagcctctatctctgggctcaaatgattctctcacctcagcctcctgagtagctgggactacaggtacactctaccacattcagctaattttttttttttttaatttttagtagagatgaggtctcactatgttgcctaggctggtcttaaattcctggcctcaagtgattcatccactttggcctcccaaaatgctagggttatagacgtgagccagagtttctgtggaattgcaatagaaatcattaacaaa

SEQ ID NO: 164735 - DNA, 601 bp, Human
ttttcactaagattgattaaagatttggttggaaggaatcaaattggtatagcagtcactaaactaaatgcaaacagattatatattgtggcagtaaaatactgtcaggttagtttaagaaacaaaacctaaccaagtcctgtttcgaagaagcaaactattgaaaacttgataagtaaagctgaaaataaaagagttgaataaagatgtaagatacaggaaaataaccaaaagatcaataattataataatattagacaaggtgaaatttaaatatcaaactaggtaagtggattgttamcatcataaaaggcatattttatgaaaatccaatagccataatcttgtatggctaaaaagcttaacacataaagcaaaaataatctgagtagtgtggtagagcaggcatggtatgagatttatatatatatataatatatatattaaaaaattatatattatatatatatgtttttttcttttggagacagagttttgctctttctcccaggctggagtgaagtggtgcgatctcagctcactgcagcctctgccccacaggttcaagcgattctcctccctcagcctcccgagtagctgg

SEQ ID NO: 164736 - DNA, 601 bp, Human
attctcctccctcagcctcccgagtagctgggattataggcacttgccaccatgcctggctaatttttttttcttttttttttttgtatttttagtagagatgggtttttgccacgttggctaggctggtctcaaactcccgacctcgtgatccacccacctcagcctcccaaagtgctggggattacaggtgtgagccactacgcctggccaggatttcagtacatgtttatcagaattaggtctagtagatgaaaatacgagtataaggaattgaatagtgcatttaataatcttaatyatatgtgtatagaaatagtgttttaaattcctggaatagatctttttttaatgtccaaggaactgtggtcaaagtttaatgtccaaggtacttgaccataaagaaaatcttaacagatgagaaaagttgagattttataggctgcgttgtctggtaataatactggtaaagtagaaagaaataactatgagacgagtcctttgaaacctgcctcctgttcccctattctccctatatttgtttccactgcagaattacctcagtattcttgaactaagaaattggtggtggcaaggtctt

SEQ ID NO: 164737 - DNA, 601 bp, Human
ctcttagacataaaagcccaagtaaggccatatgtatagggatatttattgcagtgatgtgcatattgtcagtcaactgaaaacaaaatgaacattagtagggaaaggcaggaaaaagtgatacctccataggtgggatactatgctacataaagaaaaaataaattagactaataccagattagtttgagaaatttccgtaaggttttgttgagtgagcaaagaaagatgcagaaaagtatataataatttgtgtaaccaaaaaataatttaagagaaccatgcctatatcataggctcrtgagtatgaagaaaagtatttaagaattcctggtaggtggttaaatgtttaccttggtcaagggtgggtcagagtaactggggaagtgggttaaaacaacaacaacaacaacaacaacaagattcgtctgtgatcatatctatgcattatctgtaaaattatataaatatgtatgtttaaagatactaagtaaacatttaaaataaaactgacctgtttcccagcctggacaacatagcaagactcatctctaaaaaacaaaattaattaaaataaattagctaggcatagtggtgtgtg

SEQ ID NO: 164738 - DNA, 601 bp, Human
tgaccacattccctgctgctgctggcagcaagtccttccttgaagaggagatctaggtggcatgtctccctgtccacacactttcctaagaataagaaaatatttcctggaaatcatccatcagatgtgccctcacatctaagtattagattacattctgtgtcagagattcatggttacacatcatagcctttttctacttctctagtaaaaagaattctgattttttgatgggtacatgatcatctgggataacggctgcatttttcagccttcctctacttgtagacatgtcagtaamttctggctaatcgaatgtaagttgaattttcatgtgtgacttaacagagggagagagggtgtacccccccgttttcttttcctccttcctgctgggtagaatttgggtataatagctggagcttgagccgctatcttggattatgaggtagaagccacatgttggggatgacagagcaatagtatagaacagcattaggtccctgatgatcatggaaatgcattgcatgctctggattgcttatctttgggttttttttatcttggtggttagtccattactatttaggtttttctgaca

SEQ ID NO: 164739 - DNA, 601 bp, Human
cttcctgctgggtagaatttgggtataatagctggagcttgagccgctatcttggattatgaggtagaagccacatgttggggatgacagagcaatagtatagaacagcattaggtccctgatgatcatggaaatgcattgcatgctctggattgcttatctttgggttttttttatcttggtggttagtccattactatttaggtttttctgacagttgcattaaagcctaatcttttttctacatctatatctatatatgatgtatatctatatctatatagatacatattcttttttwaaaatagatatgagggtgttgctgtgttggccagcctgatcttgaactcatggcctcaagcagtcctcctgcctcagcctccaaactgctgtgatttcaggcaagagccaccatgcctggtccacacctaattttaattgatacagatttctaatcagtcagtggcaaggggcatgggaaaacatgattggcttcgactaacattttggggtggaatggattttggggagtagggcatggatacatctctatcaggcaagtacagcagaggaagagaaaggcaagaacatcagggagttt

SEQ ID NO: 164740 - DNA, 601 bp, Human
gatttaggtatgttttgttcattcctgttggttttaatatttttctgtcttcttttttaatgtatgcaataagtatttgtttcatctaaatttatgcaatctgaatataactagtcattttctactggttatagtgtttgttaatgtacccattatgtttaatttgtattatattaagaattaagaaatattaatatatgaaaatatataaaatatataaaaatatatgaaattaatatagcagacttaagttttctttcttgatttaaattacagactaactggatcttctgggtttgtracagatggacctggaaattataaatacaaaacgaagtgcacgtggctcattgaaggacagtaagtagaaatggctgacttaatttttgtttttttagcatagaagtcagtgtgacattagttttcccacaagtaaaattaacaatctgtagcataaagttcttaaaacattacttgataacctttcatttgacaagtgaattttatcttagccttcattaatttaaaagtttcatgttgatttaatgctgcaaatgaattgtacacaccacaaatttgtgtatttccaactgtaatagtt

SEQ ID NO: 164741 - DNA, 601 bp, Human
ttggttttaatatttttctgtcttcttttttaatgtatgcaataagtatttgtttcatctaaatttatgcaatctgaatataactagtcattttctactggttatagtgtttgttaatgtacccattatgtttaatttgtattatattaagaattaagaaatattaatatatgaaaatatataaaatatataaaaatatatgaaattaatatagcagacttaagttttctttcttgatttaaattacagactaactggatcttctgggtttgtgacagatggacctggaaattataaatayaaaacgaagtgcacgtggctcattgaaggacagtaagtagaaatggctgacttaatttttgtttttttagcatagaagtcagtgtgacattagttttcccacaagtaaaattaacaatctgtagcataaagttcttaaaacattacttgataacctttcatttgacaagtgaattttatcttagccttcattaatttaaaagtttcatgttgatttaatgctgcaaatgaattgtacacaccacaaatttgtgtatttccaactgtaatagttcagaaacggttacacacacacacacac

SEQ ID NO: 164742 - DNA, 601 bp, Human
gctggcagaatctaagtgccatttgcagttggagagcagagaccattgctggaaccagtctacccagtggtgtggtatagaagtttggctttcttcaatacagcttagttttgttttttttttccctccaccgccccctcccactttttttttcctggttcaatcttagagcagataactggtttcctgtacaacagagcttttgccagccagtgtcctgaaaaatcagaggggctggcaaatttagaggattggcaggcatgtttatgaaatgacgtagtgtggaatctgaagttgaatraggaagtgcagaaatggaagggctaatgggttggttcagaagctgttaaagagtggccactgaatggactgtaaggcccagaatcatggaccacatcagttttgtttcccattgcatgtttagtagtctcttgtacttggagaatactaaataaatctttgacaaatgaaggaatactggtggggcagttgttagactgtgttacatattattaatttaaaaatctgaatttttatattctcaaatgtctgatagttgtgataactttattataaattactttttttattcttttcaggc

SEQ ID NO: 164743 - DNA, 601 bp, Human
cccctcccactttttttttcctggttcaatcttagagcagataactggtttcctgtacaacagagcttttgccagccagtgtcctgaaaaatcagaggggctggcaaatttagaggattggcaggcatgtttatgaaatgacgtagtgtggaatctgaagttgaatgaggaagtgcagaaatggaagggctaatgggttggttcagaagctgttaaagagtggccactgaatggactgtaaggcccagaatcatggaccacatcagttttgtttcccattgcatgtttagtagtctcttgyacttggagaatactaaataaatctttgacaaatgaaggaatactggtggggcagttgttagactgtgttacatattattaatttaaaaatctgaatttttatattctcaaatgtctgatagttgtgataactttattataaattactttttttattcttttcaggccaaatagaataatgagacttcgtttcaatcattttgctacagagtgtagttgggaccatttatatgtttatgatggggactcaatttatgcaccgctagttgctgcatttaggtaagctcagtcttacaagcct

SEQ ID NO: 164744 - DNA, 601 bp, Human
cattgttcctgagagagatggcaatgagactgtccctgaggttgttgccacatcaggttatgccttgctgcatttttttagtgatgctgcttataatttgactggatttaatattacttacaggtaagatacttaagtctagtatttgtgatttcattcaggagactatctactatgttttaacaacaataatggctaacatagattgagagccaggcatagcgtcaggcagtttacatggattttctcatttaaaattcttccataaattcagtgaggtctgggctctgtttttctgctyatttataattgaggaaactggcaggaaaaggttagtagattgtcaaagtaactggtgggaccacaatttaaacccaggtgttgatgctgttgaacttctagaagagagggacttttctgctaatggacaaaaacgttggaattttacaaagtacagctccacaaatattagtagttgtcatgtactcgatagtagaagaaatctatactcattaaagtaccttgatagtccatttatccccccttttaaattctgaattacattgtttcaaagcactgtcagtacaattatattattatg

SEQ ID NO: 164745 - DNA, 601 bp, Human
tcattaggaggctaccaagaagaataggatagtcctcccacccatgaggagctaacagttctgcacaaatctcctacctcctttaatttctttgactttatgagttatttattcttatcctcttattatgagaatccagcagggttgatttgatttcattacttgtacctcgggctctagctatgcagtgttgagcaaacccatttggactgaatccttaagtactgcagttacacttgtgaatgaactgagacagtgagattcttaaacttgtgtgggaggaagttatgctaagttaatrgaagcgttgcgttgtgttaatgtaattttccctgctatttttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtaggagcttctttcatttttattttttcttccatttatagaacattc

SEQ ID NO: 164746 - DNA, 601 bp, Human
cagaattgagaaatcacccacactttgcaaataaaatgtctggagagctatgtgtaacctcaaacaagatgaaagaagtggcatcgtagctagtgcaaatattctatgatgaaaaaataaagaggaagaaagactgcagcctgtaaaatctaacaagaacccatcatggaggaaaagcagcttcaaggagcagaaggagattccttccaactgcttcgtgctgcagatcaacttaatgagaatttgagttcagaaaaacaagctagaagacaagatgataataacagaagaattgggaggytgtaggcctaaagaaatacgaataaattagatacagcaaaaattagaatgaaaatttaattactgacaggttgagataattgtagtaatacattgggaaaaaaaccagaaaagcaaaaacacacaaaggacagaaggtgatcaaatagaactataattgcggtcactgaagaaaagaacctaacacacgtaacagacagattgaaacagcacaaggtgtttcagaaaaatttcatagtttcttcatgacaaaacctgatttgatcaagttattgaactttttgtgcttggagtgtatcca

SEQ ID NO: 164747 - DNA, 601 bp, Human
agcagaaggagattccttccaactgcttcgtgctgcagatcaacttaatgagaatttgagttcagaaaaacaagctagaagacaagatgataataacagaagaattgggaggctgtaggcctaaagaaatacgaataaattagatacagcaaaaattagaatgaaaatttaattactgacaggttgagataattgtagtaatacattgggaaaaaaaccagaaaagcaaaaacacacaaaggacagaaggtgatcaaatagaactataattgcggtcactgaagaaaagaacctaacacaygtaacagacagattgaaacagcacaaggtgtttcagaaaaatttcatagtttcttcatgacaaaacctgatttgatcaagttattgaactttttgtgcttggagtgtatccaagaaaaataaagtcattgaacttttgggataaaggacaaattattatttgggaggcctcaggtagttctgtgctatctgctgtttggggtcatgtctagtctccacagagcctttgccttggtctttaggtggcccgattgggttaccaggccattatggagtttgaaacctgtaccctgtggtacat

SEQ ID NO: 164748 - DNA, 601 bp, Human
taatgagaatttgagttcagaaaaacaagctagaagacaagatgataataacagaagaattgggaggctgtaggcctaaagaaatacgaataaattagatacagcaaaaattagaatgaaaatttaattactgacaggttgagataattgtagtaatacattgggaaaaaaaccagaaaagcaaaaacacacaaaggacagaaggtgatcaaatagaactataattgcggtcactgaagaaaagaacctaacacacgtaacagacagattgaaacagcacaaggtgtttcagaaaaatttyatagtttcttcatgacaaaacctgatttgatcaagttattgaactttttgtgcttggagtgtatccaagaaaaataaagtcattgaacttttgggataaaggacaaattattatttgggaggcctcaggtagttctgtgctatctgctgtttggggtcatgtctagtctccacagagcctttgccttggtctttaggtggcccgattgggttaccaggccattatggagtttgaaacctgtaccctgtggtacatgatggtcattggcttgccagccatcctagaggggtcgagggaggt

SEQ ID NO: 164749 - DNA, 601 bp, Human
gataataacagaagaattgggaggctgtaggcctaaagaaatacgaataaattagatacagcaaaaattagaatgaaaatttaattactgacaggttgagataattgtagtaatacattgggaaaaaaaccagaaaagcaaaaacacacaaaggacagaaggtgatcaaatagaactataattgcggtcactgaagaaaagaacctaacacacgtaacagacagattgaaacagcacaaggtgtttcagaaaaatttcatagtttcttcatgacaaaacctgatttgatcaagttattgarctttttgtgcttggagtgtatccaagaaaaataaagtcattgaacttttgggataaaggacaaattattatttgggaggcctcaggtagttctgtgctatctgctgtttggggtcatgtctagtctccacagagcctttgccttggtctttaggtggcccgattgggttaccaggccattatggagtttgaaacctgtaccctgtggtacatgatggtcattggcttgccagccatcctagaggggtcgagggaggtgctgtcactctatggaagacatctttttctgaatttctggaat

SEQ ID NO: 164750 - DNA, 601 bp, Human
agtaatacattgggaaaaaaaccagaaaagcaaaaacacacaaaggacagaaggtgatcaaatagaactataattgcggtcactgaagaaaagaacctaacacacgtaacagacagattgaaacagcacaaggtgtttcagaaaaatttcatagtttcttcatgacaaaacctgatttgatcaagttattgaactttttgtgcttggagtgtatccaagaaaaataaagtcattgaacttttgggataaaggacaaattattatttgggaggcctcaggtagttctgtgctatctgctgtytggggtcatgtctagtctccacagagcctttgccttggtctttaggtggcccgattgggttaccaggccattatggagtttgaaacctgtaccctgtggtacatgatggtcattggcttgccagccatcctagaggggtcgagggaggtgctgtcactctatggaagacatctttttctgaatttctggaatctatctttgcttatttgcttgcttaggtcttagaattagttgttcactattctgttatcttggattcagctcccagaaggtgcatttatctcgtacttttttgtacga

SEQ ID NO: 164751 - DNA, 601 bp, Human
aagaaagagaagttgtggtaaaaggactgtgaggagattgagtcagctaaaattcaggactaaataactatggaattactgttattgaatgtagtgcaaatgttaaggacctggacattgtaaaaattttataacaaaaattggaagaagaaatgagaggcaatgtgagtgctaagatttttcaactttcaaagcaagaagttagtgaattctgtacaaaaataaattgcatataactttaaattcaacctctaaataatttttcatgtatttttaagagtgcaatattccaaaaatatgyaaaataatagttatgtgcaattaatatttaatagttgtcaccatttgttgtatttgcttcagatcttgtataaaatatttaagataaaaggaaaggcttagagaaaattaacatcaatggattcaccaccggcttagaaattaaaacactgctaacacagttgaagtcccttgcatgtccctccaaagtcccagagataacctgtatcctgattttggtgtcagttgttcatactttcatatatatgttatactttacatatatgttatacattacagatatatgaaagtatagtagaat

SEQ ID NO: 164752 - DNA, 601 bp, Human
acattgtaaaaattttataacaaaaattggaagaagaaatgagaggcaatgtgagtgctaagatttttcaactttcaaagcaagaagttagtgaattctgtacaaaaataaattgcatataactttaaattcaacctctaaataatttttcatgtatttttaagagtgcaatattccaaaaatatgcaaaataatagttatgtgcaattaatatttaatagttgtcaccatttgttgtatttgcttcagatcttgtataaaatatttaagataaaaggaaaggcttagagaaaattaacaycaatggattcaccaccggcttagaaattaaaacactgctaacacagttgaagtcccttgcatgtccctccaaagtcccagagataacctgtatcctgattttggtgtcagttgttcatactttcatatatatgttatactttacatatatgttatacattacagatatatgaaagtatagtagaattaataaattttctgtttttagtctttatagaaacaatattctgcagtgtgctattttagcttaacattgttttgagatttatgttgacatatgttgctggcgtatatttttcat

SEQ ID NO: 164753 - DNA, 601 bp, Human
atttatttgtattcttttttgctattgtgataaactttcttatacctttatgcttatatatgataatgtttttcaagattttttaaatacttggaatatccaggtaaacttttatagaaaagaaacatttacttaagatataacaatatcatttctttttgttttttttctattttatgaaaataattaaaatcaacactttattaacagtatcctcatatgcatagaaagatgtctggaatgatgtttacttaatgatatttatttctagatcatggaatgtggcatcttttaaaaaaaacttttagctctttattctttgtattggttacattctttataatgaacatgtatgattttcataaaaacagtagagtttttctcaaaagcaaaaactcaaaagtgagtactttaagatactgaatgtgattattgaataatgcatgaataagtataaattgcatggcaggattataaattattttctttttggcatttttgtattttaaggtctttatattcgtagtacaagtgaaatgctataatggtattctggcttttgaaaatgtatttttagtcaattatataaagaaaaggaaag

SEQ ID NO: 164754 - DNA, 601 bp, Human
gcatctttttgcctatactataagcagcatttaaaaggagactgaaaatattgccagttcaaaatgatcaggccatttgaaagaggtccaaatggtattttttatattcatttgactaatgttacacatctggtaaaaattatttctacattaaattctttttgaaatcactcctgttaattgcttgaatgctaatttttaaggctgagttgaggtgtctagtctctcctttgtcatgttatgcctacctggtagtgttacatagttgcaaccaccagcattgtgttaaaattggttcacrtattagctttatctcattccctagaaaactggtttctcacatggtcttggtgtggcaatataccagaccagaagagggcagtatttgttcatgcaaagcaaatgcataccggatgatctctttcataaaaattgtcagatgttcattttaaacaaattattatttttttgattgtggtaaaatacacataaaatttaccatcctaactatatttaaatgtctagtttagtgatattaaacacattcataatgttataaatccatcaccgccatccatcttcagaactgtcttcatcttgt

SEQ ID NO: 164755 - DNA, 601 bp, Human
attgagactatcctggctaacacggtgaaaccccatctctactaaaaataaaaaaaattagccaggcatggtggcaggtgcctataggcccagctacttgggaggatgaggcaggagaatggcgtgaacctgggaggaggagcttgcagtgagctgagatcacaccactgcactccagcctgggtgacagagcgagactctgtctcaattctagtgcatcaaactgataggcagttgggtgagtgatccagatgtcatggatttcgggtgcgtttgctagttagaattgtggtatgatccygcctttcttccatgccctgttgctctgctgctgcttcattttaacccagaaatgatgttgtaactgagaaaattgagaggcatgttttatgaggttctctttgttgtagtatttttcccaaagaaaatgtcaggtcctgttgattagaaatggtagtccgtttaaaaatatatttttctttctcctagcctgtgaccgctggtcagtgcttcccagacctgatctccaccatgatgtcaacagatttggccattcagcagtcttacacaacaggtaattggagaagtgattgctcctttt

SEQ ID NO: 164756 - DNA, 601 bp, Human
gaattattgctcctaggggaaatacagggttatgtttctataaacctctgatgacattttcatcaaccagtcagcatacataactttcttttatgtgtgtttctatttaaaaacatcttgtcgaatatatattcttgatttattaacattgagctcacagccaacagcactttaactcatgcctgaacaaagcttatgtaacacacgtattttctcagtaaggctcgtcacagccttcttacacttaggaacactagacagcacttcagcactgcatagggggccattttcagcagtgaamgcactaacataaggcacaaaaatgcataaaacatggcactagatacatcatggaagggacacttgtttgtagtatgatagttgaaacaagaagggagagcatctccttgtttgaccttagccggtaatatgcatgtgtgtcaactcaaattttttgccattctttgcacacacatgctggtaaatgaccatgaaactactgcaagtattgattttggaattagaaatagattttataagtacgtgaatttgcaaatatggaatctacaatctgcagatatggtcatgtgtcactgaatga

SEQ ID NO: 164757 - DNA, 601 bp, Human
tctttaagccaggggtggtggctcacgcctgtaatcccagcgctttgggaggccaaggcaggaggattgcttgagtccaggagttcaacaccagcctgggcaacacagcaagacctcatctctactagaaatacaaaaattagctggtcatggtggtgcgtgcctgttgtcccaactactcaggaggttgaggtgggaggattgcttgagcccaggaatttgaggttgcactgagctatgatggtgctgttgcactccagtctgggtaatggagcaagactctaactcaaaaaaaaaaaawaagttgttctttaatatctctcagtgtccattcagtgtttacatctcctaattgtctcaatttttttttaagtttagtttgttcaactcagaatccaaataagatccatatgttacaattggttaaaatgtctctgaagtttctcttgatctgtagggaccccatccatcattttcccccttacttgttaaagagactgggttgtttgtcctgtagagtttcccgtagtccagattttgattattgtatcctgggctttcatataacatattggtctctctcctaaacttcctacaaatt

SEQ ID NO: 164758 - DNA, 601 bp, Human
agttatttatatcctgctgctcaaggtcatccccaaggtctgatttttcacaaaaaaatttgccctctggcataagtgggttaatgctgtagtgaatagcctcatgtacttctttttgtatttttgctattctatctttgtgctagacttctagaaatgtgatttcaggttcaaaaagtaaatgcaaagttttgttagagcttgccaaatccctctgtaggctgcatcattttacatgcccagcagtagtgtgtgagagtgccttttgccccatagtctcaccaatccatatattgtcaaytttttgtgcttttttttttttttgctagtcttataggtgagaaatgctacctcagtatagttttaatttgcatttttcttacactgaaattagagcatcttctcatatgtttaaggtcatttgcatttttttctctgcaaactggctgaagccccgctctatgttagggatagtccttttcctataacataacttgtaaatctttttttcatagcatatcatttgtttttttactttgcttatagcattatttccatgtaaaacgtctttttaattcatatgaccagatttttcaatctt

SEQ ID NO: 164759 - DNA, 601 bp, Human
aggtcatccccaaggtctgatttttcacaaaaaaatttgccctctggcataagtgggttaatgctgtagtgaatagcctcatgtacttctttttgtatttttgctattctatctttgtgctagacttctagaaatgtgatttcaggttcaaaaagtaaatgcaaagttttgttagagcttgccaaatccctctgtaggctgcatcattttacatgcccagcagtagtgtgtgagagtgccttttgccccatagtctcaccaatccatatattgtcaactttttgtgcttttttttttttttgctagtcttataggtgagaaatgctacctcagtatagttttaatttgcatttttcttacactgaaattagagcatcttctcatatgtttaaggtcatttgcatttttttctctgcaaactggctgaagccccgctctatgttagggatagtccttttcctataacataacttgtaaatctttttttcatagcatatcatttgtttttttactttgcttatagcattatttccatgtaaaacgtctttttaattcatatgaccagatttttcaatcttcttttcccctaccttctggattt

SEQ ID NO: 164760 - DNA, 601 bp, Human
gtctgatttttcacaaaaaaatttgccctctggcataagtgggttaatgctgtagtgaatagcctcatgtacttctttttgtatttttgctattctatctttgtgctagacttctagaaatgtgatttcaggttcaaaaagtaaatgcaaagttttgttagagcttgccaaatccctctgtaggctgcatcattttacatgcccagcagtagtgtgtgagagtgccttttgccccatagtctcaccaatccatatattgtcaactttttgtgcttttttttttttttgctagtcttatagrtgagaaatgctacctcagtatagttttaatttgcatttttcttacactgaaattagagcatcttctcatatgtttaaggtcatttgcatttttttctctgcaaactggctgaagccccgctctatgttagggatagtccttttcctataacataacttgtaaatctttttttcatagcatatcatttgtttttttactttgcttatagcattatttccatgtaaaacgtctttttaattcatatgaccagatttttcaatcttcttttcccctaccttctggattttaagtcagtttttt

SEQ ID NO: 164761 - DNA, 601 bp, Human
tgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaagtatgtttttttttctctacttagattttaatgaatttgagacctcattttatctgaattgtgaaggaacttagcatatgtatactttttatgtttaccttatccaaaattattcagtaataacttgtacaaagtgtttttggatatttgawaattggtttgtaaacatctcggatgggaacatgccatgtggctcctagaagctgtctgcgagtgatagagacataaccgttttggcattgcataggctttgcatactgaccccagattctggctgcagttgctctgaggcagtgccatccagtagaactttatttttgatgatggaaatgttgtgtgtctggactgtcccgatatggtagccactagccacatgggctatcagatacttgaaatgtagctagtgtgagtgaagaactgaatttttaatttaatttaattttaatttaaaa

SEQ ID NO: 164762 - DNA, 601 bp, Human
gctcctagaagctgtctgcgagtgatagagacataaccgttttggcattgcataggctttgcatactgaccccagattctggctgcagttgctctgaggcagtgccatccagtagaactttatttttgatgatggaaatgttgtgtgtctggactgtcccgatatggtagccactagccacatgggctatcagatacttgaaatgtagctagtgtgagtgaagaactgaatttttaatttaatttaattttaatttaaaagacatttgtggttactggctaccatattggatgcagatctracattaaggattaagttaggagagtcagcccagaaaagccatgttgaagtaaatttttttggtggagggagggagagctgctgtccttgcaaagtatttttgtctagcgtctctagttggatacaacagtgatatcaagacagacagttactgaggatgggcgatgatccctgcttctagaacctcccccatgtttttcaagctgtttccttccttctgcctgctttgcttcttgtcctatattgctgtgacatagagcacaatgcggtacagtgaagcgatatattaaaaatttatttt

SEQ ID NO: 164763 - DNA, 601 bp, Human
tgtctgcgagtgatagagacataaccgttttggcattgcataggctttgcatactgaccccagattctggctgcagttgctctgaggcagtgccatccagtagaactttatttttgatgatggaaatgttgtgtgtctggactgtcccgatatggtagccactagccacatgggctatcagatacttgaaatgtagctagtgtgagtgaagaactgaatttttaatttaatttaattttaatttaaaagacatttgtggttactggctaccatattggatgcagatctgacattaaggatkaagttaggagagtcagcccagaaaagccatgttgaagtaaatttttttggtggagggagggagagctgctgtccttgcaaagtatttttgtctagcgtctctagttggatacaacagtgatatcaagacagacagttactgaggatgggcgatgatccctgcttctagaacctcccccatgtttttcaagctgtttccttccttctgcctgctttgcttcttgtcctatattgctgtgacatagagcacaatgcggtacagtgaagcgatatattaaaaatttattttttgttttatttt

SEQ ID NO: 164764 - DNA, 601 bp, Human
aaaagccatgttgaagtaaatttttttggtggagggagggagagctgctgtccttgcaaagtatttttgtctagcgtctctagttggatacaacagtgatatcaagacagacagttactgaggatgggcgatgatccctgcttctagaacctcccccatgtttttcaagctgtttccttccttctgcctgctttgcttcttgtcctatattgctgtgacatagagcacaatgcggtacagtgaagcgatatattaaaaatttattttttgttttattttattttatttatttatttattttttttgagacagagtctctgtcgctcatgctggagtacagcagcgtgatctcagctcactacaacctccacctcccaggttcaagtgattcttatacagtcacctgccaccatgctcggctagtttttgtatttttagtagagatggggttttaccatgttggccaggctggtctggaactcctgacctcaagtgatctgcccgcctcagcctcgcaaagtgttggaattacaggcgtgagctactgtacatggccagaaagttctttaaaagtaagaatgttgtctctacatcaattaat

SEQ ID NO: 164765 - DNA, 601 bp, Human
ggtggagggagggagagctgctgtccttgcaaagtatttttgtctagcgtctctagttggatacaacagtgatatcaagacagacagttactgaggatgggcgatgatccctgcttctagaacctcccccatgtttttcaagctgtttccttccttctgcctgctttgcttcttgtcctatattgctgtgacatagagcacaatgcggtacagtgaagcgatatattaaaaatttattttttgttttattttattttatttatttatttatttattttgagacagagtctctgtcgctcakgctggagtacagcagcgtgatctcagctcactacaacctccacctcccaggttcaagtgattcttatacagtcacctgccaccatgctcggctagtttttgtatttttagtagagatggggttttaccatgttggccaggctggtctggaactcctgacctcaagtgatctgcccgcctcagcctcgcaaagtgttggaattacaggcgtgagctactgtacatggccagaaagttctttaaaagtaagaatgttgtctctacatcaattaatttaaagtatgttggctgaatttcttac

SEQ ID NO: 164766 - DNA, 601 bp, Human
tcatcatatatagatttttaaatttaagttataagatgacccaggcttttatagtttttgacagcttacaagacttttttttttgtcagtctcatacagttcataaaatagaaaactttcagacttttgaagtgagcatttgaaaagcaccaagttcaacattcccattttacagatgagcaggttgaggcatggtgtttaaaagagtgggctgcttccttgccagttaaaagcatgtccttgagcagaacattccattgcagtgttccccactgcagagctactgcaacttatctatctrtctgtctgtctgtctgtctgtctgtctatctatctatctatctatctatctatctatctatctatctgtctatctatttatttgcagtttgcttcctcaattagattttgttgtctataatatcctgttggtcctcaccataagttctctctgtggatacaaaagaaaagcttttgtccactgtgttctagatctccatttttaggtatgagaattgccccaaggataaccccatgtactactgtaacaagaagaccagctgcaggagctgtgccctggaccagaactgccagtgggagc

SEQ ID NO: 164767 - DNA, 601 bp, Human
ttataagatgacccaggcttttatagtttttgacagcttacaagacttttttttttgtcagtctcatacagttcataaaatagaaaactttcagacttttgaagtgagcatttgaaaagcaccaagttcaacattcccattttacagatgagcaggttgaggcatggtgtttaaaagagtgggctgcttccttgccagttaaaagcatgtccttgagcagaacattccattgcagtgttccccactgcagagctactgcaacttatctatctatctgtctgtctgtctgtctgtctgtctrtctatctatctatctatctatctatctatctatctatctgtctatctatttatttgcagtttgcttcctcaattagattttgttgtctataatatcctgttggtcctcaccataagttctctctgtggatacaaaagaaaagcttttgtccactgtgttctagatctccatttttaggtatgagaattgccccaaggataaccccatgtactactgtaacaagaagaccagctgcaggagctgtgccctggaccagaactgccagtgggagccccggaatcaggagtgcattgccctgcc

SEQ ID NO: 164768 - DNA, 601 bp, Human
atgtgatatatttggaccagggtggtccagaaaggggaacttccttgtctgtgcacaacatctgagcttgttcagggaagttggtttggaccaggccctttttgaatgtcccttggaagtttttgattcagcttgcagagtgggactcttttctatatctcagtgtgtctcaaattttaaggtacaggaaaagacctgggaatcttgcgaaaggcatattctggtgcaagtgtggggtggggcctagagtgtgcattttatctagtcgactgctacactgtgaggagcaagtctttgtctrttcttaaatgatctctttcccatggtacctttcttttatctcagtgactgttactgttaatgaacattgttgatgtctccaaagtactttggttctggtgaagttgctttgttctttcattgtcttccaggaagcattcatagcttctgtgcagtaccttgtgtgggttcaggatgatcacaggtagcagattacaagcttgtcttgtatgctatagccatatcacttgggttgtttctcaagaaggaccttctcaccttgcttttgggatgctttgtacacttgattgtaccttccacc

SEQ ID NO: 164769 - DNA, 601 bp, Human
acaacccagaagaaggtagaatttgtccttaagcagctgcgaataatgcagtcatctcagagcatggtgagttaaaatcctcaaaacttaagtttctggttatccacctttctaccaagggcatgactgcagcttgcatgtggaaggctgtggatatgtgtgacgtgcttggcaagaaggggagtgctggtgaacgcagcctgagggactgtgggtttgtgctgtcagagtctcttcctcttaaaatttttaatactttgtatatataagatctatgaataattatatgggggatgaattrtaacatgtatatgtgtacataatctggtgacatcagtagattatttcatacctgttttacctctggattctgctaggggagaaagagaggtcactgataattagctaggttggattaagccacctgagttccttggagttaaggtattataatagtgcataagactgtataattaccactaagaagtgtacatctcagctggatgtggtggctcacacctgtaatcccagcactttgggaggctgaggtgggtggatcgcctgaggtcaggagttcaagaccagcttgaccaatatagta

SEQ ID NO: 164770 - DNA, 601 bp, Human
taatagtgcataagactgtataattaccactaagaagtgtacatctcagctggatgtggtggctcacacctgtaatcccagcactttgggaggctgaggtgggtggatcgcctgaggtcaggagttcaagaccagcttgaccaatatagtaaaaccccgtctctactaaaaatacaaaaattagccaggcatggtggtgtgcgcctgtaatcccagctactcaggaggccgaggcaggagaattgcttgaacccaggaggtggaggtggcagtgagctgagattgcgccaccgcactccarcctgggtgacagagcgatactccgtctcaaaacaaaaaaagaacagcaaaaaaaagaaatgtacatctccttgggtctttcatagcccagccatctcaaaagaagagagcaccttcttgtcaagagtttctaagcccagaaaggctcaagttctctgcttgtccacccagtgctctcagggggcttatagtcaatattccatgatcacattttgtcatttttagtctggagtcataaattgtgatcctaccgtcagttaagtagactcatagaacaaagctctttcagcagtttcagctg

SEQ ID NO: 164771 - DNA, 601 bp, Human
agaacagcaaaaaaaagaaatgtacatctccttgggtctttcatagcccagccatctcaaaagaagagagcaccttcttgtcaagagtttctaagcccagaaaggctcaagttctctgcttgtccacccagtgctctcagggggcttatagtcaatattccatgatcacattttgtcatttttagtctggagtcataaattgtgatcctaccgtcagttaagtagactcatagaacaaagctctttcagcagtttcagctgtggtacagaaacgtttagtggaaatgttcttaccaagcarggaggagttgagggcaacacttccttgggtacagcctccttcatgtgaaggtatggaaatgtggcctgggtctcggctgcctgtggcctctgtgtaccacctatagggccattctgagactggtaggaggtgccctgtatttagttttctccaattagtcccttttttcagtgcaacttagatggggtatggacactcaaacattggtgatatattcttagtgtgtttacctcaggctactgtgaccacatttggtatttcataatattttgatagctttttcagatttcagaatctcca

SEQ ID NO: 164772 - DNA, 601 bp, Human
cgtcagttaagtagactcatagaacaaagctctttcagcagtttcagctgtggtacagaaacgtttagtggaaatgttcttaccaagcagggaggagttgagggcaacacttccttgggtacagcctccttcatgtgaaggtatggaaatgtggcctgggtctcggctgcctgtggcctctgtgtaccacctatagggccattctgagactggtaggaggtgccctgtatttagttttctccaattagtcccttttttcagtgcaacttagatggggtatggacactcaaacattggtgayatattcttagtgtgtttacctcaggctactgtgaccacatttggtatttcataatattttgatagctttttcagatttcagaatctccattggtgactgtctctgttgtttctctttccatgtccaaatgtgggtctcttccagcattccatccttggctggcagctgacctttcccatagttattcactccctcagaaaatggatggcacccagctttgcttattaccctggtgtctctaacaatgactctcaagtccacagaagttaaaagggttcaaccaggtggccacagatatac

SEQ ID NO: 164773 - DNA, 601 bp, Human
agattagtaaagcaagcaagtgactgcagggacagtgttcagaaaggtagtgtcaacagggagaaaaatgatgagagcagttctgtaagcgaggacagaagcaacccagaactacgcgagagctgcaggagagtactgagcagacagacactcggagtagcttcccagctttcagtctctctgggctacattttggctaactaaaggcaggcccaggggtagctgctgcagcatgaagacaactcaaaataagcctcctcctcctgcagagggactcacaagcagtcggtggaattgtggrttattttgggaggctggactccatttgcattgtgtccaattttgggaaagtaatttgtctgaggaattacagaggtataggagagaattcatagcattgtagatttctaaatattgatttctaaacttctctaggggagctgcccagcagcctttcagaattctgaatcctttgttgaacttaatgaatgccgtagaccttcttccctccaaaattgcaaacatgagattttacatattcaagtggattgtaaaacccctaaagttcatcctgggtccccaaattctaaggggcttacag

SEQ ID NO: 164774 - DNA, 601 bp, Human
gataaaggatttaaatagacatatgtccagagaagaaatacaaatggccaataagcacatgaaaagatactcaatatcattcatcattaccaagaaatgcaagtcaaagccacaatgagataccactttacacccactgagatggctgtaatcaataaaacaggtaataacaagtattggaaggatatgtagaaattggaactctcatgcaggttggcaggtcctcaaaaagttaaatatagagttatcatacggcccagcagttttactcctaggtacatacccaagaaaattgaaaacrtatgttacccaaaaacttgtatataaatgcttatgcttatagcatcattcttcatagcatcatgctcaaagcaacattattcataataagcaaaagtgaaaacaagccaaatacctgttagctggcaaatggatgaacaaagtgttgtatattcatacagtgtaatgttatttggcaataaaaaggaatgaagtactgacatattttctgacatggattaccctaaaaaaacatgctatgtaaaagaagccaggtgcaaaagattatgcgttgcatgatgccatttatatgaaatgtcca

SEQ ID NO: 164775 - DNA, 601 bp, Human
catcattgctggtgctactcagcagggtttggtctgtctactttttagtttatatctgcatatatgtttactagcttcatgttgccctaaagccaatatgtgaagaaaagtctaatccaaggttaaatttaacttttaggtccacattcccttaaacagaaaaatgtcatcgagcaaaattaatcactcttaccctcagttagctgatgcaacaaagacatgaggtggcatcaagtaagactttcaagttccttcgagatcgcagatgtaggcaggtgctgctcatcaccctggctaaagsgacacagcatacctgcctgggaaaggccattacccacttcccgccctttcctcttcatgcatagctgttgtgtttacctaaatgcttcatgaagtgggaggctgggttttgctgatgtttatagatgatctgtatggggaaattgttttctgagtagaacatattttttttctacagactggtgaacacttgttccagggtttaaaaaaacagtgattcttggtatttagtcttctctcacttgtgtttaaagaagagaattagtttatccagggaacataggaaagaagtgagaaatta

SEQ ID NO: 164776 - DNA, 601 bp, Human
tttagaataagattttaacaaaagtaccatatatgaaatgtattcactgcctcataagcaagcgtttgaagtgctcaaaatctttcaggatatacttcatgccattaatgtcattaaaaaaataaatatagtagaatctttgtaatacttcttaaccaggtgggaagcaaccatgaaagtatttggacctttctggatttcccagtttatcttacgacagaatacttactagagttatccaaatgcatatgttctgtcctctataaaagcacaagcattttaagtttattgattctttctrtggaaagacatatagttgacccttgagcaatacaggttaaaactgtgaggatccacttacacgtagacttttttcaaccaagcgtggaatgaaaatacagtatttgcaagatgtgaaacctgagtatacagagggtggacttttcatatgcaagggttctatgggcagactgcggactggagtatgtgtggatttgggcatgctcagggggtcctggaaccgatgacccacgtataccaaaggatgactgtaattgttagttgtgtgctgccagcaaatactaaatacaaataagtaaac

SEQ ID NO: 164777 - DNA, 601 bp, Human
gagttatccaaatgcatatgttctgtcctctataaaagcacaagcattttaagtttattgattctttctgtggaaagacatatagttgacccttgagcaatacaggttaaaactgtgaggatccacttacacgtagacttttttcaaccaagcgtggaatgaaaatacagtatttgcaagatgtgaaacctgagtatacagagggtggacttttcatatgcaagggttctatgggcagactgcggactggagtatgtgtggatttgggcatgctcagggggtcctggaaccgatgacccaygtataccaaaggatgactgtaattgttagttgtgtgctgccagcaaatactaaatacaaataagtaaacacttgagctgtcctttcaagatgaaggtgaggtcttatcagtaaatgagaaggtaaatgctttgtgagagaaacttctggtttaatgatcacattttaaaaatagctgtttggaaatgtttccattgttgtgattttgtgctattaaaatgatcaaaacaacacccttaaaaatcttattctaacctctcaagatcttttaaaaatgaataatttcagtacagtcggatgc

SEQ ID NO: 164778 - DNA, 601 bp, Human
aagtgctgtggctcatgcctttaatctcaacactttgggagactgaggcaggaggattgcttgagctcaggagtttaagaccagcctgggcaacatagtgagaccctgtctacaaaaaaaaaaaaaaaaaaacccaggtgtagtgactcatacctgtaatgccaactactcaggaggctgagatgagaggatcacttgagcccaggggttggagattgcactgagccatgatcgcaccattgtactccagtgtgggcaaacagagcaagatcccatctctttaaaaaaaaaaaaaaaaaaagaaaaaaggataatcactacttaacttgataactcaacaagtagatatgggtttgaaatttgtccattaaatttacttgcaccgtgctgttaggcaagttacttaaggtttctgagccagtttcctcctgtataaagtaggatagtaaaaacaccgtcctggcagggcgtgatagctcatgcctgtaatcccagcactgtgggaagccaaggtgggaagatcacctgaggtcaagagttttgagaccagcctggccaacatggtgaaaccctgtctctactaaaaatacaaaaatcagcc

SEQ ID NO: 164779 - DNA, 601 bp, Human
aaaaaaaaacccaggtgtagtgactcatacctgtaatgccaactactcaggaggctgagatgagaggatcacttgagcccaggggttggagattgcactgagccatgatcgcaccattgtactccagtgtgggcaaacagagcaagatcccatctctttaaaaaaaaaaaaaaaaaaagaaaaaaggataatcactacttaacttgataactcaacaagtagatatgggtttgaaatttgtccattaaatttacttgcaccgtgctgttaggcaagttacttaaggtttctgagccagttycctcctgtataaagtaggatagtaaaaacaccgtcctggcagggcgtgatagctcatgcctgtaatcccagcactgtgggaagccaaggtgggaagatcacctgaggtcaagagttttgagaccagcctggccaacatggtgaaaccctgtctctactaaaaatacaaaaatcagccaggcgtggaggcacgtgcctgtaatcccagctactcaggaggctgaggtaggagaatcgcttgaaccttgaaggtagaggttgctgtgagccgagatcacgccactgcactccagcttgggtg

SEQ ID NO: 164780 - DNA, 601 bp, Human
ataataaatgaagtactcaatatagtgcttgaaatgtggtaaatggtaactatattttatcattattactattacaatactgggttttttaaaatcaaaaacacaaagcaatgagattgatgcaaaataagaatattgccttgtgcacgccacttacgtttatcatcttaaaacattgtgtagaatttgagaaaagttcagaaactctcaatgaggagggacttttaagaaaaagtctgaattatcagagtatttggagaaaggcaacatctccaggcatgtgaaagatttgcaatgagcygggcggtggctcatgcctgtaatcctagcactttgggaggctggggcaggtggattacctgaggtcaggagttcaagaccagcctgaccaacatggtgaaatcccgtccctactaaaaatacaaaactagctgggtgtggtggggcgtgcctgtaatcccagctacttgggaggctgaggcaggagaattgcttgaacctgggaggcggaggttgcagtgacccaagattgcatcattgcactccagcctgggcaacaaaagcgaaattccatctcaaaaaaaaaaaaaaaaaaaaaaaa

SEQ ID NO: 164781 - DNA, 601 bp, Human
tgctgggattacagatgtgagccaccgcacccggccagtaaaaccattttggttaggggcataggcttgtatatcagcctgcccagctttaaatcttatctccatttcttgttggctgtgtgacttgagggaagttacttaatttctgtgaacctcaatttcccagtctataaatgaagataataatagggcagctgtgaggattaaatgagattgagctcttaaaggctattactggaacacaggaaatgtttgataaatgctattgtccttattattaatgaggccagattctgttctycccctagccccccaaaaaatgtctcttctctttcatgtttttcttttaacagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcaggtaagaagaggcttttggtctcatacctgcaaaggtggtgaaatctctttagtaagactaaatttactaatttggagcttgtggtaaatg

SEQ ID NO: 164782 - DNA, 601 bp, Human; identical to SEQ ID NO: 118658

SEQ ID NO: 164783 - DNA, 601 bp, Human; identical to SEQ ID NO: 118659

SEQ ID NO: 164784 - DNA, 601 bp, Human; identical to SEQ ID NO: 118660

SEQ ID NO: 164785 - DNA, 601 bp, Human; identical to SEQ ID NO: 118661

SEQ ID NO: 164786 - DNA, 601 bp, Human; identical to SEQ ID NO: 118662

SEQ ID NO: 164787 - DNA, 601 bp, Human; identical to SEQ ID NO: 118663

SEQ ID NO: 164788 - DNA, 601 bp, Human; identical to SEQ ID NO: 118664

SEQ ID NO: 164789 - DNA, 601 bp, Human; identical to SEQ ID NO: 118665

SEQ ID NO: 164790 - DNA, 601 bp, Human; identical to SEQ ID NO: 118658

SEQ ID NO: 164791 - DNA, 601 bp, Human; identical to SEQ ID NO: 118659

SEQ ID NO: 164792 - DNA, 601 bp, Human; identical to SEQ ID NO: 118660

SEQ ID NO: 164793 - DNA, 601 bp, Human; identical to SEQ ID NO: 118661

SEQ ID NO: 164794 - DNA, 601 bp, Human; identical to SEQ ID NO: 118662

SEQ ID NO: 164795 - DNA, 601 bp, Human; identical to SEQ ID NO: 118663

SEQ ID NO: 164796 - DNA, 601 bp, Human; identical to SEQ ID NO: 118664

SEQ ID NO: 164797 - DNA, 601 bp, Human; identical to SEQ ID NO: 118665

SEQ ID NO: 164798 - DNA, 601 bp, Human; identical to SEQ ID NO: 118658

SEQ ID NO: 164799 - DNA, 601 bp, Human; identical to SEQ ID NO: 118659

SEQ ID NO: 164800 - DNA, 601 bp, Human; identical to SEQ ID NO: 118660

SEQ ID NO: 164801 - DNA, 601 bp, Human; identical to SEQ ID NO: 118661

SEQ ID NO: 164802 - DNA, 601 bp, Human; identical to SEQ ID NO: 118662

SEQ ID NO: 164803 - DNA, 601 bp, Human; identical to SEQ ID NO: 118663

SEQ ID NO: 164804 - DNA, 601 bp, Human; identical to SEQ ID NO: 118664

SEQ ID NO: 164805 - DNA, 601 bp, Human; identical to SEQ ID NO: 118665

SEQ ID NO: 164806 - DNA, 601 bp, Human; identical to SEQ ID NO: 118658

SEQ ID NO: 164807 - DNA, 601 bp, Human; identical to SEQ ID NO: 118659

SEQ ID NO: 164808 - DNA, 601 bp, Human; identical to SEQ ID NO: 118660

SEQ ID NO: 164809 - DNA, 601 bp, Human; identical to SEQ ID NO: 118661

SEQ ID NO: 164810 - DNA, 601 bp, Human; identical to SEQ ID NO: 118662

SEQ ID NO: 164811 - DNA, 601 bp, Human; identical to SEQ ID NO: 118663

SEQ ID NO: 164812 - DNA, 601 bp, Human; identical to SEQ ID NO: 118664

SEQ ID NO: 164813 - DNA, 601 bp, Human; identical to SEQ ID NO: 118665

SEQ ID NO: 164814 - DNA, 601 bp, Human
tttgtgtctccctttctctgcccagcctggcctcaaggacaagccccttcgaagcagtaggaggtggagggaaccatttaacgaagtccttggggctcagcagtgtctctccacttgccctaccctggaggcccaggagcagcctggttttgcatcaggagcaagggttccgtttctgtgggctggagaggggctggtttctgtcaggagcaacagatgcgctcagccacaagggtgtgtccccagacaactcacacttcacttggaggtgaatctcgctctgagccctgtgattggccayggagagctggcagcgcaggatccggccgtggtcctgccaggacatggccatgtggagggtctccaggtggccgacgccggtgggctcaaacttctggctgttgaaggtgacagagcgagcagggtcctggccttgccactgcagtctgacctgctcctgcaggcatacgtagggagtggagcagttgaagtccacctctgtgccctcgagaagctccaccggggaggcaatggtgggcaccctgggctcctctgaggacagagacagcagtgctcaggacccgcttttgccacccctgag

SEQ ID NO: 164815 - DNA, 601 bp, Human
atcaaactagctctgaaaatagttacccagtttgtaagcaagaggccaacaacacaaagaactgcatttccttaaatcttgttccaaagcctctctctgtgtattcaagtgttttattcttatttttttagaaagaggatctggctcagtcagccaagctggagtgcagaggcacaatcatagctcactgcagcctgaaactcctgggctcaagtgatcctcctgcctcagcctcccgaggaactgggactacaggtgcaagccaccacatccagctaatttttgttttttaattttttttgtagagacagggtctcactatgttgcccaggctggtctcgaactccttgcctcaagcaattctcctgccttggcctcccaaagcactggggttacaggtgtgagccactgtatccggcctcaagtgtttaatatgtgccaggcactcttctaaatccttgacctgggtcatctcctttatttgtttttgttgttgttgttgttttttgtttgagacacagtctcactctgtcacccaggctggagtgcagtggcacaatcacaactcaatacaactccacccccggggttcaagcaatcc

SEQ ID NO: 164816 - DNA, 601 bp, Human
ctccctattctctggccaatacgcaaccttcccaagaactcactgaagatgtggaggctgatggggggtgagaccaaagagcccacgccgttctcagcttggcaggtgtagacgccagcatcgctccaggctgcctggggcaggtgcagcacaccagtcttggtttggaggcgtaccccatccttgagccacttaatggaactgactgcagggtagctgctgttcacctggcaggtgagtgtgaccagctcacctggaaggatgttcctccccgaggggctgaggaggatcttcacacccytgggggcatctgcaagtcacagtagggggtattgggtaaggtgcttggggagggcagaggatggcacacttcttcttgcccccctttaaaagctcagtcctaaggaagtatgcccagataaaacagcagtccccttcaatcctcacccagggcatgctctgtctgcccatgtccgtccctttcccgccccctgcgcctgatgcattcctatgcccattgagagctgatcatgtgacgcttggccagcgtccagcctaccccaccagctgtagttttctgcttcccaatgctgtccattgc

SEQ ID NO: 164817 - DNA, 601 bp, Human
ggggtcccagccaacttccagccccagccccatacagtccccgggtctcagccaatcagcctcaatctctgcacatcctacaccacccgcctgctgctacaggggagcctcctggagtgctctgcatctctttgtcctgctcaccaggatccccctgacaccccacccttcgtgggggtattgtcacctgtctcatggtaaggcagggctgggactccacacctgcatccaggaagcactgggttatgccagttgctggccctgccctgccctgtctcccctccgtccctgaggcctgagytcctccctattctctggccaatacgcaaccttcccaagaactcactgaagatgtggaggctgatggggggtgagaccaaagagcccacgccgttctcagcttggcaggtgtagacgccagcatcgctccaggctgcctggggcaggtgcagcacaccagtcttggtttggaggcgtaccccatccttgagccacttaatggaactgactgcagggtagctgctgttcacctggcaggtgagtgtgaccagctcacctggaaggatgttcctccccgaggggctgaggaggatcttcacac

SEQ ID NO: 164818 - DNA, 601 bp, Human
aaggccacctccaggtaagtggccttgaagttcccatgcccaggaccccaacccttccttggggctccaccatctggtcctgctctgactgtgtccagtgccaccccaccctggcctcttacggttgactaccacgctgacagggcccgagcgctcgctgccatggacgttctgcacctcacagaagtagaagccagtatcagccctagtggccaagtgcagccggagggtatgggagtgggcatcctccagcaggacatggttcttgtaccagctgtagcggagatcactgggtgcctcrttgggtgtgttgcagactagtgtcactgtctggttctccaggatgggacctgctgggctcacctggacctcagccactgcaagggcagcatagggagtgctggggggtcccagccaacttccagccccagccccatacagtccccgggtctcagccaatcagcctcaatctctgcacatcctacaccacccgcctgctgctacaggggagcctcctggagtgctctgcatctctttgtcctgctcaccaggatccccctgacaccccacccttcgtgggggtattgtcacctgtctcatg

SEQ ID NO: 164819 - DNA, 601 bp, Human
ctgaatacacttttgtccttggctgggctgggtacgtcactctgttgtcccagtcagtgttcaaggccaccctgcaagtggggataaaagccccacttcaaagatgagaaaactaatagagagacctggtgagggacagcacctcagccaggtgaccaaagtgagcatcatcagcaatgggacaagctgacacagagtgcctcctgacagggcagagcagcatgtccgcggccttcccacccagagggcatggtctcaggccattcaagtcaggcaaatgtggagtgagggacctcctcasaacagcaggcctgcactctgcaagtttcaacatcaagaatgacaaggaaagactgaggaacagtctcagactaacggagaatgaagagacgcaacgacccaatgcaatatgtgaactgtgattgtattctggaccagaaaaaaaatggctacaaaagacagtattaggtccactggtaaaatgtgaatatagattatagcttagataacagtcttctatcagccaggtgtagtggctcatacctgtaatcccagtactttgggaggccgaggtaggtggatcacgtgaggtcaggagttc

SEQ ID NO: 164820 - DNA, 601 bp, Human
cacagcccctgtcttttatgtggcgtagccagttagctcagtcctgcggttgagtccactagacttctagaaggaacagactggagcaggctcctcctcaggctccctccactctccctggctgccagtgcccatcttaccattggcatggaagtccagggtagaggttgcatttccaagggagttggtggctgagcacttgtactccccactgtcagtttcctccaggtctcggatctccaggcgcagggagttgggaccagaggtaccactgaagcgtgggctgtgatcactgtccccrgaggtggaggccaggatatgacccccatgtgacagcaccagtgtggccaggggctcactgaccacagagcagtgaaggatgcccacaagtcccgcctgggtctccaggaaggctgtcaggactggggtgagaggcgggtctgtgtggagacgagaggtgggcctgtcaccctcagacaagggcattccctggataccctgatacaacccgtgacctctgcactgctttgtcccacactgccctgcgagaagggggtgatcccaaagtgcctgagtgcctgctgaatacacttttgtcctt

SEQ ID NO: 164821 - DNA, 601 bp, Human
tttcataattaaaaaacaatgaatgcttctgagggactctccaagtttagggtcagggtaggtgcaaaaggaatgatgtgacctgttgtgtttccctttttcccttgacttccaggaagctctgccgttgggtcactgcacagcccctgtcttttatgtggcgtagccagttagctcagtcctgcggttgagtccactagacttctagaaggaacagactggagcaggctcctcctcaggctccctccactctccctggctgccagtgcccatcttaccattggcatggaagtccagggtrgaggttgcatttccaagggagttggtggctgagcacttgtactccccactgtcagtttcctccaggtctcggatctccaggcgcagggagttgggaccagaggtaccactgaagcgtgggctgtgatcactgtccccagaggtggaggccaggatatgacccccatgtgacagcaccagtgtggccaggggctcactgaccacagagcagtgaaggatgcccacaagtcccgcctgggtctccaggaaggctgtcaggactggggtgagaggcgggtctgtgtggagacgagaggtgggc

SEQ ID NO: 164822 - DNA, 601 bp, Human
cgctatcttggctcactacaacttccacctcctgggttcaagcgattctcctgccttagcctcccaggtagctgggactacaggaactcaccaccatgcccagctaatttttgtatttttagtagagatgggatttcaccatgttggccaggatggtctcgatctcttgacctcgtgatccacccacctcggcctcccaaagtgctgggattacaggagtgagccaccgcgcccagccagaagaccctacttttctatttggcttcccacatctgactgctagcatagagcctgctcccaragtttcataattaaaaaacaatgaatgcttctgagggactctccaagtttagggtcagggtaggtgcaaaaggaatgatgtgacctgttgtgtttccctttttcccttgacttccaggaagctctgccgttgggtcactgcacagcccctgtcttttatgtggcgtagccagttagctcagtcctgcggttgagtccactagacttctagaaggaacagactggagcaggctcctcctcaggctccctccactctccctggctgccagtgcccatcttaccattggcatggaagtccagg

SEQ ID NO: 164823 - DNA, 601 bp, Human
tttttctttttctttttttttttttttttgagacagagtctcactcttgtcacccaggctggactgcagtggcgctatcttggctcactacaacttccacctcctgggttcaagcgattctcctgccttagcctcccaggtagctgggactacaggaactcaccaccatgcccagctaatttttgtatttttagtagagatgggatttcaccatgttggccaggatggtctcgatctcttgacctcgtgatccacccacctcggcctcccaaagtgctgggattacaggagtgagccaccrcgcccagccagaagaccctacttttctatttggcttcccacatctgactgctagcatagagcctgctcccaaagtttcataattaaaaaacaatgaatgcttctgagggactctccaagtttagggtcagggtaggtgcaaaaggaatgatgtgacctgttgtgtttccctttttcccttgacttccaggaagctctgccgttgggtcactgcacagcccctgtcttttatgtggcgtagccagttagctcagtcctgcggttgagtccactagacttctagaaggaacagactggagca

SEQ ID NO: 164824 - DNA, 601 bp, Human
ccttccagggttctcctttccccacactactgtaggtagctctgggctttgtggtgcatcaggagggtttgccctttaatgccaaatcagatctattggtagtagatggctgcagcatggttgaagattcagagccagagcccaggcttatgtccaacacctggcttggctgggcatggtagctcatgcctgtaatcttagcactttgggagactgaggcagaaggatcgtttgaggccaggagttccagaccagcctaggcaacatagtgagactccatctcaaacaattttttttttttgagactgagtctcactctgtctcccaggctggagtgcagtggtgtgatcctggctcactgcaacctctgcctcccaggttcaagcgattctcctgcctcagcctcccaagtagctgggattacaggtgtgccaccacacccagctaatgttatacatgtagtagagatagggtttcaccatgttagccaggcagatctcgaactcccgacctctggtgatccacccgcctcagcctcccaaagtgctgggattacaggtgtgagccactgtggccagctttttttttttttttttttttt

SEQ ID NO: 164825 - DNA, 601 bp, Human
agcagggctccattcaggtaccaggagaagcgggcatcaggtgtggggcttaggccgcttctgcagctcagtgtcactgcctgtccttccaccacctcggctgccgggctgatgaggagacgggcggctgcggggagaggaagaggctgggaagggtccctcctctcaaccccacatgctgccctatatagaaagccttccagggttctcctttccccacactactgtaggtagctctgggctttgtggtgcatcaggagggtttgccctttaatgccaaatcagatctattggtagtagrtggctgcagcatggttgaagattcagagccagagcccaggcttatgtccaacacctggcttggctgggcatggtagctcatgcctgtaatcttagcactttgggagactgaggcagaaggatcgtttgaggccaggagttccagaccagcctaggcaacatagtgagactccatctcaaacaattttttttttttgagactgagtctcactctgtctcccaggctggagtgcagtggtgtgatcctggctcactgcaacctctgcctcccaggttcaagcgattctcctgcctcagcctc

SEQ ID NO: 164826 - DNA, 601 bp, Human
ctgctgccgggaccctcgtgaagcagggctccattcaggtaccaggagaagcgggcatcaggtgtggggcttaggccgcttctgcagctcagtgtcactgcctgtccttccaccacctcggctgccgggctgatgaggagacgggcggctgcggggagaggaagaggctgggaagggtccctcctctcaaccccacatgctgccctatatagaaagccttccagggttctcctttccccacactactgtaggtagctctgggctttgtggtgcatcaggagggtttgccctttaatgccaratcagatctattggtagtagatggctgcagcatggttgaagattcagagccagagcccaggcttatgtccaacacctggcttggctgggcatggtagctcatgcctgtaatcttagcactttgggagactgaggcagaaggatcgtttgaggccaggagttccagaccagcctaggcaacatagtgagactccatctcaaacaattttttttttttgagactgagtctcactctgtctcccaggctggagtgcagtggtgtgatcctggctcactgcaacctctgcctcccaggttcaag

SEQ ID NO: 164827 - DNA, 601 bp, Human
cctggcgggggggtcgctgtccacacggcacaaaaggaggcctcgccgtccagccccggccccagcggcatcaaggtccagcctggtggtgaatgttggttgtcgaggggggtctgcagggaggaagaacatgggcactcatcccacggatgctccagggccccacaagcctggctaggctcccagaatacactggacaaaggcagatcccgaaggctgccccaagcagctgtgcagactgtgcactgcacaagggcagccagaccagggtgggtggaactcaagctaggctcatgctccycaagctaagctgtgccctgatgcctactgagtcttcccagaagaaggagcaccattttctagctcagacaaaggtgctgtatgggctggctgccaccttgcataagtcccatctgctgctgagcagggtgcccacctagcaatccctgggggtcatgctgtctgctcccaccctgcacccaatgccttaccacggagcctcccctcaagatctgccctgcagcttatctgtgatctccaagccagctcctgtgatactagcgaatgcatagaatggcctcttcctgaaggcttctggaga

SEQ ID NO: 164828 - DNA, 601 bp, Human
aagacagagtctcactctgtcatccaggctagagtgaagtacaattttggctcactgcaacctccatctcccaggttcaaacgattcgcctgccttagcctcccgagtaactgggattacaaatgcccaccaccacacctagctaatttttgtatttttagtagagtgttggccaggctggtcttgaactcctgacctcaagtgatccgcccgcctcagcctcccaaagtgctgggattacaggcatgagccatggtgcccggcctgagggaggatttttatagagactatatatatatayacacacacacacacacacacacacacacacacacacacgtatgtgtatataaataaagaatatgaatatattatgcataagaatacacataatgtatatttgtatgtgtatatactcatacataaacatatatgcataatataaatatacatatgtatgagaatgtttactatgtaacaaaattatatgatcacaaaacaagttatttcagaaagtgctcccaccaagcaagccactttgtgaattgccattgcctcctagtggctgctgcagttattacaggtgaaaatatctagctgg

SEQ ID NO: 164829 - DNA, 601 bp, Human
aagccctgagcccctccctgaccctggctgggggcaaatggggagaccacagacctcccctcccctgctgcactttctcctgaaattccctgtttagttttatccactgggcatacttgtaaaatttggtgtttataaaaggttctcctaagaaactcaagtctggagtccaccatcgttaggaagggtgggaatggggactattcccgtgcccccaggcttctagaaccctgtcccacctcctctcctcttttaaaggacacacacacacacacacacacacacacacacacacacacactgaccttgagcgtcgaagtcagctgaggccgaggcctggcccagggtgttggaggcctcacagatatagacaccctcatcctccagcatagccccgtggatctccagacgcagtgtgttgggggccacagccacatgcagcctgggagagctgccttcgggtccccccacaccttgtagggtggaggccacaaggcgatccccgtggagcagccgcagctgggccggagggtcactgtccacacggcacaggaggaggcccagtcgtccagggcctgtgtccatcagggtagtgagtgtg

SEQ ID NO: 164830 - DNA, 601 bp, Human
tgcccctcccgcacggtagccccgggccacacctgcacattcacagctggggagagggagggcacaggacaccagtgagggtcttgaggctgtgtacagcaggccacctgtctccatgtgggtgagctactcctactgctggggagccccttggcctttgggagccttgggtggcccacctataaatgtggcttagaagtcaagcttgggaatagcccactggctcctgagtggtcccaagtagagttccacagagtcctggaaagccctgagcccctccctgaccctggctgggggcaartggggagaccacagacctcccctcccctgctgcactttctcctgaaattccctgtttagttttatccactgggcatacttgtaaaatttggtgtttataaaaggttctcctaagaaactcaagtctggagtccaccatcgttaggaagggtgggaatggggactattcccgtgcccccaggcttctagaaccctgtcccacctcctctcctcttttaaaggacacacacacacacacacacacacacacacacacacacacactgaccttgagcgtcgaagtcagctgaggccgaggcct

SEQ ID NO: 164831 - DNA, 601 bp, Human
gccgcagctccagggacgtgttggcctggcccagagggctgcgggcagagcagctgtagaaaccctcatccctgggctgtggccctcgcagctccaggcgcagggtgttggggacagaggctgctgtcgaggaggccaagaggcgaccggcgtggctgagggccagctgggcgggcgggcggctgtccacagtgcacagtaccagggccagctgcccgccatggctctccaggaggtaggtcaggcgcaggttgcggggcgcgtctgcagggcatgagaggcttacacggagtcacaggcrgcagcctgcaggaggccagtttgcaggtggcattcaaactcaggagggccctggctccccacccctatggctcccaaccacccagtctgaggcactgctcctctgcccagacaggactcaccccagcgccccctactcttaatgctccttgcccagtgctccactagctactgggtaccgagttccccactggacacctgtcgggttccggccatgccgtgatccctgtgggcttctgtcattcctgtgagtcccaccctgcatccagccagactcacagaggacgtccaaggtgatagg

SEQ ID NO: 164832 - DNA, 601 bp, Human
tctcttccactcaccttctacctgcaaccgcccgatggtgctgattgagcccagcaagttttgggctgtgcaaacataggtgtcatcacctgcaggcacatcttgcacctgcagccgtagggcgtttcgggccacctggacatggcctgtccctgatgccaagctgtggaccccgctgctcgtggccagcaccttgccatcatgagatagggccagctcagcaggtggctcactgtccacagtgcactgtatcacagccatggatctggccctggagtcccggaaggaggacaggacagcrtcctgaggggcatctgtgggcaggcagggcacagatggggaccttgcttaggcaccctgtactgctcattgcctagctgcctggggttggtcaggctgaggcctctggaccaatggccacttcctagaagtgacaccttcccaggagtcctgtgggcagagtgctccaggcagggcttataggactgtctctttctctagcacctatgtcctctttccccaactgcccattcctgggcccactgcagtcctttgcccactcccaccagagcccagaagcaccctccaccaccctcctcct

SEQ ID NO: 164833 - DNA, 601 bp, Human
ccaggacatttgaggcagaacagatgtattccccttggtcgctgggcctcagcgcctcgatgtccaccctcagggcattgggggaagccaggacatggatgtgtggctctgcaggagcaccctggggctgactggaggccaccagtcgactgccaaggtggagagtcaggctggcgagcggctcgctgtccactcggcaatccaggatgccccggaggccaccctcaggctccacgaagaccatcatggtgggcgtcttgggagggtctgtggggaggaagggagtgtggtgattgcagamaatgaccacaaatttctccctccctgtacccatgcacagtgactttgctgctcctcccattaagaggcagaacctatttcctcactccttgaatctgtgactcagtttgaccaattgaagaaagaagtgatgttgtgcaacttcagagccagacctcaagaggccttgtagcttctgctctacttgttggaacacaacaatgtgggaagcccaggccagcctgctgggcacatgtggcccaactggcagccaggagcgtgcagtcatctgagaccactgggcaactgcagccacatgagg

SEQ ID NO: 164834 - DNA, 601 bp, Human
agaaagggacacaaatcacttcagcgtaaggtaatttgtgataaatgtcatgtaacttgcagcccctggccccctcctacagatggtgtctaagaataaaccccactaacatgtgactcctctgttctagcccagctgtttgggttgcaagaaagagactcactccagttgcgtcataggatggagttttattgggaggacattctggacgggctcccagcaagagtctggcaatggagcatgaaaatgaatgagcctggaatgagggagggtgcggcctcggctacacaaagttcacccgcccccaactgcctcccagcgtgttagctcctgtggcaactccccacttctctctctgtttttcaacccaaatcctagagcagagggctcttcgctcctcacaccatctccaccaggctgcagggggagtcactagcccactcaagagctctctcctgttggtccctgattcgcaggggcacgtcattccttcttggtaactcattctctttaacagcccgacacagggtctccaggaaaaggacaggagctcacacagtcatgaacagagatgcatctggagcaggaataaggatgctga

SEQ ID NO: 164835 - DNA, 601 bp, Human; identical to SEQ ID NO: 23963

SEQ ID NO: 164836 - DNA, 601 bp, Human; identical to SEQ ID NO: 23964

SEQ ID NO: 164837 - DNA, 601 bp, Human; identical to SEQ ID NO: 23965

SEQ ID NO: 164838 - DNA, 601 bp, Human; identical to SEQ ID NO: 23966

SEQ ID NO: 164839 - DNA, 601 bp, Human; identical to SEQ ID NO: 23967

SEQ ID NO: 164840 - DNA, 601 bp, Human; identical to SEQ ID NO: 23968

SEQ ID NO: 164841 - DNA, 601 bp, Human; identical to SEQ ID NO: 23969

SEQ ID NO: 164842 - DNA, 601 bp, Human; identical to SEQ ID NO: 23970

SEQ ID NO: 164843 - DNA, 601 bp, Human; identical to SEQ ID NO: 23971

SEQ ID NO: 164844 - DNA, 601 bp, Human; identical to SEQ ID NO: 23972

SEQ ID NO: 164845 - DNA, 601 bp, Human; identical to SEQ ID NO: 23973

SEQ ID NO: 164846 - DNA, 601 bp, Human
caggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactgtccgtggtcagcgcgaaggactttctttagatccacgtttcgcaagtgtccctgaggccgaggaagaggcgaggggcgcccccggcctcgggcgtctggggcctgcccataagkccgggtcggcgcggcggggcggggagagctgtggccgcgcgcctgctccgccgcacaatcggctgggacaaggcagggaagctgtggcgacctgcaggggttcacaagcccggaggccgatggggtttgtcagtgacaccagaggggaaaagcctcacagagcaggaacaccccccgccgccaggtgctgggtgcgccggctcggtcactagcctgccgcttccccttcttccccggtggtcagagcagccccggacccaggatcgtttctggggtaacccttgcctaggtcggggggcg

SEQ ID NO: 164847 - DNA, 601 bp, Human
gcgacctgcaggggttcacaagcccggaggccgatggggtttgtcagtgacaccagaggggaaaagcctcacagagcaggaacaccccccgccgccaggtgctgggtgcgccggctcggtcactagcctgccgcttccccttcttccccggtggtcagagcagccccggacccaggatcgtttctggggtaacccttgcctaggtcggggggcggatgccggggcttcccaggatgtggagtgtggggcagtgagaggccccccgccccgcctcttcggaaaagcctgagcagcagctccsggggcgcggaagctctgacacctgagagccggtgcaggcgaaagggcgcgaagcgcgggcgcgtcccgcttccctcttccgcccgcagggactcggcgaagtgcctgggagagggagtgcgctaggaggaggtcctgcggcccaagcctgggtgtagagaccgccccggctaaggtcaagcctcggggacctgggcgaccccgccgccctccgagccgtcgggagccggtgcaaatcgccgctgagggcccttccagctccaaggctgcggcttccaggccttccccacccccaggcccg

SEQ ID NO: 164848 - DNA, 601 bp, Human
tattgctggaggaaaagagagggtgtttggctcctgttcatctggttttcttctttctgtgctccaggataggtaaggagacctggatgccatcccctcctggactcagaattcccacacatcgctttccactaattatagagcagaatttaggttaacagacttcctttttaaacagctaatgcccatgggaaggtgaagtcgtgggtcacttataccttagtgcaaatcgttttataaatttaaactgattgctcttcccaccaccacgaccacagggagtgctagtttgatagggcarttggaacatggggagggtattgggctggtagagagcttcaaccagagcctggatgactggaggcagggagcaagggtgagtgccaaagacagagcactcacccacctgctggtctgctccagcagaagatacactgtgtatctggcatgagcaggtgtcttcaaggcttccgaatggagcttagacaaaggagggtctgaggctagtatccagccaagccctgcccagagagaggtactccctgttcagccctaggagtgaggaattatcagagggccctcctgtgacttcattaaagtc

SEQ ID NO: 164849 - DNA, 601 bp, Human
acacatcaaatcctcttctgccaggcccacctgccagccctcctcactgtttctgcacagttctaaaaggatggttcagttccctcaccctgcctaacccaaggcaagtttcctcttcactaagtccattctggtcccactatcccctaaattcttctagcaggtccctacagccattaaactcattcttttggataaaggcaaaggtggccatccagtagagaagggcccccaggcaggtctcagtgttccccagaagtcaaaactcagactgccttattgctgcacatcacttcaccaygcacaaagcactttctcaggccacatcccatttaacccccaaagggaggcaggatggtagcatcctgctggggatactttggaacctgctggggcagttggaacttggggagggaggatgggctgatagcttcagccagagattgggaggctggaggcagggcatgaggggatgtaactccccttgatttccttctgtaaaatgggaatgataccacttcacgcacttgctatgcatgtgcattcattatggctctcaaactgagtgtgggagaagggggtacaggatggtgctgctgaa

SEQ ID NO: 164850 - DNA, 601 bp, Human
ctcagctggaaggtgacacagccatgactggaaccaactactgacttcccacccagtgctctaccataacttccatctcctccccatgggaaagggctttatggtcagcagccctcttctacttaggccacctcctcagttctctctctccctcttagaactccctcttgtcagggaggtgtattcctctgggggtacaacatgtgtaactgtgctaaaaggcaagtgcctctgtggggaggcggcagacacagttgacatgagccaacctgtgtacttcagagaggacacagggctgccragttgcgggtggtaagaggagaggtccagaggatgggatgctctcaagattagctggaggctagaagagataaggggcacaccaaaaaaacaaaaacaaaaaacaaaaaacaaaaaacaaccctcgtctccttcccaggtttgtctaagttgacaggccctcaggtttgcaccttattttctttctttttcttttttttgagacggagtctcactctgctgccaggctagagtgcagtggctcgatcacagctcactgcaacctccacctcccagattcaagcgattctcctgcctcagc

SEQ ID NO: 164851 - DNA, 601 bp, Human
tccagaggatgggatgctctcaagattagctggaggctagaagagataaggggcacaccaaaaaaacaaaaacaaaaaacaaaaaacaaaaaacaaccctcgtctccttcccaggtttgtctaagttgacaggccctcaggtttgcaccttattttctttctttttcttttttttgagacggagtctcactctgctgccaggctagagtgcagtggctcgatcacagctcactgcaacctccacctcccagattcaagcgattctcctgcctcagcctcccaagtagctgggaccacaggygcatgccaccatgtccggctaatttttgtatttttagtagagacggggtttcaccatgttggctaggatggtcttgatctcttgaccttgtgatccgcccacctcagtctcccaaagtgctgggattacaggcatgagccacctcgcccagcccggcatcttattttcatggcttaagatttctaggtccagataaaaaccaagggtgccctgggccttgccagctaatgagtgcatagaatccagggatagcaagagaggcttggagagccttttctttctccagccctgttctttctc

SEQ ID NO: 164852 - DNA, 601 bp, Human
gcgattctcctgcctcagcctcccaagtagctgggaccacaggcgcatgccaccatgtccggctaatttttgtatttttagtagagacggggtttcaccatgttggctaggatggtcttgatctcttgaccttgtgatccgcccacctcagtctcccaaagtgctgggattacaggcatgagccacctcgcccagcccggcatcttattttcatggcttaagatttctaggtccagataaaaaccaagggtgccctgggccttgccagctaatgagtgcatagaatccagggatagcaagrgaggcttggagagccttttctttctccagccctgttctttctccaggccctgccaggctggccttcctgccctgggcctgtgtacaggtttgtttctgtgtatgtctgtctccctaaatgagaggaaccaaggtcctgagtgaaggaatcagtgattgagatttgttcagcttctgcctcataccatggaatgggatgggggagctgggcgcctatcatgcttaagccttatgtactactcacagcaacccagtaaggatagttatttcctcattttatagatctttttcttacagatgc

SEQ ID NO: 164853 - DNA, 601 bp, Human
tgcgccccctcatgccctggccgctgcctgcgcccccacaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaaggtgaggcaggcgcgcttcgctggcaccgccgcagccccactgcgcgctgtctttyccgatcccccgctcccgccccgcctgcccctccgccctctcccaccgcctcgccgtcccctgcaactgggaggtaccgctgctctacgctgtcctcttccccactggcgggcccggggcccctgacactcctgtcccacatccagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggact

SEQ ID NO: 164854 - DNA, 601 bp, Human; identical to SEQ ID NO: 22609

SEQ ID NO: 164855 - DNA, 601 bp, Human; identical to SEQ ID NO: 22610

SEQ ID NO: 164856 - DNA, 601 bp, Human; identical to SEQ ID NO: 22611

SEQ ID NO: 164857 - DNA, 601 bp, Human; identical to SEQ ID NO: 22612

SEQ ID NO: 164858 - DNA, 601 bp, Human; identical to SEQ ID NO: 22613

SEQ ID NO: 164859 - DNA, 601 bp, Human; identical to SEQ ID NO: 22614

SEQ ID NO: 164860 - DNA, 601 bp, Human; identical to SEQ ID NO: 22615

SEQ ID NO: 164861 - DNA, 601 bp, Human; identical to SEQ ID NO: 22616

SEQ ID NO: 164862 - DNA, 601 bp, Human; identical to SEQ ID NO: 22617

SEQ ID NO: 164863 - DNA, 601 bp, Human; identical to SEQ ID NO: 22618

SEQ ID NO: 164864 - DNA, 601 bp, Human; identical to SEQ ID NO: 22619

SEQ ID NO: 164865 - DNA, 601 bp, Human; identical to SEQ ID NO: 22620

SEQ ID NO: 164866 - DNA, 601 bp, Human; identical to SEQ ID NO: 22621

SEQ ID NO: 164867 - DNA, 601 bp, Human; identical to SEQ ID NO: 22622

SEQ ID NO: 164868 - DNA, 601 bp, Human
gtcccagggagaccccccaactatgctcaggggtcccagggagatgccagcaccccaactccgcttccctggggcccccctccccttacagctcaacttccctcgagagtctggggctggggctccgttcagttcttgagtccccttccctcggggtgtcccggggccgcccacccccacactgtctgtgattccccaaggcgcgggtctcgggccgcagcctgttccacgttctgctgctcgttcttttctggctccttgctttcgaaggagagaaggaggccttcgtttccagtctttytgccttttctaatggagccctgcttttccttccgtgtcccttcaggctacttctgccaggtttctatttttcattctttattatgactttgcccaaaatattcttgacttctattgagaaggatttgggggtctatttcttatttggaggtgtgttcttaagttccaaacagatgaggattttccagttaatccttctggggtgacttattgcttaatgccaccatagtcagaaaatggactctcagtgtccgaaactgcattcggctctgaagtgtctgtccttgtcacctcttgcaat

SEQ ID NO: 164869 - DNA, 601 bp, Human
agggtgggactgagcccttcacctgtggggtctgccctgctcaaggcagtgtcagaattgaattgaaatgttggacggtcagtgtccagagagttggagaactggtttgtgtgtaaaaactcacatatttagggtcagaagtatggtggtgtagaaataattcatactatagtcccttatttctgcctcttacacatcctgttatttttaaaattttttcatctttaaaaaatcaatttagtaatctttttctctttaatgctctcattagaatttttaaagtacttgtatgctaatgtcmacatttgagtgaactgtgggtttatttctattgttgttttattgattagcaataatttattcctaattcttacatatcctgtgatgtttttattgaacatcttgcgttgcgtacaaaatagctggaaagcttggaggtggttgtatgttactactggggatgtgtgccctctcctctctccaggagcctgtgggaaggcctggactactggcttgctcaaaggtggaggccaagtgggatgcttgcagcttcaacctgaccctggctgcctctggagccggccctgtctctaaccctaac

SEQ ID NO: 164870 - DNA, 601 bp, Human
acctgtggggtctgccctgctcaaggcagtgtcagaattgaattgaaatgttggacggtcagtgtccagagagttggagaactggtttgtgtgtaaaaactcacatatttagggtcagaagtatggtggtgtagaaataattcatactatagtcccttatttctgcctcttacacatcctgttatttttaaaattttttcatctttaaaaaatcaatttagtaatctttttctctttaatgctctcattagaatttttaaagtacttgtatgctaatgtcaacatttgagtgaactgtggrtttatttctattgttgttttattgattagcaataatttattcctaattcttacatatcctgtgatgtttttattgaacatcttgcgttgcgtacaaaatagctggaaagcttggaggtggttgtatgttactactggggatgtgtgccctctcctctctccaggagcctgtgggaaggcctggactactggcttgctcaaaggtggaggccaagtgggatgcttgcagcttcaacctgaccctggctgcctctggagccggccctgtctctaaccctaactgaagccatcttgagcggtg

SEQ ID NO: 164871 - DNA, 601 bp, Human
agaattgaattgaaatgttggacggtcagtgtccagagagttggagaactggtttgtgtgtaaaaactcacatatttagggtcagaagtatggtggtgtagaaataattcatactatagtcccttatttctgcctcttacacatcctgttatttttaaaattttttcatctttaaaaaatcaatttagtaatctttttctctttaatgctctcattagaatttttaaagtacttgtatgctaatgtcaacatttgagtgaactgtgggtttatttctattgttgttttattgattagcaayaatttattcctaattcttacatatcctgtgatgtttttattgaacatcttgcgttgcgtacaaaatagctggaaagcttggaggtggttgtatgttactactggggatgtgtgccctctcctctctccaggagcctgtgggaaggcctggactactggcttgctcaaaggtggaggccaagtgggatgcttgcagcttcaacctgaccctggctgcctctggagccggccctgtctctaaccctaactgaagccatcttgagcggtgcccttccccttctcctacagagtgtggcttgtc

SEQ ID NO: 164872 - DNA, 601 bp, Human
ctggcgctggacttggtacacagggtggggcaaagtgggtactggatcctgatcatccctatccctggggtgtggcttcttgctgcacagtcagcttctagttctgtagccccagctgctcctgcggtggagggagctacacatcaggctctgaccccctccaggtggggccttcgcgtgaggggagtcagcacgcatcagcagctgggcccagggagttgccccactgagcactgcgggctgacctgctcccaaccagggagatggagcttcccccttgagtcgggctgctgaagggggrtaggggatggagacagtgcgtttgcaggagtaagggtgcagttgggtccctgcgagaaaatgtctcagttgtggcaactgattggtgacctggggggcgtttctgagcccacagtgctggcatcaggactcaggtgtgaggtgccccagaccctccccttgccagtaattagctgatggctcggtgatgcccagggtgaaggaagacttgattttgggaggggagttctctcgtaatgacactgaggatgccttcaagttgggcttctggcatgttctgccctcgctccccttctgtagt

SEQ ID NO: 164873 - DNA, 601 bp, Human
catcaggctctgaccccctccaggtggggccttcgcgtgaggggagtcagcacgcatcagcagctgggcccagggagttgccccactgagcactgcgggctgacctgctcccaaccagggagatggagcttcccccttgagtcgggctgctgaagggggataggggatggagacagtgcgtttgcaggagtaagggtgcagttgggtccctgcgagaaaatgtctcagttgtggcaactgattggtgacctggggggcgtttctgagcccacagtgctggcatcaggactcaggtgtgagrtgccccagaccctccccttgccagtaattagctgatggctcggtgatgcccagggtgaaggaagacttgattttgggaggggagttctctcgtaatgacactgaggatgccttcaagttgggcttctggcatgttctgccctcgctccccttctgtagtcaccttggccctcgtgttgctgagctgtgtgtgggagcgggaagcgcgtcagtgggcggagggagcgggaagcgcgtcagtgggcggagtatttgagaacatttcacaagccgctgttgaggttcagaatcaaccagcaga

SEQ ID NO: 164874 - DNA, 601 bp, Human
cttcctgccatcatttgaagcatgtgtttgctaccccttctgctgtcattgtaagtttcctgaggcctccccagccacgcggaactgtgagtcagttaaacctctttcctttataaattgcccagtctcgggcagttctttatagcagcgtgagaagagactcatacacacctcttcttcagaccaactgctgatttgggacatgggcaggaggctgagaatctgggctttgtctccacagtggccactgctggggaccttgatggcatggttttgtcatgttgggattactgcctctaartgaggctgagaactatctttcccataactccctcgtggggtaatagttggcaaaaagaggaacttgagtgagattcgcaaggtatgggtgaagcagagatcactcttctggaaggtcacgatggtttagtgaagtgaaggacactggtggactccaatctgtcctccttcatgtccaccccatcttctccacttttgagcctttgactgaaagcaattctaagactccagcaggcatttggccactggcctgcctaggtgatgggtactccagtggcgcagtttaaatgtctctgcaaga

SEQ ID NO: 164875 - DNA, 601 bp, Human
tcatacacacctcttcttcagaccaactgctgatttgggacatgggcaggaggctgagaatctgggctttgtctccacagtggccactgctggggaccttgatggcatggttttgtcatgttgggattactgcctctaaatgaggctgagaactatctttcccataactccctcgtggggtaatagttggcaaaaagaggaacttgagtgagattcgcaaggtatgggtgaagcagagatcactcttctggaaggtcacgatggtttagtgaagtgaaggacactggtggactccaatctrtcctccttcatgtccaccccatcttctccacttttgagcctttgactgaaagcaattctaagactccagcaggcatttggccactggcctgcctaggtgatgggtactccagtggcgcagtttaaatgtctctgcaagagactcctctgcacagccttacttgagaggataacggtgcatggcctttgatattgccctgcagagttgggctgttccagcctgccccagtgtaagtgacctagctctggactgttgttcctctgatcttcagccttacctgactgacttcctttcttggct

SEQ ID NO: 164876 - DNA, 601 bp, Human
acattagaagagaaataattcagaaaaagccacatacttctggtttcttgatctctgacaaagttgaccctgcagtgcagtaggtaaagacacttctctgcgctgagcagtagtggatatgttagatatttatacacaatatctgcaccatataaaagaagcagtttcaggtggtttgtagatctcaatgtaaatattaaaccaataaagtttttagagaaaaatgtaaaatgctgtatttatgacttttaggaattaagaatttaaaaaatcgaacaaaatagtgctagtcacataagamtgaaattgataggttgaattacctttaacttcaaaacttctgttcctaagaagatacctgtgaaatagtataaccgcaagccacggatgaggagaaagcatttcaaaacatgtatttactaaagtacttgtgttcataatataatgaacttattcctatgaattaataaaaaactgatcaatggaaatttaaacaaaaggtttaaagggaatttgccagaaaatggtgtctgaatgtgtaacatacataagaaaagttgttcactgtcgttcttcttgaaagaaatgcagcttaaaacca

SEQ ID NO: 164877 - DNA, 601 bp, Human
ggtgtctgaatgtgtaacatacataagaaaagttgttcactgtcgttcttcttgaaagaaatgcagcttaaaaccacaacacaataacaccacaggaaatgactcagtatcctaaagtgatcataccaagtgttgtcagggttctgaactgtgcacaatccctcagactatagataagttcaacccagtgtagaaaactcttcgatgttgtcggctaaagctgcgtatcaaacactgagactcagcgcttctactcctaggtacatagctaattataaaaaagcttatacaggctcacctyaaggcaaatacaagacaagagtattcattgcagcactatttggagtagacaaaaaccagaaacaacctcaatgtccatcaacaataaattgtggtatgttcaccaatgtaatgctatgcaattttgagaatgaacaatatacaacagtgtgcaacaatagggataaatttcataaacacagattagagcaaaagaagccatccacaaaagcagatgtaatgtataatttcatttcataaagttcaaaaccaaacagaactaacctataggtttagaagcccatacatttcctgtctttgg

SEQ ID NO: 164878 - DNA, 601 bp, Human
caaagattatcttgtccagttgctcttttttttttggaaatggagtctcgctctgtcacccaggctggagtgcagtggcacaatctccgctcactgcaagctccgcctcccaggttcactccattctcctgcctcagcctcccgaggactacaggtgcccaccaccacgcccggctaattttttctatttttagtagagacggggtttcaccgtgttagccaggatggtctcaatctcctgaccttgtgatctgcccgccttggcctcccaaagtgctgggattacaggcgtgagccaccrcacccggccccagttgctgttttagtgctaaatttctttttcttttttttttttttttttaacttaaagcaatctatctattcatctaattttttgagagaaggtctcaccccgtttcccaggctggagtgcagtggcacgatctctgcaacctccgcctcccggattcaagtgattctccagcctcagcctttctagtagctgggattacaggtgtgcaccgccgtgcccagctaatttacatatttttttcttttttttttttttgagatagagtcttgctctgtcacccaggctgga

SEQ ID NO: 164879 - DNA, 601 bp, Human
acagtcagtgatttttgccagtgcctgtagttcattctagtcagcagtattagtttttgttgttgttttttgttttttttttttggagacggagtcttgctctgtcgctaggctggagtacagtggcacaatctcggctcagtgcaacctctgcctcccgaattcaagccattcccctgcctcagcctcctgagtagctgggactacaggagccacggcgagctaattttttgtattttagtagagatagggtttcaccatgttggccaggatggtctcaatctcctgacctcgtgatccrcccgcctcggcctcccaaagtcctgggattacaggtgtgagccaccgcgtctggccaggattagtttttatttgcagtgtatatattgaacataatataaaaattgttcatttctgtgccatgtgctatataaatgtatttgtttttgattttttggcacaggatcagaaatatatgcttgtttttttttgtttttgtttttagacagagtctcactccgttacctaggctggagtgcagtggtgtgattttggctcactgcagcctccacttcccaggttcaagcaattgtcatgcctc

SEQ ID NO: 164880 - DNA, 601 bp, Human
aggctgaggcaggaaaatggtgtgaacccgggaggcgcaggttgcagtgagccgagatcgcgtcactgcactccaacctgggtgacagagtgagactccatctcaaaaaaaaaaaaaaataatagtaattgtcatttcatgtttatttgtctgttctccctgattactgggggtgtgttaatggaagggcatgttatcctcccccatttgtttagactgaggaaggatagtagggagcattgtgagctataaagacagtttctctttggttgagcaatggtgtgttggtgattacaggtcrtcattataaataaaatgaattttgttttcaagagacagggtctagctgtgttgcccaagctggtctcgaattcctgggcttaagtgatccacccacctaggcctcccaaaatgctgggattacaggcatgtgccactgtgcccggccaccttacgtttaaagaggagaaattcatggtcctttcaaagttactgaagtttaacaatgaacaaattggatttctcataacacttttggaatgtacattttgggatatatagatatatatggaatgtacatatttagctttaacttttcaaa

SEQ ID NO: 164881 - DNA, 601 bp, Human
tccttaaaacatgctgtagcctctgggcttttgcatctgcagggccctctccagtcctactgactcctaagcatccctgacaatgaatccttcaggccttcgtttggacatttcgtccagaactctatcttgaccccatcattctggctcttactgtgtattaagaccctagtctgagctccaggaattgcttatacaccatatcctagatgcttatagtgtctggcacaaagttggcactcagtaaatactgttgaactggaccgagaagagatagagaaggctatttttatttaaattwcttttctttttttttttttttttttgagatggaggcttgctctgttgcccaggctggagtgcagcggcgccatctccactcactgcgagctccacctcccgggttcaggccattctcctgcttcagcctcccgagtagctgggactacaggcacctgcaaccatgcccggctaattttttgtatttttagtagagacggggtttcaccgtgttagccaggatgatctcgatctcctgacctcatgatccacccgcctcggcctcccaaagtgctgggattacaggcttgagccactgcgc

SEQ ID NO: 164882 - DNA, 601 bp, Human; identical to SEQ ID NO: 26504

SEQ ID NO: 164883 - DNA, 601 bp, Human; identical to SEQ ID NO: 26505

SEQ ID NO: 164884 - DNA, 601 bp, Human; identical to SEQ ID NO: 26506

SEQ ID NO: 164885 - DNA, 601 bp, Human; identical to SEQ ID NO: 26507

SEQ ID NO: 164886 - DNA, 601 bp, Human; identical to SEQ ID NO: 26508

SEQ ID NO: 164887 - DNA, 601 bp, Human
ccctagacgccggaacgtccctaattcaacatctctccacaattcacttttagcctcctggaaatccccccatgactctccttagacttccaagagaaccccaaaagctcttttaagagctatcctcattaattccctcacgtcttccaacctcccccatgcaggtccctcaccgagtcctggctgctgcaggacacgacatggcggaggcggatctccggcatgtcaacgtcgtgggcttcgcctggccagaaggatgaggtagagtatggggtccgaggggcagggagagtgggagggrgcggggtgcgccctgcgctggctaaagtgcgcaagcgcgcgaggctcgggcctttcaaaccccggcgcgccggcgccggcgtcgacactgcgcaagcccagtcgcgcctctccagagcgggaagagcgctgcgttccttagcaacgagcgtttcctccagccccgcctccctccgccacacacaaccccgctctagcctcgcctcccaatgacgtccgaaccctgctttctgggagcctagcaacagaagcgacctccgggattggtgtctggaagaaattcgcctttctcattgcacga

SEQ ID NO: 164888 - DNA, 601 bp, Human
tttttatattttgggggtctcactctggtgcccaggctggagtgcagtggcacaatctcagctcactgcagcctccatctcctgggctcaagcaattctctcacctcagactcgccagtagctgggattgcaggtgcacaccaccatactcagctaatctataaaattttggtagagatgacatcttactgtattgcccaggctggtctcaaactcctgggctcatgcaagactccagcttcggcctcccaaagtgatgggattacaggtgtgaaccaccatacctggctattattctttwaaaaaaattatttattttaataaaaatagagacagggtcttgatatgttgcccaggctggtctggaactcctgagctcaagcaatcctcccatctcaggctctgaaagtgctgggtttacaggcatgagccacggcatccggccagtttccccttctttaaagtggagttgattggcttagacgaccttcctggacaccttccagccctgagcccactggctgcaggaggcagagtacgtggcaatgattcattttgttccagctgaggaaactggaacccagaaagtagatgccacctg

SEQ ID NO: 164889 - DNA, 601 bp, Human
ccctggtagctgggactacaggcatacgccaccaagcccagctattttttatattttttcgtagagatagggtttccccatgttacccaggctggtctcaaactcctgggttcaagcgattcacccacctcgacctcccaacatgaaaactgagacttataccaacaagcattcttataagagtttgtgggatggctgctttggctgcagtttgggaggattcaggtctcttccatgagattccacagttttctgggattagcagtaacctggcaaatgttctcatggcatattatgggarcacaaaagccaagtgcatttaaggcccttgctgaagttagatgtgctgaaattccattaagtaaatcatatggtcaaactcatcaatggagcagggaaatatactccccctccagtgggagggagaggagtggatatttgctgaatgactgcccattcacaaaaggttaatttttccgtcaccctagcactatccacagagtgttctgctccttatagtcataaagcagcccccaggccaggaacaatggttcatgcctgtcatccgagcactttgggaggctgaagcaggaggaacgct

SEQ ID NO: 164890 - DNA, 601 bp, Human
ttttttttttttttgagatacagtctcactctgtctcacaggccggagtgcagtgaaaccatcacagttcactgcagcttcaaccttatgggctcaatcaatcctccccgctcagcctccctggtagctgggactacaggcatacgccaccaagcccagctattttttatattttttcgtagagatagggtttccccatgttacccaggctggtctcaaactcctgggttcaagcgattcacccacctcgacctcccaacatgaaaactgagacttataccaacaagcattcttataagartttgtgggatggctgctttggctgcagtttgggaggattcaggtctcttccatgagattccacagttttctgggattagcagtaacctggcaaatgttctcatggcatattatgggagcacaaaagccaagtgcatttaaggcccttgctgaagttagatgtgctgaaattccattaagtaaatcatatggtcaaactcatcaatggagcagggaaatatactccccctccagtgggagggagaggagtggatatttgctgaatgactgcccattcacaaaaggttaatttttccgtcac

SEQ ID NO: 164891 - DNA, 601 bp, Human
acagacaacagagcctgctgtggctactgcaaacaaccaggtgtgtggggctgtcataagcagatggctaagccccatgtggtaagatcgagatgttgcataacaataattagaggagaaaatgcagggtagtagaagaacccacagatgtggccaggtgcagtggctcatgcctgtaatgccagcactttgggaggccaagacaggaggactgcttgagctcaggagtccgagaccaggctgggcaacatagtgagaccccatctctacgaaaaatttttaaaattagctgggcctggcrgcacacgcctgtagtcccagctatctgggaggctgaggtgggaggattgcctgagcccaggaggttgaggctacagtgagccatgactttgcaactgcactccaacctgggcaagagagtgagaccctgtctcaaaacataacataacaacccagagataagcctactgccttggtggccagaaatgtctgccttatcagttacgtcaaaagaatcaaaattagcatttgatgaatccagagtaaccccacaaattagtcattgccagatgcaatcagtcattccaaagggtctctgacg

SEQ ID NO: 164892 - DNA, 601 bp, Human
agacaccacagtggcgaactgagtgattagaaaaccaataacaatcaaaaatgaccataggccctattgctgatgaacatttcttctaaaaatgacacacctccagtgacacaccagagttatatctgggtcttgtccaagccacccctccagcccaggagtagttagcaaagaggttggcatttccctctgggagcaggtgatgaacagacaacagagcctgctgtggctactgcaaacaaccaggtgtgtggggctgtcataagcagatggctaagccccatgtggtaagatcgagatkttgcataacaataattagaggagaaaatgcagggtagtagaagaacccacagatgtggccaggtgcagtggctcatgcctgtaatgccagcactttgggaggccaagacaggaggactgcttgagctcaggagtccgagaccaggctgggcaacatagtgagaccccatctctacgaaaaatttttaaaattagctgggcctggcggcacacgcctgtagtcccagctatctgggaggctgaggtgggaggattgcctgagcccaggaggttgaggctacagtgagccatgactttgcaa

SEQ ID NO: 164893 - DNA, 601 bp, Human
caacaagacgaaactccgtctcagaaaaaaaaaaaatcacaataaatcatctacagctacactgaacgacatagatgaaatgaacaaacataacaagggaagccagataagaaaagtttataccacacgattccattttatatgcaattcaaaatcaggcaaaatgaatctatgctgttaacaatcaggacagtggttacccttgcaggggtactgacagaaagaacctgagggaactgctgggggctaggcatgttctgtgctgcatctgggtgtggagtacacagggctgcagtttgcraagagtcactgagctgtactcttacttacaccttcacttcactctatgtatgttacacatcaaaaaacagtaaaaacaaatttaagacaccacagtggcgaactgagtgattagaaaaccaataacaatcaaaaatgaccataggccctattgctgatgaacatttcttctaaaaatgacacacctccagtgacacaccagagttatatctgggtcttgtccaagccacccctccagcccaggagtagttagcaaagaggttggcatttccctctgggagcaggtgatgaacagacaaca

SEQ ID NO: 164894 - DNA, 601 bp, Human
gcctgaccaacatggtgaaaacctgtctctactaaatacaaaaaattagccaggcgtggtggtgcatgcctgtaatcccagctacttgggaggctgaggcaagagaaccacttgaacctgggaggcggaggttgcagtgagctgagattgtgccattgcactccagccagaacaacaagacgaaactccgtctcagaaaaaaaaaaaatcacaataaatcatctacagctacactgaacgacatagatgaaatgaacaaacataacaagggaagccagataagaaaagtttataccacacrattccattttatatgcaattcaaaatcaggcaaaatgaatctatgctgttaacaatcaggacagtggttacccttgcaggggtactgacagaaagaacctgagggaactgctgggggctaggcatgttctgtgctgcatctgggtgtggagtacacagggctgcagtttgcaaagagtcactgagctgtactcttacttacaccttcacttcactctatgtatgttacacatcaaaaaacagtaaaaacaaatttaagacaccacagtggcgaactgagtgattagaaaaccaataacaa

SEQ ID NO: 164895 - DNA, 601 bp, Human
gcacatgcctgtagtcccaactactgaggaggctgaggtgggaggatcgcttgagcccgggaggtcgagcctgtagtgagctgagatggtgccactgcactccagcctgggcaacatagtgagaccctgtctcaaaaaaaaaaaaaaaaagacaataggagtcgagcacagtggctcatgcctgtaatcccagcactttgggaggccaaggcaggtggatcactagaggtcaggagttcgagaccagcctgaccaacatggtgaaaacctgtctctactaaatacaaaaaattagccaggygtggtggtgcatgcctgtaatcccagctacttgggaggctgaggcaagagaaccacttgaacctgggaggcggaggttgcagtgagctgagattgtgccattgcactccagccagaacaacaagacgaaactccgtctcagaaaaaaaaaaaatcacaataaatcatctacagctacactgaacgacatagatgaaatgaacaaacataacaagggaagccagataagaaaagtttataccacacgattccattttatatgcaattcaaaatcaggcaaaatgaatctatgctgttaaca

SEQ ID NO: 164896 - DNA, 601 bp, Human
tttttagtgtatacccttttgcaccttttgaattttgcactatatgcatataatacccattcagaaagcaaatataataaaaccccaatggccaggtctttgtggctctgtctgtaatccctgtaatcccagctactcaggaagctgcctccaaaaagcttaaaaaaaaaaaaaaaaattagttgggtgtggtggtgtgcacctatagtcctagctactcaggaggccaagttgggggatcacctgagatcaacagttcaagaccagccttggcaacatagtgagactccgtttaaaaaaraaaatcaaatataaataaataaaaccataatagttatctcaatacaacagaatactatacagaaatgacaataggccaggtgcagtggctcatgtctgtaatcccaaggatttaagaagctgaggcaggaggaatgcttgagtccaggagttcaagaccagcctagacaacacagtgagacccccatctctgcaaaaaaaatacaaaaattagactggtgaactggcacatgcctgtagtcccaactactgaggaggctgaggtgggaggatcgcttgagcccgggaggtcgagcctgta

SEQ ID NO: 164897 - DNA, 601 bp, Human
gaatgacccaggaagaccacccaaaaaaactgctaatggtggttgcatcaggagagaagaatgagggagcaggagttggggagggagcaggagttggggagggagcagggagggatggaaagggtgaggggagattttctttttagtgtatacccttttgcaccttttgaattttgcactatatgcatataatacccattcagaaagcaaatataataaaaccccaatggccaggtctttgtggctctgtctgtaatccctgtaatcccagctactcaggaagctgcctccaaaaagcttaaaaaaaaaaaaaaaaattagttgggtgtggtggtgtgcacctatagtcctagctactcaggaggccaagttgggggatcacctgagatcaacagttcaagaccagccttggcaacatagtgagactccgtttaaaaaaaaaaatcaaatataaataaataaaaccataatagttatctcaatacaacagaatactatacagaaatgacaataggccaggtgcagtggctcatgtctgtaatcccaaggatttaagaagctgaggcaggaggaatgcttgagtccaggagttcaagaccag

SEQ ID NO: 164898 - DNA, 601 bp, Human
tcaccgatggcctgggttcgtgtgcatgcagctttctcagggagacacagttctgatatgaactgttcctgaaacaaacatggcacaggaaggcaaagttcctgagatatattgctaaaaaactgtttcacatccatgaaatgcaatcttttcttttttttttttttttgagacagagtcttgctctgtcacccaggctagagtacagtggcacgatctcggctctctgcaacctccgcctcccgggttcaaacaattctcctgcctcagcctcccaggtagctgggattacaggtgcccrccactgcacctggctaatttttatatttttagtagagacagggttccaccatcttggccaggctggtcttgaacacctgacctcgtgatccacctgcctcagcctcccaaagtgctgggattacaggcgtgagccaccgcgcccggccatgaaatgcaattgtatgcatcatttaaaagaataaggtaggctgcgcacggcgtggctgacgcctgtaatcccaacactttgggaggccaaggcaggaggatcacttgaggtcaggaattcaagaccagcctggctaacatggggaaaccc

SEQ ID NO: 164899 - DNA, 601 bp, Human
cttggcctcccaaagtgctgggattacaggtgtgagctaccgcatctggctgaaatgtgcactttaaatggttaaaacagtaaattttatgtgaatttttctcaaaataagagatgagtgctcagtatgtatcagctgtgaggataagagcacaagatgactatcaccgatggcctgggttcgtgtgcatgcagctttctcagggagacacagttctgatatgaactgttcctgaaacaaacatggcacaggaaggcaaagttcctgagatatattgctaaaaaactgtttcacatccatkaaatgcaatcttttcttttttttttttttttgagacagagtcttgctctgtcacccaggctagagtacagtggcacgatctcggctctctgcaacctccgcctcccgggttcaaacaattctcctgcctcagcctcccaggtagctgggattacaggtgcccaccactgcacctggctaatttttatatttttagtagagacagggttccaccatcttggccaggctggtcttgaacacctgacctcgtgatccacctgcctcagcctcccaaagtgctgggattacaggcgtgagccac

SEQ ID NO: 164900 - DNA, 601 bp, Human
atccacccgccttggcctcccaaagtgctgggattacaggtgtgagctaccgcatctggctgaaatgtgcactttaaatggttaaaacagtaaattttatgtgaatttttctcaaaataagagatgagtgctcagtatgtatcagctgtgaggataagagcacaagatgactatcaccgatggcctgggttcgtgtgcatgcagctttctcagggagacacagttctgatatgaactgttcctgaaacaaacatggcacaggaaggcaaagttcctgagatatattgctaaaaaactgttycacatccatgaaatgcaatcttttcttttttttttttttttgagacagagtcttgctctgtcacccaggctagagtacagtggcacgatctcggctctctgcaacctccgcctcccgggttcaaacaattctcctgcctcagcctcccaggtagctgggattacaggtgcccaccactgcacctggctaatttttatatttttagtagagacagggttccaccatcttggccaggctggtcttgaacacctgacctcgtgatccacctgcctcagcctcccaaagtgctgggattacagg

SEQ ID NO: 164901 - DNA, 601 bp, Human
atttatggaatatcatccagttatttaaaaaactgaagttgtgatatatgctacaacatggatgaacctcagaaacattatgcaaagtgtaacaaggttaagtgtaaaagaccacgtatacatttataagtccagaatacgcaaatccagagaagcagaaagtagatcagtggttgccaagggcaacattggggagagaataagaagtgactgtttaatggttatgtggtttctttttggagtgatgaaaatattctgaattagagaatggagatggttgaagaacattgtcaatatgctaaaaaaaaaaaaaaaaccctgaaatgtgcactttatttatttatttatttatgttttttgttgagacggagtctcactctgttgcccaggctggagtgcagtggtgcaatctcagctcactgcaaactctgccttccagttcaagtgattctcttgcctcagcctcccgaatagctgggactacaggcacgcaccaccacccccggctaatttttgtattttcagtagagatggggtttcaccatgttggccagcctagtctcgaatccctgacctcaagcaatccacccgccttggcctc

SEQ ID NO: 164902 - DNA, 601 bp, Human
agcagaggttgcagtgagccgagattgcaccactgcattccagcctgggcaacagagcaagactcaatctcaaaaaaaaaaaaaaaaaaaggtttatatatacatggtaacaacccaataaatgtccatcagttgatgaatagataaacattgtacagtatatttatggaatatcatccagttatttaaaaaactgaagttgtgatatatgctacaacatggatgaacctcagaaacattatgcaaagtgtaacaaggttaagtgtaaaagaccacgtatacatttataagtccagaatamgcaaatccagagaagcagaaagtagatcagtggttgccaagggcaacattggggagagaataagaagtgactgtttaatggttatgtggtttctttttggagtgatgaaaatattctgaattagagaatggagatggttgaagaacattgtcaatatgctaaaaaaaaaaaaaaaaccctgaaatgtgcactttatttatttatttatttatgttttttgttgagacggagtctcactctgttgcccaggctggagtgcagtggtgcaatctcagctcactgcaaactctgccttccagt

SEQ ID NO: 164903 - DNA, 601 bp, Human
gagaccagcctggccaacatagcaaaaccctgtctctaccaaaaataaaaaaagttagctgggtgtggtgacacgcacctcaataatcccagctactcaggaggctaaggcacaagaattacttgaacctgggaggtggaggttgcagtgagttgagacgagccactacaccccagcctgggtgataaagtgagactctgtctcaagagagaaaacaacaggctgggcacagtggctcacacctgtaatctcagcactttgggaggccaaggcaggcagatcacttgaggccaggagttcragaccagcatgaccaatatggtgaaaccctgtctctactaaaaatataaaaattagccagacttggtggcgtgcacctgtaatcccagctacacaggaggctgaggccagagaatcacttgaacctgggaggcagaagttgcagcgaaccgaaatcatgccactgcactccagcctgggtgacagagtgagactccatctaaaaaaaaaaaaaagtggccaggcacggtggctcaggcctgtaatcctagcacttcgggaggcagaggttggcagatcacaaggtcaggagagttcaaga

SEQ ID NO: 164904 - DNA, 601 bp, Human
cccaccagataatccagggcactctccccatctcaagatccttaatttaatcaaacccacagagctcctttggccattaaaatatttccaggttctggggatgaggacatgaacatcttttgagcaccactgttctgtccaccacacttggctaagcatgggccgggcatcactgaagcctcaaaaccactttaaatagaagggtctgttacgactccagtttcacagatggggaaactgaggctcagacaggtttaatcaatagcttacatggcacacaagctaataactagcagagtayttcggacgcaactgcctgactgcaaagcactgtccaataccaccactgttctcaactcctttctttccatccctgagtcaaactcaacatctttacctctcccacaatattcagcatagctcctaaatgtggtaggatggagatgcttgtattttaaatgaacaattcctactgcataaataactatttctactttaaacaggcactccctgacatttcttctttgtatataaaaaaagtcctggctaggagcactggctcacgcctgtaatcccagcaccgtgggaggtggaggcggga

SEQ ID NO: 164905 - DNA, 601 bp, Human
acacaaatttggccaggcgcagtggctcacgcctgtaatcccagaactttgggagactgaggcaggcggatcacctgaggtagggagttcgagaccagcctgaccaaaatgcagaaactccgtctctactaaaaatacaaaattagccaggcgtggtggcgcatgcctgtaatcccagctactcaggaggctgaggcaggagaattgcttaaaccgggggggcggaggttgcagtgagccgagatcacaccactgcactccagcctgggcaagaagagcgaaactccgtctcaaaaaaacaaaaaaaaaacacacaaatttaatatcttacagatctggaggtcaaaagtctgaaactcggccttacagggctaaaatctagatgcggcagggctgcattccttccttccgggagcactagaggagaacgtgtctccttgcatcttcggcttctcgaggccacctgccttccttggctcacagtcccttcctcgtcttcaaagctgctgaaagcgctggcatcactccaggctctgcttgcatcttcacagctctggttccagctctcttgcctccctctttcccttataaggcctctggg

SEQ ID NO: 164906 - DNA, 601 bp, Human
acaggcgcccagcaaccgtttgcagaagttactactcaagagttattaagcagtaactctggctctgtcctcccttaccaagtggccctgttgagccccttctctgctgcttgcctgggtgtcccatctgtcacaagaggatcatcatggctaacattttcggattctcaccatgtgccaggtgcttggtgtatgagtttcctgttactgttgtacaaattagcacaaactttgtggctaaaaacacaaatttggccaggcgcagtggctcacgcctgtaatcccagaactttgggagacygaggcaggcggatcacctgaggtagggagttcgagaccagcctgaccaaaatgcagaaactccgtctctactaaaaatacaaaattagccaggcgtggtggcgcatgcctgtaatcccagctactcaggaggctgaggcaggagaattgcttaaaccgggggggcggaggttgcagtgagccgagatcacaccactgcactccagcctgggcaagaagagcgaaactccgtctcaaaaaaacaaaaaaaaaacacacaaatttaatatcttacagatctggaggtcaaaagtctgaaact

SEQ ID NO: 164907 - DNA, 601 bp, Human
tgagaaataacataccaagtgcctggaatactgcctggcaccgagcaaacactacataaatgtcagctgcgaatatcattaacacagcaggcctctactgcattcccaatggatgtacagacagacacagaacaggcgcccagcaaccgtttgcagaagttactactcaagagttattaagcagtaactctggctctgtcctcccttaccaagtggccctgttgagccccttctctgctgcttgcctgggtgtcccatctgtcacaagaggatcatcatggctaacattttcggattctcmccatgtgccaggtgcttggtgtatgagtttcctgttactgttgtacaaattagcacaaactttgtggctaaaaacacaaatttggccaggcgcagtggctcacgcctgtaatcccagaactttgggagactgaggcaggcggatcacctgaggtagggagttcgagaccagcctgaccaaaatgcagaaactccgtctctactaaaaatacaaaattagccaggcgtggtggcgcatgcctgtaatcccagctactcaggaggctgaggcaggagaattgcttaaaccgggggggcggag

SEQ ID NO: 164908 - DNA, 601 bp, Human
aaggccaagaacagtgtctggtccttcccagctctgctgatttcctgctgtgtgatcctggagcaaatggtttcatttcaccccttgtgccttagttttcgaacctatgaaatggggacaataacaacgtctatctcataaagttgttgagaacattcaaatccataccaagaatgagaaataacataccaagtgcctggaatactgcctggcaccgagcaaacactacataaatgtcagctgcgaatatcattaacacagcaggcctctactgcattcccaatggatgtacagacagacrcagaacaggcgcccagcaaccgtttgcagaagttactactcaagagttattaagcagtaactctggctctgtcctcccttaccaagtggccctgttgagccccttctctgctgcttgcctgggtgtcccatctgtcacaagaggatcatcatggctaacattttcggattctcaccatgtgccaggtgcttggtgtatgagtttcctgttactgttgtacaaattagcacaaactttgtggctaaaaacacaaatttggccaggcgcagtggctcacgcctgtaatcccagaactttggg

SEQ ID NO: 164909 - DNA, 601 bp, Human
tcagaccataagtaacctacctcgccccctacctggtgccactctctatctccctacccgactttacttttcttcatgattactgcctggtgttacacagttacatcttttttgtttgtatttgtctagcatctgtctctcccgccagacttttaagctccacaagagcaaggacagtatcgtctgagttgttccctactgtgtccccaaggccaagaacagtgtctggtccttcccagctctgctgatttcctgctgtgtgatcctggagcaaatggtttcatttcaccccttgtgcctyagttttcgaacctatgaaatggggacaataacaacgtctatctcataaagttgttgagaacattcaaatccataccaagaatgagaaataacataccaagtgcctggaatactgcctggcaccgagcaaacactacataaatgtcagctgcgaatatcattaacacagcaggcctctactgcattcccaatggatgtacagacagacacagaacaggcgcccagcaaccgtttgcagaagttactactcaagagttattaagcagtaactctggctctgtcctcccttaccaagtggccc

SEQ ID NO: 164910 - DNA, 601 bp, Human
gctgggagttcaagaccagcctgggcaacatagccagaccttgtctctacaaaaattacaaaaattagcaaggcatggtggcacatacctgtggtcccagctactcaggaggctgaggaaggaggatcgcgtgagcctggggaggtcaaggctgcagtgagtcatgttcgcatcactgtactctgggcgacagagtgatgagaccttgtcttcaaaaaaaaacttaccctccctctgaaggaagttgagatgacacagaattaacaactataaccacaactgcggccaacatccgagtgcrctgagcgctcctggtgtgccagactcctgctaataatacatgtatctactctcctgcaatggctctgccaggcagttgctataattatctccatcttacacatgagcaaacggaggcaggaagtggttatgtaacttcacagctggtgggtggcaaagccggaccggaacccaggcaggctggcaacagtccacgcgtgctcctccatcacaccactgacgtgctagaggaggaagatggtgctggaggaagggcctgcctaaggctgaggccggcagacctcctgctgactcccctgcc

SEQ ID NO: 164911 - DNA, 601 bp, Human
atgctccaatctgctctgttgcctccctgtcagatcatctagacatcacctgcacactgctatcaacaggaacaccactgtatggaaggagggagcctggacttggggtgaggtaggcctgggctcaaatacagcaatgccatttccaacctgcacaaccttgggtgacgtattcaacgtctctgtgaggcagtttcctcacatgcaaaaagggaagatggtcataacaaccctccctccttggccaggcgcagtggctcacgtctctataaccagcactttgggaggctggggtgggagratcacttgaggctgggagttcaagaccagcctgggcaacatagccagaccttgtctctacaaaaattacaaaaattagcaaggcatggtggcacatacctgtggtcccagctactcaggaggctgaggaaggaggatcgcgtgagcctggggaggtcaaggctgcagtgagtcatgttcgcatcactgtactctgggcgacagagtgatgagaccttgtcttcaaaaaaaaacttaccctccctctgaaggaagttgagatgacacagaattaacaactataaccacaactgcggccaac

SEQ ID NO: 164912 - DNA, 601 bp, Human
cacaaaaaaaaaaaaaaaaaaaaccaaggtacctagtccaccctacactgccctctcccacccctggtgatgacagatgctccaatctgctctgttgcctccctgtcagatcatctagacatcacctgcacactgctatcaacaggaacaccactgtatggaaggagggagcctggacttggggtgaggtaggcctgggctcaaatacagcaatgccatttccaacctgcacaaccttgggtgacgtattcaacgtctctgtgaggcagtttcctcacatgcaaaaagggaagatggtcataacaaccctccctccttggccaggcgcagtggctcacgtctctataaccagcactttgggaggctggggtgggaggatcacttgaggctgggagttcaagaccagcctgggcaacatagccagaccttgtctctacaaaaattacaaaaattagcaaggcatggtggcacatacctgtggtcccagctactcaggaggctgaggaaggaggatcgcgtgagcctggggaggtcaaggctgcagtgagtcatgttcgcatcactgtactctgggcgacagagtgatgagaccttgtcttca

SEQ ID NO: 164913 - DNA, 601 bp, Human
cagctgaactgcccaccagcacctccacgaaagctgagccatcattcccaatgtccacactgtgtatctgctcctccttctccaactgtgggcagagagagaggccactgtcagtgcctgctctgcctctgggctcactgtgggacctcaggatgaatctcctttggatcaccatgtccctgtaatgtcaattctgtgagggggcacaccagggttgaatggtgccatgtgtcccctccatgcagcacagggtatggcatggagcagaaactcacaaaatagtcactgaatgaatgcataygcgcccacctcacacatacctgcttccctgacctctccagactccaccaggtcagcttatcacacactgccatagagctctccttgataagcacttgccagagttataactttattcaaatcatcatgcagacaaacagcacatgtcacccctcacccacaatcgcagaggactccaggaaacctccctgagggcaggggctttgtccgatcttgctcaccgctggttcctgggtttgaatcccagctgtgctgcacactagctgtatgaccataccagttaaccttttggagcctcagt

SEQ ID NO: 164914 - DNA, 601 bp, Human
agcctgggcaacggaaatgaaaccctgtctcaaaaaaaaatgaacaaaagaaaaagaaggccaggcgcagtggctcacgcctgtaatcccagcactttgggaggctgaggcgggcagatgacgaggtcaggagttcgagaccagcctggccaatatggtgaaaccccgtctctactaaaaatacaaaaaaaaaaagttagccgggcgtggtggtgggcacctgtagtcccagcaactcgggaggctgaggcagaagaatagcttgaacccgggaggcagaggttgcaaggagctgagatcrcgccagtgcactcactccagcctgggcgacagagcgagactccgtctcaaaaaaaaaaaaagaaaaagaaaaaaagaaggcaagagagtcagagttggagaagtaacaatggaagtggaagcaggcgttagagtgacaggagtgctggctttgatgaaggaagggtcacaagctgaggagggcagatggactctagaagctgaaataggcaaggaaatggattctcccctagagcctccagaaggaacagggctctgcctacacctagattttagcccagtgagagtgatttcagacttc

SEQ ID NO: 164915 - DNA, 601 bp, Human
atataaaaaagatacagaaaagggccgggtgcggtggctcacacctgtaatcccagcactttgggaggctaaggtgggcagatcacaaggtcaggagatcgagaccatcctggctaacacagtgaaaccctgtctctactaaaaatacaaaaaattagccgggcatggtggcacgtgcctgtagtcccagctactccggaggctgaggcagaatggcgtgaacccgggaggtggagcttgcagtgagccgagatcgcgccactgcactccagcctgggcaacagagtgagactccatctcaaaaaaaaaaaaaaaaaaaaaagatacagaaaaaataaaccttatcccctgcttcacacaatacacaaaaattcacttgagatgaaacagagatctaaatgtaaaatctaaaaatagaaagcttctagaagaaaacataggagacaggcagaataacagctcctcaaagatgtttacatcctaatccctgaacctggaaatgtggcagaaggcactttgcagatgtgatgaacttgaagatgttgaaatgggggagatgcccctggattatccgggtaggccaagtgtcatcataagggtc

SEQ ID NO: 164916 - DNA, 601 bp, Human
agtgaaaccccatttctacaaaaaattttttaaaaaattagccgggtatggcggctcacacctatagtcccagctactcaggaggctgaggctggagaatcccttgagtctgggaagcggaggttgcagtgagccaagatcatgccactgcactccagcctggccaacagagtgagactctgtcttaaaataaataaaataaataaataagcattgtcaacaaacatataaaaaagatacagaaaagggccgggtgcggtggctcacacctgtaatcccagcactttgggaggctaaggtrggcagatcacaaggtcaggagatcgagaccatcctggctaacacagtgaaaccctgtctctactaaaaatacaaaaaattagccgggcatggtggcacgtgcctgtagtcccagctactccggaggctgaggcagaatggcgtgaacccgggaggtggagcttgcagtgagccgagatcgcgccactgcactccagcctgggcaacagagtgagactccatctcaaaaaaaaaaaaaaaaaaaaaagatacagaaaaaataaaccttatcccctgcttcacacaatacacaaaaattcac

SEQ ID NO: 164917 - DNA, 601 bp, Human
tagtgaaaccccatttctacaaaaaattttttaaaaaattagccgggtatggcggctcacacctatagtcccagctactcaggaggctgaggctggagaatcccttgagtctgggaagcggaggttgcagtgagccaagatcatgccactgcactccagcctggccaacagagtgagactctgtcttaaaataaataaaataaataaataagcattgtcaacaaacatataaaaaagatacagaaaagggccgggtgcggtggctcacacctgtaatcccagcactttgggaggctaaggygggcagatcacaaggtcaggagatcgagaccatcctggctaacacagtgaaaccctgtctctactaaaaatacaaaaaattagccgggcatggtggcacgtgcctgtagtcccagctactccggaggctgaggcagaatggcgtgaacccgggaggtggagcttgcagtgagccgagatcgcgccactgcactccagcctgggcaacagagtgagactccatctcaaaaaaaaaaaaaaaaaaaaaagatacagaaaaaataaaccttatcccctgcttcacacaatacacaaaaattca

SEQ ID NO: 164918 - DNA, 601 bp, Human
aatgtagtgaaaccccatttctacaaaaaattttttaaaaaattagccgggtatggcggctcacacctatagtcccagctactcaggaggctgaggctggagaatcccttgagtctgggaagcggaggttgcagtgagccaagatcatgccactgcactccagcctggccaacagagtgagactctgtcttaaaataaataaaataaataaataagcattgtcaacaaacatataaaaaagatacagaaaagggccgggtgcggtggctcacacctgtaatcccagcactttgggaggctraggtgggcagatcacaaggtcaggagatcgagaccatcctggctaacacagtgaaaccctgtctctactaaaaatacaaaaaattagccgggcatggtggcacgtgcctgtagtcccagctactccggaggctgaggcagaatggcgtgaacccgggaggtggagcttgcagtgagccgagatcgcgccactgcactccagcctgggcaacagagtgagactccatctcaaaaaaaaaaaaaaaaaaaaaagatacagaaaaaataaaccttatcccctgcttcacacaatacacaaaaa

SEQ ID NO: 164919 - DNA, 601 bp, Human
ggtacacacagcggctcacatgtgtaatcctagcactttgggaggccgcagcaggtggatcacctgacctcaggagttcaagaccagcctgggcaacacagtgaaaccctatttctacaaaaaatatttaaaaattagccgggcatggtggctcccactagctacttggggggctgaggcgggaggatcacttgagcccaggaggcagaggttgcagtgagctgagatcatgccactgtactccaacctgagcaacagagtgagacccccatctcaaataaataaataaataaataaatamatacatatatacataaataaataatatggttaaaaaaagagacagtttggtattggcataaagaaaactatacatatcaatggaacagagaagagagtacagaaataaacccatacatatggttaattaattctcaacaaggagtcaaaatgattcaatgagaaaaggcaagtctttttttttttttcaaagtattttcagccaggtgcagtggctcaggtctgtaatcccaatactttgggaggccaaggtgggaggatcactttaagctcaggagttcaagaccagccaggcaatgta

SEQ ID NO: 164920 - DNA, 601 bp, Human
tgtggaaggaggatcacttgaacccgggaggacaaggctgcagtgagctgagatcgtgccactgcactccagcctgggtgacaaagtgagacctcgtttcaaaaaaaaaagagtaggccaggtacacacagcggctcacatgtgtaatcctagcactttgggaggccgcagcaggtggatcacctgacctcaggagttcaagaccagcctgggcaacacagtgaaaccctatttctacaaaaaatatttaaaaattagccgggcatggtggctcccactagctacttggggggctgaggcrggaggatcacttgagcccaggaggcagaggttgcagtgagctgagatcatgccactgtactccaacctgagcaacagagtgagacccccatctcaaataaataaataaataaataaataaatacatatatacataaataaataatatggttaaaaaaagagacagtttggtattggcataaagaaaactatacatatcaatggaacagagaagagagtacagaaataaacccatacatatggttaattaattctcaacaaggagtcaaaatgattcaatgagaaaaggcaagtctttttt

SEQ ID NO: 164921 - DNA, 601 bp, Human
tgtatattgacttctcatcttgtgaccttcacttactaaaccttgtagtttgtctagatctcttgggattttctgcatagacaatcatgccatctgtgaaaaaagatagttttcttttttctttttctcaccttgtcacactgactagtgcaaagttgggcatggtggtgcaagcctgtagtcccagctacttgaggggctgtggaaggaggatcacttgaacccgggaggacaaggctgcagtgagctgagatcgtgccactgcactccagcctgggtgacaaagtgagacctcgtttcaaaaaaaaaagagtaggccaggtacacacagcggctcacatgtgtaatcctagcactttgggaggccgcagcaggtggatcacctgacctcaggagttcaagaccagcctgggcaacacagtgaaaccctatttctacaaaaaatatttaaaaattagccgggcatggtggctcccactagctacttggggggctgaggcgggaggatcacttgagcccaggaggcagaggttgcagtgagctgagatcatgccactgtactccaacctgagcaacagagtgagacccccatctcaaataa

SEQ ID NO: 164922 - DNA, 601 bp, Human
acaaaaaacgaaacaaaaagactgggcacagtggctcacacctgtaatcccagcactttgggaggccaaagcaggcaaatcacgaggtcaggagatcgagaccatcctggccaacatagtgaaaccccatctctactaaaaatacaaaaaaattagctgggcatggtggcgcgtgcctgtagtcccagctactcgggaggctgaggcaggagaatcacttgaacccaggaggcggaggttgcagtgagccaagattgcgccactgcactccagcctggcaatagagcgagactccgtctcaaaaaaaaaaaaaaaaaaaaaaagatgaatgcagccacttttggttgggtatattttgttactgacttagtctcttttctaactgacatgctgtgaaattataaaattggacaataaagccttttgctgagaaaaacagaacataactatagctctctttgtgcacagctgattatgcaaaggaaacaagaaagacaattatacagaagggaagttttcttcctgaccttgactatacttgtttataaaaggcctgatttggagctgacagggaagctgcatttatcatctggtgactaac

SEQ ID NO: 164923 - DNA, 601 bp, Human
ccactgcattccagcctgggtgacggagcaagactctgccaaaaaacaaaaaacgaaacaaaaagactgggcacagtggctcacacctgtaatcccagcactttgggaggccaaagcaggcaaatcacgaggtcaggagatcgagaccatcctggccaacatagtgaaaccccatctctactaaaaatacaaaaaaattagctgggcatggtggcgcgtgcctgtagtcccagctactcgggaggctgaggcaggagaatcacttgaacccaggaggcggaggttgcagtgagccaagatygcgccactgcactccagcctggcaatagagcgagactccgtctcaaaaaaaaaaaaaaaaaaaaaaagatgaatgcagccacttttggttgggtatattttgttactgacttagtctcttttctaactgacatgctgtgaaattataaaattggacaataaagccttttgctgagaaaaacagaacataactatagctctctttgtgcacagctgattatgcaaaggaaacaagaaagacaattatacagaagggaagttttcttcctgaccttgactatacttgtttataaaaggcctg

SEQ ID NO: 164924 - DNA, 601 bp, Human
ctctcagcagccggtgggggaggaagccctcctcaaacgatctgaatttcagctcctggagccccacctcccagtttccaaacatctacgtttcaataattcctgctcctttcttttgttcccccaaccctgggagtggtagctactccctgcggttgcttctccctcatatcttagtcttctagtaacacctagttactggttctttctatcaaattatctgttaaaataactggtgtggttttaatctccgggcaaggaccctgactgacccggcagcactcatgttggtagtttgtcrtggtgctgatcccagatagcaaataacttgattttatttattattattatttttttaagagacagggtctttctctgtcacccaggctggagcacagtggtgcgatcatagctcactgcagcctcgacctctgggtctcaagtgattctcccaccttggcctctgagtagctgggtctagagatgcacgacaccacacctggctaattttttattttttgtagaggcatggtcttgctatgttgcccaggctggtcctgaactcctggcctcaaatgatcctctcacctcagcctcccaa

SEQ ID NO: 164925 - DNA, 601 bp, Human
ctatgaaaccgtacaaaactcaagccaaagggggagtcctgggaaaggaggggtgggagtcagggagtctggcccaaggacagaggccagggcccaagacccttttcactcagggaaacctcttcctggctccttccctctcatgaacacccatgttgaaggaggggccctggcgatggtgatgacaattataggattaagctgttatgactgagccctaactctgagtctggctccaagcccttttcacgcattagctctttgggcaattggcagagtctactaggtgtcccagcgaatycactgccctatgcacaaactcctgcctgtggaatgggagggagtgctgcgtgccacttccagaacacagaagtgttccaggctctctcctctgccagctggatgcagagccagaaaataggagaagtctgggtccctgcacgacctcataaggagaagccagctgacaggctaaacactccccaggacagttacctgggcaagaagcacacctttagtgtgtggcatcatcacatactccagtctcactgttaccacagcttttagcatcccttaacctacagcaaccctgtaaggatca

SEQ ID NO: 164926 - DNA, 601 bp, Human
cccgcaaggtcagtattataggtgggctgctggcaggtgggggtggagaggcagggagaaggccatggggagtgacaggtacagcttacctgggacggggcctctgcctcatctttgtctggggggctatgaaaccgtacaaaactcaagccaaagggggagtcctgggaaaggaggggtgggagtcagggagtctggcccaaggacagaggccagggcccaagacccttttcactcagggaaacctcttcctggctccttccctctcatgaacacccatgttgaaggaggggccctggcratggtgatgacaattataggattaagctgttatgactgagccctaactctgagtctggctccaagcccttttcacgcattagctctttgggcaattggcagagtctactaggtgtcccagcgaattcactgccctatgcacaaactcctgcctgtggaatgggagggagtgctgcgtgccacttccagaacacagaagtgttccaggctctctcctctgccagctggatgcagagccagaaaataggagaagtctgggtccctgcacgacctcataaggagaagccagctgacaggctaa

SEQ ID NO: 164927 - DNA, 601 bp, Human
acaagggatctagttagctcacatttaggtctcttgggaacagatggcgacagctgggctggtggtttgctgggggtcttcttttcttcttggttcaaatccaacttcctcttccctttgggagactcctggggctgaggggatggggatggattgaggcctccagcttctctcctcctccaccccaccaaagtctgatgatttcaccttggaggtgctgcctatggccctggagactggagaggctgaggaggcagcactagaagcctggagggtagcagctgcatagctaggtcctgcygggtcgctggctgtgactatgaagggagaaagtggatccaggatgagagggctgagccccaagaccctttcactcctatctatgggacacagaatattgttgccaaaacccaccagtgatccaggagtcccagcctccagacctctcaaccctcaggacacaagaggccaggcccaccttcctccaccctgagacccaggagtccaggactccactaccctcctccctcagacccaggaatctgagccccagccccctctaccctcagacccacgagtctaggtctcaaccctactcact

SEQ ID NO: 164928 - DNA, 601 bp, Human
gtgacagtccagcacccactccttacgcacgatgcggcctcccaggcctaggacctggctgtacttgggggtgttggcaaaggcacagctggtggggggcagaagtgaagatgccagttaggtgtgatctgaggggcaaaggggaatgagacaggggagacagacagagagagagagagacagacagacagacagatcatgagattgaggtgggagaaacaaaaagaggttggagaccaagggagagatgcaaaaatcagagagaagacaaaggctacagaatgcagtgagaaagaaagcragtgagagagagagaaagcatgcagcatagtggacacagagaaagcacaaggtggaggagacacagggagctgggggagaaactgcagcggcgcagggaggggggcgcaagcctacatgaggtgcgtgctgtcccgggtccagtctggccgatacttggccccaagctctagggccttatctcgcagctcggagcggaaggggttctggaagccactcagcaccactaccacaccctgaaggatcttccccagctcctctgggccagctcggggtcgtctgggctcggtgccttctcctc

SEQ ID NO: 164929 - DNA, 601 bp, Human
gctaatttttgtgtttttagtagagatggggtttcaccatgttggccaggctggtctcgaacttctgacctcaagtgatccacctgcctcagcctcccagagtgctgggattacaggcgtgagccactgcaccgggactcactttgaatgaatgaatatggaccctaacacttgttctcccacccctgagtttttgcacaaactgctcctccagccttttctgataagcaggcttcacagagccctctgtgacctcccaggcaggtcctccttccctcatctggagtaccccagcccctgycccgctcctctcagtagtctgctggctctgggctgggaccacctgtgttctccgctggcaggccccagtctgactcccctccagattcctggcattgcccagcacaggataaggagcagggttggcgtgtgaggccttacctccgggagggcagccgccgacgcatgcggtgacagtccagcacccactccttacgcacgatgcggcctcccaggcctaggacctggctgtacttgggggtgttggcaaaggcacagctggtggggggcagaagtgaagatgccagttaggtgtgatctg

SEQ ID NO: 164930 - DNA, 601 bp, Human
tctcttggaccttgaagacccctcgctctctgcgggccaccctgtggggcttccactgcactgttacaacaattctgatccctcatcaaagtgagaagccttcaagggcagggctcaatgactggatcctcagccttgcacattccagcctggcaccaagcaggggcttctgggactcattttggtttttgggttttttttttcttgttgagatgggagtctcgctctgtcacccaggccagagtgcagtggcacgattttggcttccaggttcaagcgattctcctgcctcagccttccragtaactgggattacaggcgtgcgccaccaagcccagctaatttttgtgtttttagtagagatggggtttcaccatgttggccaggctggtctcgaacttctgacctcaagtgatccacctgcctcagcctcccagagtgctgggattacaggcgtgagccactgcaccgggactcactttgaatgaatgaatatggaccctaacacttgttctcccacccctgagtttttgcacaaactgctcctccagccttttctgataagcaggcttcacagagccctctgtgacctcccaggcag

SEQ ID NO: 164931 - DNA, 601 bp, Human
gtagcctgggctccggaagccccttctgacctgagcccacccacctcacagcctcgctatcccccaaggcaaataatttctcaaatacaccaggtacaactaacttctgaacacactcaggccatggagtacaatccagtctcccctccaattcatggacctcagatatgagctagcctttgctcagtccaaagccttctgtggttcctaatgccccagtcccatttttcctgccacttcttgcccctgtgtaagctcagcctcacctacaactccaggcagacaacaggctgacctgacmttgtctcctctgcccagcatgttctctgcctctgttcagcctgaaaaacctctcttggaccttgaagacccctcgctctctgcgggccaccctgtggggcttccactgcactgttacaacaattctgatccctcatcaaagtgagaagccttcaagggcagggctcaatgactggatcctcagccttgcacattccagcctggcaccaagcaggggcttctgggactcattttggtttttgggttttttttttcttgttgagatgggagtctcgctctgtcacccaggccagagtgcagt

SEQ ID NO: 164932 - DNA, 601 bp, Human
ttctgttcctgaggccccagcctactcaggagtccccacctgcagcctccccttgacacttcatccctcccaacagagcctgcccctgcccccatcaaaccttctgtgactcccctctgctcacaagaggaggcctctggagctggatgggcttcagaattttgaatctttcaggttttagagaggcaaatggctggcatacagattgttacataaactcccaggagggcctgggggagcaccccatgatcaaacccactaatatttctgcagttaagaccatgacacacttaaggggataaaaaaaaaaaagtccgcaaatagcctcacattagttcaggatgactgcagcgaaatgagtttgtgctgaacctagaaaagaactttcagcttctagagatgtttggattcctgaataacagatgagggttctgtgaagctgcatggagcccagtgtgtagcctgggctccggaagccccttctgacctgagcccacccacctcacagcctcgctatcccccaaggcaaataatttctcaaatacaccaggtacaactaacttctgaacacactcaggccatggagtacaatccagtctcc

SEQ ID NO: 164933 - DNA, 601 bp, Human
acaggagattcagaggatttaaaatgtagtagttcattaacagtcaatagcaggtttacttaactttttcttcaaagtgctctattcaaagattaaaaaaaaaactaaatttgtgcttattaggtatggagagtcatcctcttggggtcttccttctatagttgaatttttattttatttttattttttgagacagagtctcgctctgtccccaggctggagtgcagtggcatgatctcgactcacttcaaccccttcctcccaggttcaagggattctcctgcctcagcctctagagtarctggggctacaggtgtgcgccaccatgcccagctaatttttgtattttttggtacagatggggttttaccatgttggccaggctggtctcaaactcctgatgtcacgtgatctgcccaccttggcctcccaaagtgctgggattacaggcgtgagccactgcactcagccaaatttttatttttgagataaggtcttgatttgccacctagactggagtgcagcggtgcaatcatggctcattgcagcctgaacctcctgggctcaagtgatcctaccacctcagcctcccaagtatcta

SEQ ID NO: 164934 - DNA, 601 bp, Human
tcccctccctcttttttttttgagacagagtccattccatcgccaggctggagtgcagtggcctcatctcggctcactgcaatctctgcctccaggttcgagcgactcccctgcctcagcctccctagtagctgggattacaggtgcacaccaccatgccccgccaactttttgtattttagtagagacacggtttcaccatgttggccaggatggtctcgatctcctgacctcatgctctgcccccgtcagcctctgaaagtgctggaattacaggcgttagccaccactcctggccgctttttttttttttagacaagatctcactctgtcacccaggatagagtgcagtggcgtgatcttggctcactgcaacctccacctcccagggttcgagcgagtctcctgcctcagcctccccagtaactgcgattacaggcatgtgccaccacgcctggctaattttgtgttttttgtgttgttttgttttttaagtacatacgaggtttcatcacgttggccaggatggtctcgaactcctgacctcgagtgatccacccacctcagcctcccaaagtgctgggattacaggcatgaacca

SEQ ID NO: 164935 - DNA, 601 bp, Human
attctctcccagctcaggaaggccccagtgaacccagtcagtctggccacctgccctgcagacctgggtaccccctttcttcccctccctcttttttttttgagacagagtccattccatcgccaggctggagtgcagtggcctcatctcggctcactgcaatctctgcctccaggttcgagcgactcccctgcctcagcctccctagtagctgggattacaggtgcacaccaccatgccccgccaactttttgtattttagtagagacacggtttcaccatgttggccaggatggtctcratctcctgacctcatgctctgcccccgtcagcctctgaaagtgctggaattacaggcgttagccaccactcctggccgctttttttttttttagacaagatctcactctgtcacccaggatagagtgcagtggcgtgatcttggctcactgcaacctccacctcccagggttcgagcgagtctcctgcctcagcctccccagtaactgcgattacaggcatgtgccaccacgcctggctaattttgtgttttttgtgttgttttgttttttaagtacatacgaggtttcatcacgttggc

SEQ ID NO: 164936 - DNA, 601 bp, Human
gactcaggagcccaggccgcaggccctcctccctcagactcaggagcccaggccccagcccctcctccctcagagtctgacctgactgtaccccctcaatgtctatatcttcctggagcactggtgaggctgctttggtctcttcaggggttgggggcttctggggtgagctgggtccagctgcctgagtgggcttggttttggtctggggttgctaaggagggagagtgggtgggtgaggagggcaggaacagtgtgggtgtgttgggggggtacctgcaagaggcaagagtgggaagtytggggtgccacagcggactcatgtcatcctcccactacaccctcccccactggacagggggcatcagaccttctgaggaagcttgggggcttcatctccgctgccaccgctgtgagaggcctcatcctcctcactgctggaacctggccctgccatgaggtacctaggggacaaatcgggcctcagacaaacaggcccaagggaagtggggagggcgttcaggaggcaacagccattggcatttactaaaatactcactctagtgggcctcatggtcttgttcccagcccattctctccc

SEQ ID NO: 164937 - DNA, 601 bp, Human
aaggtgactctctaggccatcaatttgctgatgccactttaggggcttgggagaatcaaagcatcttcctgcccatcacccacgaggaactgggtggaaacggctcttctggaagccccagaaccacacctctgcacagcccgtgactgtctttcctctgctcccttcattctcgaagaagctctgcctccctgcccctcatcccacaactccctgcagagtttccccatttccttttgttcttattcttttacactggaaatgcaaacacacaatgtgtgcagacagcatccacgtccasagtgatggctgatgttaaagcagacactggtgtgcacccacccagggcctgacagagagcagtgcccctgtcacctggtgtgcccggcttcaccccagaccaacagaacggcacctgagcaagtgaagcactagcatgagggtggggccctcacccctgacgtgaaaaaaaggaggtcacacctggcacatggctgcgaggggagtggtcagaacaagaaatctggaggggagaaaaaggcaagtcacagagaggatgctgaaaggaaaggaacaagcctggcagaacctgaaggtgctg

SEQ ID NO: 164938 - DNA, 601 bp, Human
tgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctaggtaagtctgttgtctgcatgtctccccactaatgtgagtcatayagatggagtctcagggcacgactgggttttgtgtctctcgttgttgcttcacagcccttttggcatcacccatttatttaactaggataaaaacgaatattggtatagcgattccacagtttacaaagtgcttttgtatccactgtctcacttgatcaagcaaaaggaaaccagaggaccggagtgctgtcctgagtctaccttgatttgctaggcgacttgagggagacttttagcctcaaagggccacttaagtggaaattctaaaacagtacctattctgatcctaactcaagggaa

SEQ ID NO: 164939 - DNA, 601 bp, Human
aattcttctctgttctgcagcccaagtgaccctctcaaaatgtaaatctgatcatgtcactctcctccttagtgctccctagtgactctccagagcttttggaatgaaaagcaaaattcctgtcatggtccacaaagccctgcctagtctggctcctgccaacctatttccccacaatccagccacgttggctctctcctcctgtgtttcctgccaccacgtggcctttgcacttgcggtttcctcttactggaatttcctcccgccctccctgcttgcttcagtctggttaactcctacrtatttatcctctatatctctgcttgcccgactcctttttggaggagcttttcctgatcctctaggtcaaggggagctcccaacatctccccattagtgccatgctcctttccttccttgcatttgtcagttttaatttccactcctatgagtgatcactgggttaatgctttctcccgccacccacccgtctacaatctccatgaggttagaatctgtttctcatttgttcatccttgtgtccccagtgcccagcctatttcctgaacatagtagaggttcaaaacatatttggaaaata

SEQ ID NO: 164940 - DNA, 601 bp, Human
cggtgtgtgtttattacctaccccatgagctaaacatgaggcaaagtagtaattggctgggtctctggtgagtccatttccctgcgttgccccgaggtgtatgcaggctttacacagctaccttggcaactgacttccccaatgtttgctgtgtgtccaaggacaagcagggatctatgacactgggtgtttctagcaaatttccctctcaaattggcacattctctgtgagctttggagacttcacagtgtggctcacagtttgggaacaatttgcatcatcatctgactggtaagttcyagttctgtggtaactcaagtgtttcaaatagcttaatacgcaatagggcacggaggttcgttctgcttctgttggaatcaaacacacatttccacaatgttcccgttatacaggatcatcccgaaacacatcccccagaacactatgttgtcactactctaccttttgatatacactttattattattcctatgtgcagataggttacttaagtttttctgttctagattagtttgtctattcaaatacatgtttctcacacacttctacagtgtttttctttttgttgttattcttaaa

SEQ ID NO: 164941 - DNA, 601 bp, Human
ccatgttgtatcaaggctgggtggtagctttgtaactagtttcccaccttagaatgactgtctgctttgtccaggactgcaagggggacttagaatatgggatttttcagtgctaaaactagaaaagtctgagacaaatcaggacaaagtggtcaccctgctaccatttctagccttgataaaggagcaggtagacccaaccaaggataatttttgttttctatgtagataccagtttagtggttggtaggaattcccccaaatcaacaccttgctaagctcatctctctctctctctctcttttaatataacagcttattgagataaaactcacataccatacaattaatgcacccatttaaattgcgaaattcagtagtttttagtatactttcagagttgtgcaaccttcatcacaatcaattttacaacattttcataattctcaaaagaaatcctgtacccattagcagccactcccatttctctccaaatccctcagctcctggcaaccactggtctgctttcagtctctgtagctttgccttttctggacatttcatataaatggaatcatacaatatgtggccttttggttct

SEQ ID NO: 164942 - DNA, 601 bp, Human
gttgtatcaaggctgggtggtagctttgtaactagtttcccaccttagaatgactgtctgctttgtccaggactgcaagggggacttagaatatgggatttttcagtgctaaaactagaaaagtctgagacaaatcaggacaaagtggtcaccctgctaccatttctagccttgataaaggagcaggtagacccaaccaaggataatttttgttttctatgtagataccagtttagtggttggtaggaattcccccaaatcaacaccttgctaagctcatctctctctctctctctcttttaatataacagcttattgagataaaactcacataccatacaattaatgcacccatttaaattgcgaaattcagtagtttttagtatactttcagagttgtgcaaccttcatcacaatcaattttacaacattttcataattctcaaaagaaatcctgtacccattagcagccactcccatttctctccaaatccctcagctcctggcaaccactggtctgctttcagtctctgtagctttgccttttctggacatttcatataaatggaatcatacaatatgtggccttttggttctggct

SEQ ID NO: 164943 - DNA, 601 bp, Human
ctctccaggagtgccctgttcacagctgtgggataatgatcaatagttcctaaaaatatctatggaagacctcaccactcttattgatcagcaactactgcaaagataatgtttcagcatttgaaaccccttattattaatacttattctgtatgggtcaagtagccgctaacttacagtttggcagatggatcaagtataataataataacctataaatactaataaatgagccagtatagtataagtgagtactatactaagcagtgaaggaagaataatttcatggagggaagtccayggtagaagcaggctgctaggtattattatcgttttcacatactattcactttatgaagagatttaacatagctcagggtaatatggtctcattcaaatgccaaaatgacccctcagttcttctttctctcctttcccgatagaggtggccctaaggacacacatctgggacaatacggccatttttagccttgacccaagagatctgggttccccatgactggagtggaaaacaatgtctgtgggtttgtgtttttcagagtcaagggtccagagaaggaggagaagttgagacaggcgg

SEQ ID NO: 164944 - DNA, 601 bp, Human
gccaacaacgaaggacttttctccctggtggcgaggaagctgagcagacccctgtgatgcctgtgacctcaattaaagcaattcctttgacctgtccagttgactttagtccttgtttctaactgccaagtcatgtgctgagtagaggctcagtggttggggcccaatggttcatctaggacgggactagagaggtcagtctacaagcaatccattgaccacttacttggtgctgcacacaaatgttggtgctatgggacccaaagatgagcaattagtattccagtcttcattgcctgtrcttacaaaagaagacctcacttccctaaacatctagttatggcggctcaagcccgtacctgcctacagagaagtgtctgcagttactcactattagtttcctaagggggcactgctggctccttctctcccaggaatgggcttctcctattctttaactcttgccttctccctggagaggctaccaaaccctggcctctgccgctgttcaggctgccatgtgggtatagctgtttgctagactccactctggcctcaggggccagagaacagctgtccagcatttctgttcatcccagca

SEQ ID NO: 164945 - DNA, 601 bp, Human
caccaataaccaagttacacaaaaccggaagagaagcagggtgtggaagtatagcattttcagctctgggaaagtttagaataaggtgtctctgggagatgggagtgaatatttcagtaggcttaaataatgaagtttggtacttatttgggtaatcaggatttgagacacagattcagaatttttaatataaatgtggataatgaagctgtggaaacagtttctacaaaagcagaatagattacaaaaagaaaattatatgaccaatctatgagaattctccatagcccatttacccacrtttgatcctacaaaattaatgtcaaggaagatgtgggtcaaagaatgctcttcctttaaaaacagcattacctggaaaggaagaaagtactccttgagagtcttgcatattaaggtaatttccagatgtttgatctatgaaaagataaagggtattgaagtagtcacttatcatctctggaaaactttaccccaatctgtaaaacactccccactaaaaatttctcccataacactgactgactgactgacattaaataatgttaaagatgttctttaatttagagagtggtgggaggta

SEQ ID NO: 164946 - DNA, 601 bp, Human
catggtagtaagcactaggaatattttttaatgaatctttgtcctgtccttcaggatctcttccttctatgtatacatatgaaaggacatgaatattgaatatatgaagtagaatgaagatataatgataaatgctaaaatcaaggtacacactagatggatttatagcactaaacattcattgcacagacacttgaggaaatgttttcacagagtttatgtgagaaaatccttgagccttttatttcatcacaggttcaacacaatccaacaatgtgatgtccttgttaaagaaattaaygtaacctttgttttaaaatagaaataagttttctagatgtgtggaggatcttttagaagctattaaggcaaaaaataatatttaattttaaaaacaaatttgaaaaattgttatacaatcagttagataaacaaaggcagcatgaaatgtgctgatgtggagaagaacgaattagaatagatatattggaaaaaattatagaataatcatttgttggataaaatgttggatttcttcataaagaagtgtgaaaacaatagaaaaaaactagaagtagttaggttatttttgagctatttt

SEQ ID NO: 164947 - DNA, 601 bp, Human
aggagtttcttaaggaattccgtgacaaacaacagggtgccaaaaaaaaatttagtcttagtttcaagaaaggtgaaggaaagtgttataggaagtcatccagagttatcttgtagagagacagtggcattactgagtcaataaaacatttcccaattcagttataccaggcttgtgctgcatgactcttatgttacaaaggaccatgtagtatccagcactctctcatggcaagtttgtattttagattatcaagagattacatttcttggtcttacaaccaagctttctaatattattyagttatacgaagggcataaccattgtttctgttgtataatagaacttaccgaagcagtgagattttttttcacatctacgctgtaccccagattttgtagcagcattgtcatgcctgtgatgtcaacctcagctccagttcttctaggaatactgtcaaattcttcattgcagataatgagagcaagacgtgtgcggcttgacttgtccattattggataaatctgtaggaaatgcaatttgaatgaacagccttgttctttccaattaaatatttcccttcctggtttatgacagcttc

SEQ ID NO: 164948 - DNA, 601 bp, Human
atgtctgggcaaattggactaatgaatgatctcaacatggcagaattttctatgcagagtcagattctaatgtactacagcacataccgtcttccatttaattctctgctatcgctcaaagttccaaaaatattttgaaacatagatgaattctttaattagtaatgcattgaacagatatgcaaaattgctctcttggataaagggaattctgtgtataacttggaacaaagcttgagttggtcttgagttgttaatcaccacctctagtgggttattgtcactttttctattgatagcmccaacaaagatgtcctgtgtagaaacctgttacctggtgtggaagagcagaaagcgataaaatccttctctatgtgggctttcttaatagcatcatcctcaaactcttctgtagttggtaaagataggtttccagaaactcctactgaatctttaaaccacaccacaccagggctgtctggaaagacacagtttgatttgttactactaccaatggctgagaagatgttttcctcctagcctctgttcaatgatatttattaatgtgtttgctctatcattaattcacatgcaaatagac

SEQ ID NO: 164949 - DNA, 601 bp, Human
ttttaaataatagcagttttttaatgtgtgctttattttgtgtcgtgcccaatatttcaaatatattaatttattaaatccttagaaaaataatatttatattcacatattagtcagcaattcaaggaaagcccgaggaggaactagtggaactgttttacaaaatactaaatgtctgggtcagtcaataatagcaagattcttactccaaagcatacgtttagaaaaattcaaatatattctgtctcacacacttcatgcttctaggtaaaacccactttaatttagggccccaaagtgyctcgcttgctgttctgcttttcagaatcttgctcttactcttctcctataaatatttgatgtctgggcaaattggactaatgaatgatctcaacatggcagaattttctatgcagagtcagattctaatgtactacagcacataccgtcttccatttaattctctgctatcgctcaaagttccaaaaatattttgaaacatagatgaattctttaattagtaatgcattgaacagatatgcaaaattgctctcttggataaagggaattctgtgtataacttggaacaaagcttgagttg

SEQ ID NO: 164950 - DNA, 601 bp, Human
ggtggtgaatgaaaggatttaaataatttttatttaaaccttgcttagaaaagtaactgaattaagttatcaaatatatacattttaaataatagcagttttttaatgtgtgctttattttgtgtcgtgcccaatatttcaaatatattaatttattaaatccttagaaaaataatatttatattcacatattagtcagcaattcaaggaaagcccgaggaggaactagtggaactgttttacaaaatactaaatgtctgggtcagtcaataatagcaagattcttactccaaagcatacrtttagaaaaattcaaatatattctgtctcacacacttcatgcttctaggtaaaacccactttaatttagggccccaaagtgtctcgcttgctgttctgcttttcagaatcttgctcttactcttctcctataaatatttgatgtctgggcaaattggactaatgaatgatctcaacatggcagaattttctatgcagagtcagattctaatgtactacagcacataccgtcttccatttaattctctgctatcgctcaaagttccaaaaatattttgaaacatagatgaattctttaatt

SEQ ID NO: 164951 - DNA, 601 bp, Human
caaaggtggtgaatgaaaggatttaaataatttttatttaaaccttgcttagaaaagtaactgaattaagttatcaaatatatacattttaaataatagcagttttttaatgtgtgctttattttgtgtcgtgcccaatatttcaaatatattaatttattaaatccttagaaaaataatatttatattcacatattagtcagcaattcaaggaaagcccgaggaggaactagtggaactgttttacaaaatactaaatgtctgggtcagtcaataatagcaagattcttactccaaagcrtacgtttagaaaaattcaaatatattctgtctcacacacttcatgcttctaggtaaaacccactttaatttagggccccaaagtgtctcgcttgctgttctgcttttcagaatcttgctcttactcttctcctataaatatttgatgtctgggcaaattggactaatgaatgatctcaacatggcagaattttctatgcagagtcagattctaatgtactacagcacataccgtcttccatttaattctctgctatcgctcaaagttccaaaaatattttgaaacatagatgaattcttt

SEQ ID NO: 164952 - DNA, 601 bp, Human
agagctacttagagagcggtgaatgtcatgtggaaggctgggatcaaacgatactaacgaacagttctgtctaatattaaactctgctatacgtactcaggctgaaaatatatggtgtttttgggtagtgtcattgtttctgatcattgggaaaaaaaaattattgagttctacatcagggcatgttcaacccaatgtagaaccaagcttcttctgaaagaagatatctcattttagaaaatattttagaaaacttaactatttgagcagagacagggcctttgggccagaggtgaccaaragaatgcaagtcctctcaggaaactgccaaaggtggtgaatgaaaggatttaaataatttttatttaaaccttgcttagaaaagtaactgaattaagttatcaaatatatacattttaaataatagcagttttttaatgtgtgctttattttgtgtcgtgcccaatatttcaaatatattaatttattaaatccttagaaaaataatatttatattcacatattagtcagcaattcaaggaaagcccgaggaggaactagtggaactgttttacaaaatactaaatgtctgggtcagtca

SEQ ID NO: 164953 - DNA, 601 bp, Human
ttgataatgagaagccagaggcctacaaagagctacttagagagcggtgaatgtcatgtggaaggctgggatcaaacgatactaacgaacagttctgtctaatattaaactctgctatacgtactcaggctgaaaatatatggtgtttttgggtagtgtcattgtttctgatcattgggaaaaaaaaattattgagttctacatcagggcatgttcaacccaatgtagaaccaagcttcttctgaaagaagatatctcattttagaaaatattttagaaaacttaactatttgagcagagrcagggcctttgggccagaggtgaccaagagaatgcaagtcctctcaggaaactgccaaaggtggtgaatgaaaggatttaaataatttttatttaaaccttgcttagaaaagtaactgaattaagttatcaaatatatacattttaaataatagcagttttttaatgtgtgctttattttgtgtcgtgcccaatatttcaaatatattaatttattaaatccttagaaaaataatatttatattcacatattagtcagcaattcaaggaaagcccgaggaggaactagtggaactgtttt

SEQ ID NO: 164954 - DNA, 601 bp, Human
aaagaaaagaaagacacataaatcagccagattgataatgagaagccagaggcctacaaagagctacttagagagcggtgaatgtcatgtggaaggctgggatcaaacgatactaacgaacagttctgtctaatattaaactctgctatacgtactcaggctgaaaatatatggtgtttttgggtagtgtcattgtttctgatcattgggaaaaaaaaattattgagttctacatcagggcatgttcaacccaatgtagaaccaagcttcttctgaaagaagatatctcattttagaaaayattttagaaaacttaactatttgagcagagacagggcctttgggccagaggtgaccaagagaatgcaagtcctctcaggaaactgccaaaggtggtgaatgaaaggatttaaataatttttatttaaaccttgcttagaaaagtaactgaattaagttatcaaatatatacattttaaataatagcagttttttaatgtgtgctttattttgtgtcgtgcccaatatttcaaatatattaatttattaaatccttagaaaaataatatttatattcacatattagtcagcaattcaagga

SEQ ID NO: 164955 - DNA, 601 bp, Human
atatcgtggagacagatatctctgcaaatgttttgtgaaattaaggaagtagataattatttttcttcaggagatcactatgatgtggttgggattggcacagcagaatgtggagataggtttaacatggaagttatagataactgaattggagtttctgacagtcatctagaaggtaggagtaaggaaagtgaaagaaaagaaagacacataaatcagccagattgataatgagaagccagaggcctacaaagagctacttagagagcggtgaatgtcatgtggaaggctgggatcaaasgatactaacgaacagttctgtctaatattaaactctgctatacgtactcaggctgaaaatatatggtgtttttgggtagtgtcattgtttctgatcattgggaaaaaaaaattattgagttctacatcagggcatgttcaacccaatgtagaaccaagcttcttctgaaagaagatatctcattttagaaaatattttagaaaacttaactatttgagcagagacagggcctttgggccagaggtgaccaagagaatgcaagtcctctcaggaaactgccaaaggtggtgaatgaaagga

SEQ ID NO: 164956 - DNA, 601 bp, Human
gaaaatagcatccactagcatcttaccttgcggaaaatttcctccacatcacaggaacaggcatattcttgcatatgttcaatgagtcttccaataaaaacagagcccattgtgggatgtctccaagaaacattatctatggataaagcacatttcaaatctcaagactggctcttgcctgaagaaagagaagaaaccctagtatttatactccagctgagggatgtttgaaatcataaatttagtagcaaataaggaaaaggcggaatggggtagaggggagtgattgggatttggaaaygaaatatctaaatgtgcattcccaaagtggtattactgactgtgatttaagttaattatgcattctgatatttaatagactcagctagctatacaggggatggtaataactccatacacaagaggtatctgaggtcacgcaagtgtttgagataacccaggatatgcaatactcagtctacatggggtaattatattatcaaattctcaatttatgtacttcataaaagattaatcgaaattaaataacattgacagtaagatatttacacacaaaaagttaactataaaaatcataaaa

SEQ ID NO: 164957 - DNA, 601 bp, Human
aagaatttcttgagttatgccaaaaaactacaacaaatatagcaaaataagtgacaaaaacaaaaagtacttccatctgcaacaagtataaccatatatgtatgtaagcattgaatgaccctcctcagggcattttaaatctgctgctggatctaatagccatgagagacacaggtaaattagagtccattcatttgtctctgcagggcaggagcggggtgaaactaaatgattgttttctcaaggctgtgggtcttaatagattggattaggctcctgggtttgtccactctccaaagarctccaaaactcttttggaaagaagagcattattggaagataaacttgtctggatctgctttctatgcttccaattgcaatagccaagcattcagggaagtagagtgaaaatagcatccactagcatcttaccttgcggaaaatttcctccacatcacaggaacaggcatattcttgcatatgttcaatgagtcttccaataaaaacagagcccattgtgggatgtctccaagaaacattatctatggataaagcacatttcaaatctcaagactggctcttgcctgaagaaagagaagaa

SEQ ID NO: 164958 - DNA, 601 bp, Human
taggcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccaggtaagggtgttctcgcctgcagaggtgagttctcagatgccccggaacacccttggcaaaggcaccagagctctctgattgcagctgattctyggggggcactgaagccagtctgagccagtcacaggagggccttgaggagatgctgagtatggcctgggggtgtgggagaggaaggggctcaggaaaacttctgtaaggagccagataaaagtttttaaaataatgttttaaatgtttgtcaaagaaagcaatagatttgtaaagaaattagtaggtaagtagtgaaaattgattctccttcccattcccaatcctgtggcaactcttgttacagattttatttatcctccacagatacatcatgcgttcacaatgaacatagaatttact

SEQ ID NO: 164959 - DNA, 601 bp, Human
tcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccaggtaagggtgttctcgcctgcagaggtgagttctcagatgccccggaacacccttggcaaaggcaccagagctctctgattgcagctgattctcggggggcactgaagccagtctgagccagtcacaggagggccttgaggagatgctgagtatggcctgggggtgtrggagaggaaggggctcaggaaaacttctgtaaggagccagataaaagtttttaaaataatgttttaaatgtttgtcaaagaaagcaatagatttgtaaagaaattagtaggtaagtagtgaaaattgattctccttcccattcccaatcctgtggcaactcttgttacagattttatttatcctccacagatacatcatgcgttcacaatgaacatagaatttactgggttttagactgagccatccttaacttgtcaacagttactttgaaaacaaaccagctctcccaaattggggtt

SEQ ID NO: 164960 - DNA, 601 bp, Human
catttgagtatacagctttttgtgggggcaggcagaactgagacataccaaaatcagtttgggaaatgctgtatttgaaaatgctttctatttaaatattctctttgcaatcatttttgctctgttgatttgcttagcaaagtcttcatgtctgggacaatatccatttcttactgactcatcaaaaacccccactcgacacgtcgatgagagaggttttgtttgctgtgtggcatgttcagtgaaagcgtggtttccagtttcttcacatccttataattttctagacttcagatggagsgaacaatcagaggaggctggaatcctgcctctgaccaaggaaaagaccagaggctgagccaggtggggtctcttgtccagccctctgcttgcctcgctttacctgggtgtgggctgagtaattccagacaagcgtggaattaatctggctgtttgtgctgttcagtggcacgctggttacacctccttctggaaacaactctgcgtgtgctgtttgggtggtaggattccgggtctccttctccgtctttttataacatcaagttgctgcccagctcaggctcctttacggccagtcttc

SEQ ID NO: 164961 - DNA, 601 bp, Human
cagatggagggaacaatcagaggaggctggaatcctgcctctgaccaaggaaaagaccagaggctgagccaggtggggtctcttgtccagccctctgcttgcctcgctttacctgggtgtgggctgagtaattccagacaagcgtggaattaatctggctgtttgtgctgttcagtggcacgctggttacacctccttctggaaacaactctgcgtgtgctgtttgggtggtaggattccgggtctccttctccgtctttttataacatcaagttgctgcccagctcaggctcctttacgkccagtcttcagaaaaccaccagctaacacatttactaccctccttccccgatgttcctgtagcttctctatggctgggtggccaggcatggccgaagaggctctgggtagatataggctctgtgcccggtgtgtgtaactggccttgagtgaggctgcagttgtgtgttatttctattaggtcactgtggaatttctagcgacaactaatctttcaaagtgtgtttattggtcacaggattattgggccagcctctgccttcattctttttcacctaatctgcataatagctgtgttatc

SEQ ID NO: 164962 - DNA, 601 bp, Human
agccagtagtccaaagctggccctctgttgttgtaaataaagttttattgggacatggtcatgctcacttatttaggtagagtgtatggctgcattcagtctacaccagcagagttaaatagttgtgatgaagaccacgtggcccgtgaagccaaaaatatttgcttcctggccctttacaggaaaaaaattcccagccccagtggcaggcaattaacaccttgtcctcgaggagctgaaagtggctggaggcaggaatgcttataagaaccaagcgaggtgaagcactaggtggccgcgkcgagcaggaagagaagctgattttgtttgccctttcgtttgccagagattgtgggttttttttttttttttttttgcagagatgaagctttgatcttgtcacaatagcagagggaggccttatttttgtctatttctctgtgacattggtagaaaggactttgtcagaattccaagctatttggcaattatccaattttgagatcctaatggatctttcgaggtctagtttgttcattcttttagtgattccttgttaattccctgattttataaatgtgtgttgaacatctgtcttggc

SEQ ID NO: 164963 - DNA, 601 bp, Human
ctatgcaggggtcattgctaccctctatccctggaaaggatgtaggcacagggcagttctaggttccagcttgggcaccgcttaacatcttggtggtgcagggatcaggctgatgataccgtggttgttctgtgggctactgggcagggtcaagccactcccaccctgatccaggtacctaatgcacccgacacagaagcggcagtgtccttggggtcatccattatccatgtgttggaggagtgggaccctagggaagatgcttggctcgacttccccacccctagccagggcacaatcwgaggtccaggggctggtgggcacaatgccaagtcgtgaggcctccagtgtctgcgctcactgtcccataaataaccacagtaataactagcaaatcaaaaacattgtgataggtcgagagagacagcatgtggaagaaaggaaaaagctttctattttagtacctttaacagtgctttctgtatgctttatgaacaaggagcctgcatttttattttgcactgggctctgctaattttgtagctggtcctgccccctagtagctcaagtcagcaaatctttggttcatctgagtccacag

SEQ ID NO: 164964 - DNA, 601 bp, Human
gtccaggggctggtgggcacaatgccaagtcgtgaggcctccagtgtctgcgctcactgtcccataaataaccacagtaataactagcaaatcaaaaacattgtgataggtcgagagagacagcatgtggaagaaaggaaaaagctttctattttagtacctttaacagtgctttctgtatgctttatgaacaaggagcctgcatttttattttgcactgggctctgctaattttgtagctggtcctgccccctagtagctcaagtcagcaaatctttggttcatctgagtccacagtccrctgacccgccctttttcacagttcctcccctgcccatgtgctcacttccctccttacccagcttggcgcactccctcaagcaagtctttggatgctgacatcccccgtaaacaacccttctgcggcctggtttgattttccttaggagacatgcaagttctatagcactgtttcttgctgggtatggaggatgtgctattttgtccattgcatattttttaaagaaaatgaaaggttagcataactgtttccagaaggcacattgaatcactcagttgagtcccagccagttgctgcaat

SEQ ID NO: 164965 - DNA, 601 bp, Human
taaccacagtaataactagcaaatcaaaaacattgtgataggtcgagagagacagcatgtggaagaaaggaaaaagctttctattttagtacctttaacagtgctttctgtatgctttatgaacaaggagcctgcatttttattttgcactgggctctgctaattttgtagctggtcctgccccctagtagctcaagtcagcaaatctttggttcatctgagtccacagtccactgacccgccctttttcacagttcctcccctgcccatgtgctcacttccctccttacccagcttggcrcactccctcaagcaagtctttggatgctgacatcccccgtaaacaacccttctgcggcctggtttgattttccttaggagacatgcaagttctatagcactgtttcttgctgggtatggaggatgtgctattttgtccattgcatattttttaaagaaaatgaaaggttagcataactgtttccagaaggcacattgaatcactcagttgagtcccagccagttgctgcaatgttagcctttgaagcaaacttgaaccaacacaggaccagcctagaagtcccagcctccagaaatgatg

SEQ ID NO: 164966 - DNA, 601 bp, Human
aacagtgctttctgtatgctttatgaacaaggagcctgcatttttattttgcactgggctctgctaattttgtagctggtcctgccccctagtagctcaagtcagcaaatctttggttcatctgagtccacagtccactgacccgccctttttcacagttcctcccctgcccatgtgctcacttccctccttacccagcttggcgcactccctcaagcaagtctttggatgctgacatcccccgtaaacaacccttctgcggcctggtttgattttccttaggagacatgcaagttctatrgcactgtttcttgctgggtatggaggatgtgctattttgtccattgcatattttttaaagaaaatgaaaggttagcataactgtttccagaaggcacattgaatcactcagttgagtcccagccagttgctgcaatgttagcctttgaagcaaacttgaaccaacacaggaccagcctagaagtcccagcctccagaaatgatgcagtggattctgcagattcagcaacaacaatatttttgtaactcaagagcacttagtaattttcaaaggagagaaagaagtaattgacttggctta

SEQ ID NO: 164967 - DNA, 601 bp, Human
gtatgctttatgaacaaggagcctgcatttttattttgcactgggctctgctaattttgtagctggtcctgccccctagtagctcaagtcagcaaatctttggttcatctgagtccacagtccactgacccgccctttttcacagttcctcccctgcccatgtgctcacttccctccttacccagcttggcgcactccctcaagcaagtctttggatgctgacatcccccgtaaacaacccttctgcggcctggtttgattttccttaggagacatgcaagttctatagcactgtttcttrctgggtatggaggatgtgctattttgtccattgcatattttttaaagaaaatgaaaggttagcataactgtttccagaaggcacattgaatcactcagttgagtcccagccagttgctgcaatgttagcctttgaagcaaacttgaaccaacacaggaccagcctagaagtcccagcctccagaaatgatgcagtggattctgcagattcagcaacaacaatatttttgtaactcaagagcacttagtaattttcaaaggagagaaagaagtaattgacttggcttattaggttgaaaaa

SEQ ID NO: 164968 - DNA, 601 bp, Human
gttataccctctctggtcccctgtccctgtggagtgatccggggcacaagggcagctgtttccccgctgacctctgtgtgccctgaacatctgggaggtggggagcaggctggtgagaagaacacctggagtggaggttggggtcagggagggtcccagtcccggtaccacccccacctgctgtgggacctgcagtcccctcatcagcagaacggctatgaagccatcctgcccatccacagggtggtgggtcgtgaaggctgcatacctggcagagcgggagaagctctgggaagatgcyggacacgcgccgtgggagtgatttccctgccttgcccagattctgctcccatcacctgaacctgcctgtcaccaccatggaactgctgtgaccattgctttccttttaagcagattagcagacatctcctgctccaccccgccaaacaaacaaacaaacaagcaaacaaacaaacaaaaatgtgcatgagggagtatggacttgtagagtcttttctaaacattgttaggtgcttgtattgggatcctctcttaaaatgaaccatattccccaggctttggatgacactcatggttgccc

SEQ ID NO: 164969 - DNA, 601 bp, Human
tgcccagattctgctcccatcacctgaacctgcctgtcaccaccatggaactgctgtgaccattgctttccttttaagcagattagcagacatctcctgctccaccccgccaaacaaacaaacaaacaagcaaacaaacaaacaaaaatgtgcatgagggagtatggacttgtagagtcttttctaaacattgttaggtgcttgtattgggatcctctcttaaaatgaaccatattccccaggctttggatgacactcatggttgcccaccctccaacttccttccctgctggcagagccctgggtttgttttagttccaaccctgaccccaccgcattcctgactcaggcaaattcgcagggtccaatgcagtcaggggagccacgttccctcctccaacgagtgctgaggtcgctgcttgattggatactgccgatgacctacgaggaggagggtgccagggcgcttttgggactttgcttttctggagagatgcttccacagcatggtcatggacacagtcacgtcttgatgtgatgtctggaatggtggtggccgtcttgtggctgtgagaataggctgaggttgattggatggagg

SEQ ID NO: 164970 - DNA, 601 bp, Human
ccatattccccaggctttggatgacactcatggttgcccaccctccaacttccttccctgctggcagagccctgggtttgttttagttccaaccctgaccccaccgcattcctgactcaggcaaattcgcagggtccaatgcagtcaggggagccacgttccctcctccaacgagtgctgaggtcgctgcttgattggatactgccgatgacctacgaggaggagggtgccagggcgcttttgggactttgcttttctggagagatgcttccacagcatggtcatggacacagtcacgtcytgatgtgatgtctggaatggtggtggccgtcttgtggctgtgagaataggctgaggttgattggatggagggaaggaaggagccttgttcttgatgctgtctgtgagccttcgagttatcagcctggtaccacccagcccttggacagatatctactctacatactccatttggagttttttttttttttttttttttttttgtcacttgcagttgaaaacaccctaattgatacacacaaactatttttagtgctggtctgtgtttggcccttatggaagactctgggctgagctgccc

SEQ ID NO: 164971 - DNA, 601 bp, Human
acttccttccctgctggcagagccctgggtttgttttagttccaaccctgaccccaccgcattcctgactcaggcaaattcgcagggtccaatgcagtcaggggagccacgttccctcctccaacgagtgctgaggtcgctgcttgattggatactgccgatgacctacgaggaggagggtgccagggcgcttttgggactttgcttttctggagagatgcttccacagcatggtcatggacacagtcacgtcttgatgtgatgtctggaatggtggtggccgtcttgtggctgtgagaayaggctgaggttgattggatggagggaaggaaggagccttgttcttgatgctgtctgtgagccttcgagttatcagcctggtaccacccagcccttggacagatatctactctacatactccatttggagttttttttttttttttttttttttttgtcacttgcagttgaaaacaccctaattgatacacacaaactatttttagtgctggtctgtgtttggcccttatggaagactctgggctgagctgcccatggtgagggaggtggactttgtgttttcttactgctctgtgtcctg

SEQ ID NO: 164972 - DNA, 601 bp, Human
tttagcattgtgagtccctgcaggctgggggccagtgggcgtttttcttctagatgccccctctcttcttctggcctcccaggcttcctgctcctgagattgtgagaactggcctgtgctgggctcactgcagaaagactgtcgtccccaaaggttttgcaccaaacttgagctacaagatcttttagggggacctgagatctccgcctgggctctatgagagcaggcatgggttgtttttgccccgtcactgcagtcatgcccacacttgcattttcttttccccccagcagtgtgaggrtctggcatgaggagtgggactcgcgtgccctctttcttctcctcttccctctggccttttcatccgtcagtgggggacagatgtttgccctgtttacttctaggcttactgtggggctccagggagatggtgaagtggccaaggagaggagctgccaccttcaagacggcctgtggccggtgccgctttaaagggagactcagaggtgctttgctgtgggtggcgcgggaaccagcctggggacagcagtgcagaggccttggactcagagtgcgtgggccccgcggggcttcacggcgc

SEQ ID NO: 164973 - DNA, 601 bp, Human; identical to SEQ ID NO: 25844

SEQ ID NO: 164974 - DNA, 601 bp, Human; identical to SEQ ID NO: 25845

SEQ ID NO: 164975 - DNA, 601 bp, Human
ctaaaaatacaaaaattagctgggtgtggtggcgcacgcctgtagtcccagctactcaggaggctgaggcagaagaatcgcttgaacctgggaggcagaggttgcagtgagctgggattgtgccactgtactccagcctgggtgacagagtgagactccgtctcaaaaaaaaaaaaaaaaagaagaagaagaattaaccatgtctgcaatatacacattaaacacatctagaaaaatgtatattgtgaaaatatggaagcaatttttttttataaaaggtttcaagaaaagggaaaagacrgattaatttgaaacgtaccttttcctctctccagggctacaggtaaaggatggtagttgtgtgcaccatacttatattccctttcaaaaatgtcatcagaggttggagggccttggactgtttttttagttgcaacagatgtagcagaagccactgaagaatgaactccgcgactaagtacagcaaacctctgcaaatgtgctagtttggaaaacattgtgtccttcaagtagaaaaaccacagatctgtccaaagaaaagagaatgcattaagagtgagaatccttggcttatgcctat

SEQ ID NO: 164976 - DNA, 601 bp, Human
ggatgcagtgagttgagattgtgccactgcactccagcctgggcaccagagcaaaatcctgcctataaaaaaaataaaataaaataaataaaatttaaaaataaaaaagcagaagttacacataacagacaaaaatcatgagaagtagactgtaataacccttaggatggaaaaaaaatatttgtaaatcatgtgtctgataaggatctaatatccagaattcttacaactcaatttcaaaaggacaaacaacccaatttaaaaaatggggaaagacttgaatagctatttcttcaaagargatatacaaatggcaagaaacacatgaaaagatgttcaacatcactaatcattaggaaaatgcaagttaaaaccacaatgagataccatctcatactccctgggatggttataattaaaaaaacaacttttgacaaggatctgaagaaattggcactctcatacattgctagtgggaaagtaaaaacaaggttgccatgtcatgtaatatgaaacagattttcaatagttcaaaagaagatatgtctacagtactggtaccaaataaaatacaagcaaatgaccaaaatgtgtgatactc

SEQ ID NO: 164977 - DNA, 601 bp, Human
ctagcactttgggagaccaaggcagggattgcttgagcccaggagttccagatcagcctggacaacacggcaaaatccctgacgctacagaaaaatgctgggcatggtagtgcgcgcgtatggtcccgttacagaggctgaggtgggaggattgcttgagcctgggaggtagaggatgcagtgagttgagattgtgccactgcactccagcctgggcaccagagcaaaatcctgcctataaaaaaaataaaataaaataaataaaatttaaaaataaaaaagcagaagttacacataacaracaaaaatcatgagaagtagactgtaataacccttaggatggaaaaaaaatatttgtaaatcatgtgtctgataaggatctaatatccagaattcttacaactcaatttcaaaaggacaaacaacccaatttaaaaaatggggaaagacttgaatagctatttcttcaaagaagatatacaaatggcaagaaacacatgaaaagatgttcaacatcactaatcattaggaaaatgcaagttaaaaccacaatgagataccatctcatactccctgggatggttataattaaaaaaacaac

SEQ ID NO: 164978 - DNA, 601 bp, Human
aaaataacacaaaaaggttataaactctggagtaaaacctttacctaattctaagatttaggatccaaaattagaatttaaaagcagaagttaggcagggagccgtggctcacgcctgtaatcctagcactttgggagaccaaggcagggattgcttgagcccaggagttccagatcagcctggacaacacggcaaaatccctgacgctacagaaaaatgctgggcatggtagtgcgcgcgtatggtcccgttacagaggctgaggtgggaggattgcttgagcctgggaggtagaggatkcagtgagttgagattgtgccactgcactccagcctgggcaccagagcaaaatcctgcctataaaaaaaataaaataaaataaataaaatttaaaaataaaaaagcagaagttacacataacagacaaaaatcatgagaagtagactgtaataacccttaggatggaaaaaaaatatttgtaaatcatgtgtctgataaggatctaatatccagaattcttacaactcaatttcaaaaggacaaacaacccaatttaaaaaatggggaaagacttgaatagctatttcttcaaagaagata

SEQ ID NO: 164979 - DNA, 601 bp, Human
ggcagaatatttaatgatttcaactatcacaagaatgaactttgaccattatagtgacaaatgtacacatacttgttttttaaaaaaataaagcttaaaaaacaagtcagaacctctcatttgaatatcatataaagaacccaacagtcaaactacatcttctcaattaattgctagtctccctaaccaaaattcaagttattcctttcatccagtcccagaaacctaacaagggcaactccaagcctcctcttttcaacagcttctaagaggaacatggcacaacaggacctccaatatsaagattcaaaccacagtctatgtaggccatggccccacactaacttcacccaaccccagcacccaacacaaaccctccaccagtgagactatctaattaactggataactgctatgaaaaaaatctgacaggcaaatgagaggaatatggagttcagaaagaaaaatctcatatatgaagaaataatcccaagaagaggaaatccctcataaatttttatgaaacattcagcaaatacgtatcatgtaccaggcaaaacatattacaagtatttcatcagcaaattaaaacagtaaattt

SEQ ID NO: 164980 - DNA, 601 bp, Human
cagaggttacagtgagccagactgcagactaggtgacaagagtgaaactccgtctcaaaaaaaaaaaaaaaaaaaagttgggaaatagatcatgatcacaactggcaagatccctatcctcagggagcttcctttctagcagggagaaaacacctgacataaaccagtaaagcaagtgagctagataatttcagagaggatgacattcaagaaggaaagacaccatgtaaaataacagagaggttgggagtttgtgacatcatgtttttatcttctcaccacttctgccagcagcaactcyattaatcagtgctggattatcgtattttggcttcatctcgtttctaaatactattcttgcaaagcctctttcaccagcatcccttacccacaagtaatctcttctttcacttgtccacaaaaaatagcacattgattttgactaggtttgtttaagaagaaatgcactgattagaccataagcctatttgctctcccctgcctagcctcaggaacctcatcctcagtcacttaccctgcaggtataagggacttacagttagggacagtcttcctctgtctctccaccccactgactcac

SEQ ID NO: 164981 - DNA, 601 bp, Human
aagggcctttccaaggaggactatatcaggtctgacattttcataatcaacagccagccatctaccagttctggccaatcctgtctgtatttcatcagcaataaagagaacctattggggaaaaaaaatacccctattagtgatcactttcgtttccacagggaaaatagccatccttatttcactgtccccccaccaacaataaatgtgtaattctgatgtgccctcaaatttgtaaaaatgttttaactgcacacaatttcaagagtatcctataagaatcttgtagactcaccaactmtttcctttgtcaggccactatctccctagaggcccattctgccctgctctacatagtgaaaaggtgctgatgcaaaggtgagggttttgtatggcttttctggacctaactaccctctgggaagaaattaattcatttgtttattccacaagcatttaatatgtgacagaaactctcaaatggtaaacaaaatatactactattagccctgggggaaaggaggagagaatacaacaaagggcttgcgggggctcagagtgaaaggctcttagagcagcgaggaaggaaacgctgttaaga

SEQ ID NO: 164982 - DNA, 601 bp, Human
gaaatggaaagagggggaacatgaaacttacagggtataagcccccagaaagggcctttccaaggaggactatatcaggtctgacattttcataatcaacagccagccatctaccagttctggccaatcctgtctgtatttcatcagcaataaagagaacctattggggaaaaaaaatacccctattagtgatcactttcgtttccacagggaaaatagccatccttatttcactgtccccccaccaacaataaatgtgtaattctgatgtgccctcaaatttgtaaaaatgttttaactrcacacaatttcaagagtatcctataagaatcttgtagactcaccaactatttcctttgtcaggccactatctccctagaggcccattctgccctgctctacatagtgaaaaggtgctgatgcaaaggtgagggttttgtatggcttttctggacctaactaccctctgggaagaaattaattcatttgtttattccacaagcatttaatatgtgacagaaactctcaaatggtaaacaaaatatactactattagccctgggggaaaggaggagagaatacaacaaagggcttgcggggg

SEQ ID NO: 164983 - DNA, 601 bp, Human
gaatagacactgtgtggctgtatcagtctttacctcaagggctgcgatggccactcggcagcctagtggattgccaccgtatgtggacccatgctcccctggcttaatggtcagcatgatgtcatcatcacacagcactgcagacacctgaaagacagtcaattcaccatgtcatttctcagcactaagcattctactaagcatccttttccccagagtctcgctgtcacccaggcttgagtgcagtggcgtgatctcagctcactgcaatctctgcctcctggactcaagcaattctccygcctcagcctcccaagtagctaggattacaggtgcccaccaccacaccacacatgttatttatttatttatttattttgtagttttagtagagatatagtttcaccatgttggccaggctggtctcgaactcatgacctcaggtgatctgcctgcctcggcctcccaaagtgctgggattgcaggcataagccaccacacccggccaagaaactgatacttaatgacttcaacgaaagagtttacatctgccaacctaactaccagtaacaacctaatgacttagtcataccctaaaaca

SEQ ID NO: 164984 - DNA, 601 bp, Human
aagccaaaaaaaaaaaaaaaatgtgctaaggctgctgtattaatcacacaaggaactaatgcaaaagaacttgggtataggctggatgcagtggctcacacctgtaatcccagcactttgggaggccgaggtgggcagatcatgaggtcaagagatcgagaccatcctggccaacatggtgaaaccccatctctaataaaaatacaaaaattagcctgtcgtggtgtggcacatgcctgtagtcccagctactcaggaggctgaggcaggagaatcgcttgaacccaggaagtggaggtcrcagtgagccaagatcatgccactgtactccagcctggcgacagacactccagcccaacagagcaaggcactgtctcaaaaaataaaataaataaaataaataaaattctaaaaaagaaaaaaaagaacttgggtatgatacagatgattaactgacataaaatgggcaatactcaaaacccagtgaacactacacattccaaaaagggactcgcttcctgagctcaacatattatagcagcgattctcaacctggctgcacatcagaatcaccttaaaggctattgctaatgcctgtgcc

SEQ ID NO: 164985 - DNA, 601 bp, Human
tattttatatacacttaaccattaatccttcctaaaattcaataacaatgatttcactttataagatgaagccttttatgcaatacccagagataactttttcaaatatgaaacacttataccagtgaggaaattataaaaacatatatcaattatactgaaggacttgatttagaggctgtctgtatatagatgcatttcaccttaggaagtacacatgcacatcaaaacacttcaactgaatatagatgccattacattatttagttacgttacaaagcaaacggcaggttcataaacgttgttctattatgtatcaactgaaaaaaatatattcaaaaaaaaagtttttgaagactcatgggagtggaatgtgcccacattaggaataaagcttttacaggaccacctgtctccagctggctcccagggaccactgaaaacagctggctaccctcagaaagacaagatggtcttgttaataatttcaatggactctcgaagctcatcctccttgatcaccagcggaggcgcaaacctgataatgtcgccatgggttggcttggccagaagtccattatctcgaagtcgtagacacacc

SEQ ID NO: 164986 - DNA, 601 bp, Human; identical to SEQ ID NO: 24078

SEQ ID NO: 164987 - DNA, 601 bp, Human; identical to SEQ ID NO: 24079

SEQ ID NO: 164988 - DNA, 601 bp, Human
cccaactctctttcggttattagctctgtgaccctaggcaagtcacctcatcccttgatgccacccgttgcttctgtaacatggtcccaaaggtgcctgtcttgtccacctgataggatttttgagacgacaacaatatgcaaaagcaatagcttcaacatagaagtgctcagtgttttattttttaatgaaacggtttgacttggatatgctgtgcacattcaatgaacttaaggaattgtttgaacctagtagttctgggaccttagagtcctttctgtgggctccctgtggcccagawttttggtggccacgtttaatatcaagcctagcctaatttgcaaagggtctcccagggttaatttattggagtgatcacatggagtagaccagagtctgagggcagaaagctgtcacctgcttcggcaatagaggccccagatgtctgggtgcaaaagaactccatagcaccccgaccaacatggtgaaaccccgtctctactaaaaatataaaaattaggccgggcacagtggctcatgcctgtaatcctagcactttgggaggccgaggcaggtggattgcctgagctcaggagttcga

SEQ ID NO: 164989 - DNA, 601 bp, Human
gtggctactgtctgatgtagaaagaaatgggatcaggctaggcgtggtggctcacgcctgtaatcccagcactttgggaggctggggcaggaggatcacaagttcgagaccagcctggccaacacagtgaaaccccgtctctactaaaaatgtgaaaattagctgggcatggtggaacatgcctgtagttccagcttgaacccaggggtggaggttgtagtgagcctagatcacgccactgcactccagcctgagcaaaacagtgagactctgtctaaaaaaaaaaaaaaaaaaagagagwaatgggacctccgtcttagactgaagaattcagttctacgtgcttagcagtgaatacttttgtccaaggtactctggcaggaggaagaggcgtgtcctcttgagttcttgacttgggctctggcctgttaatatttccatgttggtgaaaccagaggcagcactctaggtgcacgaactttaggcagcgcagcctcctagtcttatggaacatctgaggcagaagaaacctgagtccaaccttttcattttatagatgaacaaacagatcctgatgggacagtgtacccaaggtcaccca

SEQ ID NO: 164990 - DNA, 601 bp, Human
cctgcccctgccagctgcaggccccacccttcctgtggccaggctgatgggccttatctctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaakttcctttcttccaagccagtgattctggttcttggacaaggtgttgaggaacactagaaacagaggggactgtgacctggggactttttctgcaggaagaaaacagcccaaagatgagagtgattcgcgtgggtacccgcaagagccaggtgggtgcaggagccggggtggaggaggtttgtcagaacagttatgatgctcacagcatcacaaattgggggactcagagggttagttcctagtatgaaggagatggggtggctgggcgttaagttccccgggaaatggcagattacattc

SEQ ID NO: 164991 - DNA, 601 bp, Human
gccggggtggaggaggtttgtcagaacagttatgatgctcacagcatcacaaattgggggactcagagggttagttcctagtatgaaggagatggggtggctgggcgttaagttccccgggaaatggcagattacattctatggcaagatcatccctaggctgggaaaattgttggagtgcagagggctcccaagccccttctcatgcccagatggaaattccagtcccttcaggatctgcctaacctgtgacagtctaaagagtctgagccgtggctgggaagggcaggactaatccaartctctacccgcagcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaaggtgctttcctctgaatacctccagctctgactacctggattagcctggcatttaacatcttgagctttgggtc

SEQ ID NO: 164992 - DNA, 601 bp, Human
aaggagtggaagctaatgggaagcccagtaccccgagaggagagaacacaacatttctggctttgcctatagctaaagcccgtcccgctgccccgagattccttctgggctgctcccagttctgaaggtgctttcctctgaatacctccagctctgactacctggattagcctggcatttaacatcttgagctttgggtctttttatgagtgtttctggtcttcctgctcgattgtatatactcagagggcaggaaccagggattatgtgcctctgtccccatcatgaatcgtagcacagygctaggctcagtaaatgctgatcaataatgagcacctgattgattgactctctcctcagttgctatgtccaccacaggggacaagattcttgatactgcactctctaaggtaacaacatcttcctccccagttcttgtccccactcttctttccttccctgaagggattcactcaggctctttctgtccggcagattggagagaaaagcctgtttaccaaggagcttgaacatgccctggagaagaatgagtaagtaaagataggagagtgtggtgccctcccagtctcttgctgggacc

SEQ ID NO: 164993 - DNA, 601 bp, Human
gcccagctgcagagaaagttcccgcatctggagttcaggagtattgtatccttttagaagagtgacggatccttttggaagagtgacggagacagcagccaaggaaaaagacaaggtctagagggctctgggagtccggagagtggaaggggcttccagcaagcagcccgtggggtcagtggcctgtctgtctttccatgcactcatccgtccactcatttacagtctaatgttttcttagccccagacaagtgttcagagtgcaaggcattggggataatggtgagcaagataaacattyccctgcatatgtagagtttacgtcttacttagggataatgcagttatactgaactgaatagtgactacttctggagggatagggagtacttccttttttttttttttttttttctgagacggagtctcgctctgttgcccaggttggagtgcagtggcgcaatctaggctcactgcaacttctgcctcctgagttcaagcaatcttcctgcctcagcctcctaagtagttgggattacaggtgccaccacacctggctaatttttgtatttttagtagagactgggtttcaccatgttag

SEQ ID NO: 164994 - DNA, 601 bp, Human
ataggcgggaaatgtggcgtcaagaggctgggattccgagaaagaagcgaggctttcacgaaaatgcgagcggcttcggcaaggggcggggccgctggacgtggatgaaagctacagagccagcgtggaccaatcagacctctttggggcggggcctctgtggataagtgggcgtggtctaggggggaagtcaccaagaacgcaccggaggtccttgcccgccctggaaaacgccctctgcggtgaaggagaggtgagaggccagggttcccatactcttgggtcctagggaggatggggsccagagggctggaaaactgggtcccggaggaggatgcactgggtgccagtactttaggtcctgggaaaagaggaggctgggaccctggactcttgggtctgggggaggaggcggccgagatcccggattcctgagtgtgagagaggagcgtgttgggagccaggacccctgggtctgagggcccagactcctgtgtcggaggaagggaaggccggaggcctggaatcctggggcctgggtaacaaaatgcttgtgtcttgattcttggaagtgggggcggcgctgggggcccgaactcct

SEQ ID NO: 164995 - DNA, 601 bp, Human
cggctgggggagtgggggctgtgggaggggtacgtgctgggagggcagagttcaggggaggactggtttctttttttttttttttgagacggagtcttgctctgtcacccaggctggagtgcgatggtgcgatctcagctcactgcacctccaccccgcaggttcaagcagttctcctgcctcaacctcccaagtagctgggattacaggcgtacaccaccatgcctgactaatttttgtatttttagtagagacggggtttcaccatgttggccaggctggtctcgaactcctgacctcrtgatcctcccatctcggcttcccaaagtgttgggattacaggcatgagccaccatgcctgaccatactggtttcttcaaaggggccacatggctccagctgtgcctgtatttgaaaatcaccaaagtaagactcagggagaagttgcttcttggggtcacaagctgggaagagctttggggaacacagaatacgtgtttagtgcagagtcccgtgggcaggctttcagtcgcagctccgccgcttaccagctatggggcctcccctcaccgtgcctcagtttccccatctgtaaaatggg

SEQ ID NO: 164996 - DNA, 601 bp, Human
gggagtgggggctgtgggaggggtacgtgctgggagggcagagttcaggggaggactggtttctttttttttttttttgagacggagtcttgctctgtcacccaggctggagtgcgatggtgcgatctcagctcactgcacctccaccccgcaggttcaagcagttctcctgcctcaacctcccaagtagctgggattacaggcgtacaccaccatgcctgactaatttttgtatttttagtagagacggggtttcaccatgttggccaggctggtctcgaactcctgacctcgtgatcckcccatctcggcttcccaaagtgttgggattacaggcatgagccaccatgcctgaccatactggtttcttcaaaggggccacatggctccagctgtgcctgtatttgaaaatcaccaaagtaagactcagggagaagttgcttcttggggtcacaagctgggaagagctttggggaacacagaatacgtgtttagtgcagagtcccgtgggcaggctttcagtcgcagctccgccgcttaccagctatggggcctcccctcaccgtgcctcagtttccccatctgtaaaatgggagacatc

SEQ ID NO: 164997 - DNA, 601 bp, Human
accaccatgcctgactaatttttgtatttttagtagagacggggtttcaccatgttggccaggctggtctcgaactcctgacctcgtgatcctcccatctcggcttcccaaagtgttgggattacaggcatgagccaccatgcctgaccatactggtttcttcaaaggggccacatggctccagctgtgcctgtatttgaaaatcaccaaagtaagactcagggagaagttgcttcttggggtcacaagctgggaagagctttggggaacacagaatacgtgtttagtgcagagtcccgtgggcaggctttcagtcgcagctccgccgcttaccagctatggggcctcccctcaccgtgcctcagtttccccatctgtaaaatgggagacatcatagaacctgctgcacagttcggatttggattttccaagggaaggattttggggtttggattttccaaaggaagatgtgtaaagggtttggaagagcatggtgacactccttagcaagtgttgtgggagggctgcgtcaacagaatgctcctatggtgccttctacagaggaagaattcaaaataagggaggtgctggtgtcccttac

SEQ ID NO: 164998 - DNA, 601 bp, Human
gccactgtactccagcctgggcgacagaacaagatcccatctcaaaaaaaaaaagttgaaagaacttcaaacttttagaaaagttgtaagagtagtacagaaaactcccaaacacccctgacctggcttctctagttaacatttgctccatttgctttgtcactcacgtttgggacttcaccacagtcaccatctcatcacccttacacatttcagtgtgatactcttgcataagtacagcgataaaatcgggagatttatcaggtcacactgtttttccttgctcagctaatatctttctttttttttttttgagacagagtctcgctctgtcacccaggctggagtgcagtggtgcaatctcggctcactgcaagctccgcctcctggattcacgccattcttgtgcctcagcctcccaagtagctgggactacaggcgcccgccaccatgcccagctaattttttgtatttttagtagagacggaatttcactgtattagccaggatggtcttgatctctaacctcgtgatccgcccacctcggcctcccaaagtgctgggattacaggtgtgagccaccgcgcctggcctttttttt

SEQ ID NO: 164999 - DNA, 601 bp, Human
aactcccatatgagggaggctgcacttgtttgctgaggccgctgtaaccaagtaccactgaccaggtgcttcagcaacagaacttgactgtctcatggcctgcagtcagagtccaaagtgaaagtattggcagggttggttccttctggggctatgagggaggatctgtaccaggcccctctccttggcttgcagatggccgtcttctcactgcattttcacaccatctttcctctctgtgtgcctggcccaaatttctccttccattattattttttattaattattattattattattwttttttttttccaagacagagttttgctctcgttgcccaggctggagtgcggtggcgcgatctcagctcactgcaacctctgcctcccaggttcaagcgattctcctgcctcagactcctaagtagctgggattacaagcacgcgccaccacgcctggataattttgtatttttagtacagatggagttttgccatgttgggcaggctggtttcgaattcctgacctcaggtgatccacccgccttggcctcccaaagtgctaggattacaggtgtgagccaccgcgcccggcctattat

SEQ ID NO: 165000 - DNA, 601 bp, Human
gaggctggggctgccctcagccaggttcagggccaagggcctgccatttacaggctggaattgggggctgggcagagggggcagaggggaatgaccctgtgcctttccccaggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctgtraggaccccatttgtgcccatccactccctaccacatccagttcaaacgcaagacaagaaagcagttaaagaactacaattcccaggggcccttgaggcaaaaaactccctgttactgtacctggctgccccagggtctgctgggagttgtagttttcttagttttcttgcttgagggagatgatgtttgttggatgagggtaaagggatatttggttttatcccatggcatccagacttcttgctcatgagctcctggctctcccctccacagggcagccaagcccagttgaaggaggtg

SEQ ID NO: 165001 - DNA, 601 bp, Human
gatgatgtttgttggatgagggtaaagggatatttggttttatcccatggcatccagacttcttgctcatgagctcctggctctcccctccacagggcagccaagcccagttgaaggaggtgtgggaggagctggatggactggaccccaacaggtttaaccccaagaccttcttcatactgcatggtaaggtggggagggagttccagagccaggatgaaccctagattctgacccttctaggacctgaatgctaagaggggtgtgtctgtcccaggagggcttagtcaggcccaagagycaagcctatgtcccctggttgaccagacagccctgcctctcccgactacaaggctaggatctgcatggaagggttgggcctcttttctagcaaacaccagacctcggggttctaaggacagctggtgtcctctgtaagcaaaccaggcttggctaggcctgggccctctgcccacagcagcccaggagaagccctggtccactctgggaaccctgtcgctaggagtgggttgttccctaagaaccaggcctccagaagcctggaaaaccctttctctttttctttttccttttttttttt

SEQ ID NO: 165002 - DNA, 601 bp, Human
atacaactgtaaacaaaacaaagtacctccccctcagagccagtgatcaggcacacagatcataccatactttagtaactccacgagactgtacagtatgagaggtgctagcattttacgtaagctgccaattaaattaacgtaccattgaaaacaagatgcgtcctgggctgggtgtagtggctcacgtctgtaatcccagcactttggtaggccaaggtggaagatggcttgagcccaggaatttaagaccagcctggacaacaaagtgagaccctgtctctatttaaaaaaaaaaaawagaccaggcgtggtggctcacgcctataatcccagcattttgggaggttgaggtgggaggatcacctgaggtcaggagttcaagaccagcctggccaacatggtgaaaccccatctccacaaaaataccaaaattagctgggcatgatcgtgagtgcctgtaatcccagctactcaggaggctgaggtgggagaatcacttgaacccgggaggcagagtttgcagtgagccaagatcgtgccattgcactgcagcctgggtgacagagcaacactccatctcaaaaaaacaaagaaaaaa

SEQ ID NO: 165003 - DNA, 601 bp, Human
aaagttaaataaataaagatacatccctatttcaggggtgataaaatagaagaacacaaaagtgcatctcagaatcaacgaaggttctaggccgggtgtggtggctcacgcctgtaatcccaacactttgggaggcctaggcgggtgggtcccttgaggccaggagttggagaccagcctggccaacatggcaaaacccagtctctactaaaaatacaaaaattaaaaaacaaaacaaaacaaaaattagccaggcatggtagtgctcacctatagtcccagctactcaggaggctgaggyaggagaatcgcttgaacccgggaggcggaaggcgggggttgcaatgagctgagatcacaccactgcactccagcctgggcaacagagtgagactctgtctcaaaaagcaatagaaagtaaaaaagaattagaagattctgtaatggggtctcaggtagtgacgtgtactacctcgcagccttgaccacccaggttcaagtgatcctccccctcagcctcccaagtatctgggaccacaggcacgtaccactatgcctggctaatttttttaatttttagtaaaggcaaggttttaccatg

SEQ ID NO: 165004 - DNA, 601 bp, Human
ggtgacagagtgagaccctgtctctaaaaaataaaaaaataaaaaccttatttaatctttttaatcaggcagtccctacagaccagaataggttcagagcaactccctatacctttttttatttttcattttttttatttttagagatggggcttccctttgtcacccaggctggagtgcagtggcgtgatcatggctcactgcaacccagacctcctgggctcaagtgattcttccacctcaacccttagagtagctgggatcataggtgcacaccaccatgcccagccaatttttaaattttttttttctttttgaggcagagtcttgctctgttgcccaggctggagtgcaatggcatgatcttggcacactgcaacccccgcctcccaggttcaagctattctcctgcctcagcctcctgagtagctggggttacaggcacttggcattatgcctggctaatttttgtatttttgtagagacggggttttactatgctggccaggctggtcttgaactcctgacttcaggtgatcctcctgcctcggcctcccaaagtgctgggattacaggcgtgagccaccgcacccggcccaat

SEQ ID NO: 165005 - DNA, 601 bp, Human
aattttttttttctttttgaggcagagtcttgctctgttgcccaggctggagtgcaatggcatgatcttggcacactgcaacccccgcctcccaggttcaagctattctcctgcctcagcctcctgagtagctggggttacaggcacttggcattatgcctggctaatttttgtatttttgtagagacggggttttactatgctggccaggctggtcttgaactcctgacttcaggtgatcctcctgcctcggcctcccaaagtgctgggattacaggcgtgagccaccgcacccggcccrattttttacttttttttttttttttgtagagacggggtctagccatcttttctaagctggtctcgaacttaatgtgctcaaatgatcttgccttagccttccaaagtactgggattacaggcatgagcccctaaatttggcccctacattttctttaatcttaatcaatttacatttaaacagcccatgtggctagcggctactgtactggacagcgcagatccagagtttaggcagagaagagacccccaggcctgagccctgggccacactagcatgtggaggtcaggaagaggatgg

SEQ ID NO: 165006 - DNA, 601 bp, Human
gtcagatgcaggtggaaattaaccactggatttgcaagatgagggttcctggcctcctcctcaggaggaaggttgtgcttgtctgagggagccgaggaaggagggccggtggtgaggacaggaagtgtggctgaccgagcctgaagccctgcagctgtggggtctacgttggtaggagaggctcccctcacaactggagtcggcactggcctggttgtctgggaggcagaggtccctgataaccctggagctgactctgtgtccagagcactgaatgccagggccagagaatcctgcatgwcagtgacccaagcatgtttcctcgaaccctccctttgatctattccattctcaaccccctggtcgctaggcagtggccctagcaacgggtctagtggggtactaaagcctgggggccaccgttccaccgcgggagacccgtagttacctgtcctctgataacagaccccacatcagcccaaaatttcttcaccagggaccttacacatcccgtcctcggtcccctgagataccttgccatcctcttcccttcagatatcaacagtgatggtgtcctggatgagcaggagctggaggcact

SEQ ID NO: 165007 - DNA, 601 bp, Human
ttacctgtcctctgataacagaccccacatcagcccaaaatttcttcaccagggaccttacacatcccgtcctcggtcccctgagataccttgccatcctcttcccttcagatatcaacagtgatggtgtcctggatgagcaggagctggaggcactcttcaccaaggaggtgagcatcttggaagcctcgggcacctggagggacgcccaaatcagccacttgtttcctcctgcagtccccttaaatccccctggatgggagctcagtgaaaactacaactcccatcagcccctggggcaaaaacggctcccaggagtggtagcgtgcccaaaggactgctgggagttgaagttgtcgggaatgagctcgctggggacctctcaatgctgtctgcctctcgcttgctcctgcagctggagaaagtgtacgacccaaagaatgaggaggacgacatgcgggagatggaggaggagcgactgcgcatgcgggagcatgtgatgaagaatgtgaggtgggggccaggcgggggagaggacgggcccccagctctgtcactcacccttatctggctccccaggtggacaccaaccaggaccgcc

SEQ ID NO: 165008 - DNA, 601 bp, Human
tatttatttatttatttatttatttatttattctgagacggagtctcactccgtcgcccaggctgcagtgcagtggcacgatctcggctcactgcagcctccacctcccaggttcaagcaattctcctggctcatcctcttgagtagctgggattataggtgcgtgccaccacacccagctgatttttgtatttttagtagaggcaggatttcaccatgttggccaggctggtctcaaactcctgacctcaggttatccacccaccttggcctcccaaagtgctgggattagaggtgtgatttttttttttttttttttttttgaaacagggtcttgctctgtcgcgtaggctggagcccagtggtgggatctcggctcactgcaacctccgcctcttggattcaagcgatcctcccatctcagcctcatgagtagctgggattacaggcgtgagccaccatgcctggctaatttttgtattttttgtagagatggggttttgccatatcggccaggctgctctagaactgctggactcaagcgatccacctgacctggcctccctaagtggtgggattacaggcatgcaccaccgcacca

SEQ ID NO: 165009 - DNA, 601 bp, Human
ctcaaactcctgtcctcaagtgatcctcctgcctgagcctccctattagctgggactacaggcacatgccagcatgcctagctaatctagctcattcttttatttatttattaatattttttgagacagggtctcctgtcacccaggctggagtgcagtggtgtaatcatagttcactgcagccttgaattcctgggctcaggtgatcctccttccttagcctcctgagtaactgggactacaggcacataccaccatgcccagctaatctaggtctctgttttatttatttatttatttrtttgtttatttttcaatacagagttttgctcttgttgcccaggctgtagtgcaatggtgcattctcagctcactgcaacctccacctcccaggttcaagcaattctcctgcctcagcctcctgagtagctgggattatatgcatgtaccaccatgccctgctcattttgtatttttagtagagacggggtttctccatgttggtcaggctcatctcaaactactgacctcaggtgagccacccacctcggcctccaaaagtgctgggattacaggtgtgagccatggtgcctggcctatt

SEQ ID NO: 165010 - DNA, 601 bp, Human
ctgagaaatgaataaaatataagaacatcagagtggtgaggtcatcacatgttacgtagccactggaaaactctgctgtacactggtgagaggatgagagtgaaaaggacaaaggacaaataacttctttttttttttttttttttgagacagagtttcgctcatgttgcccaggctggaatgcagtggcgcaatcttggctcaccgcaacctccgcctcctgggttcaagcgattctcctgcctcggcctcccaagtagctgggattacaggcatgtgccacgacaccggctaatttttstatttttagtagagactgggtttcaccatgttggtcaggctggtcttgaactcctgatctcaggtgatccgcccgcctcagcctcccaaagtgctgggattacaggcgtgagccactgtgcccagcagaaaaggacaaataccttcttaaccttattccgaagttttgatttcacagacgcatgaaaaggtcctcgagagtcactgaattagataatcaagaacccttccaatactatggttttcgagcaggatttatcaatgttggcaccattgacattttcagggagatgattctttg

SEQ ID NO: 165011 - DNA, 601 bp, Human
tttgcccaccttgacctcccaaagtgctgggattacaggcgtgagccaccatgcccggcctcttcatagtgtttatcactatctgacattatattatttatctgttgagctttcttctcccattaaaatgtaagctccatgagagcaggaacctcatctgtcttatccattcctctgtccctttcacctaatatagtggctgggacacaataggcattcagtaaacgtgtggaagggagaggctcctaccagtaacatacactaagaatatttctgtgaggtttttcccacccagaaaagmctcaaacctaaaaaaaaaaaattctgaaccctaaaaaaacaaacaaaccaaaaaacagaagtcaagctagttataagaatcaataaccacagaagaatcctgaaatctatgatatcacaaaaggaccataattaggcaattatataaagaaaggattttcacccactatccactttataacacctctaaatcatatagcttctcttcggaaagttgtctggtcagttacaattcatccaaataaacaccagcataatttaatctctatgaaaaagaccaatatatagcctctaagaatcc

SEQ ID NO: 165012 - DNA, 601 bp, Human
agagtccccattcctggagtggaagagctagaactcaaatctggcagtccaacttcctagctgtgagactttgggcaagttacccttgtttagaattatagtgcatatttctccaataggttctttgaaagcatataaacccttcagagctaaaagaaatttgccaaacaagttagataccaatttacaagtctcctttttagtaaacacagcacctaaagggaaccttcccaagttttagctttatgtttactttcatcatattaaattctggactcttgtcctcaaactcatgaatttmgaatgatgttgagcaaaaggtctttttaaaatacaggacacagaggcatacggtacctatttatctttgttttctattcagagtgatggttttcctacaagtttaagtcagattaactgtttctcctttataattcctaataataggtacactcattgcattcagttactttatacccttgcttttggtaagtttcttaaaggagaaaagcaatatgattttaaagtaagaatgttgaacacatgaaaaagagtattaaaagttaataaaaatatgtttttaagctataaaatgacttaa

SEQ ID NO: 165013 - DNA, 601 bp, Human
aagccctcaaggagcagtaataatgcacatcccatttcagtatattttacattatcctgaattattcagttattttatagcagtaaatcctgtccctcctactgtcataagctccaacacagcagttttcaactgtcacttcataacaaactggtgtgccatggtaaattatagtatacagtaagtaatttgttactaataaaaaaagtaccaagtctgtgaatgaatgatatatatggatagattcaagattccctttagataacatttctgtcactcgtttgaactccagtatgctccyttgatcagatgatctgatgtatcccacaacccctagcagtgtgtcttttatatgaatgtcatctatcatgagtgtcatggtaggggacaccatgtgtattacttttcctctatctcctatcattccaagtagtgctgaatgcatattagattttcaataaatactgattaattatatcaaggtgaaaacacactgcaatagggacccaaaacatagcttaatctaattacagagaggccagtcctttagctcttccaaatcttgaacatatcagtcttctggatattccctcaaacccca

SEQ ID NO: 165014 - DNA, 601 bp, Human
agtagccattttctccacaaagctttccctgactataaaagccctcaaggagcagtaataatgcacatcccatttcagtatattttacattatcctgaattattcagttattttatagcagtaaatcctgtccctcctactgtcataagctccaacacagcagttttcaactgtcacttcataacaaactggtgtgccatggtaaattatagtatacagtaagtaatttgttactaataaaaaaagtaccaagtctgtgaatgaatgatatatatggatagattcaagattccctttagataacatttctgtcactcgtttgaactccagtatgctcccttgatcagatgatctgatgtatcccacaacccctagcagtgtgtcttttatatgaatgtcatctatcatgagtgtcatggtaggggacaccatgtgtattacttttcctctatctcctatcattccaagtagtgctgaatgcatattagattttcaataaatactgattaattatatcaaggtgaaaacacactgcaatagggacccaaaacatagcttaatctaattacagagaggccagtcctttagctcttccaaatct

SEQ ID NO: 165015 - DNA, 601 bp, Human
cgccattctgagtagcatgattaaatctcttgctgtcccgctctgcacaaccaggaacatgaatcatccctttgtccagtatatcaacgttgtctacactatccatccgttagtcacttagtagccatgtcagttatcagatcaaaaaaaaaaaaaaaacatagcatttcctgtatagggtttagtagtaactgcagttttaggcatctactggagatcttagaatgataccccctgagtgtaatgagggactactacacctttaactaatcatcatttacttttcaatcaaaatccaacytaaatgataaaaagatttgaacaagaggcatttctcctagtctcaggttacttaacttttacacatttaaaatagctattagtagccaggcacagtggtgcatgcctgtagtcccagctattcaggaggctgtgaggcatgaggatcgcttgaatccaggagttcaaaaccagcctaggcaacatagtgagacaccccccccaacccccgatcttgaaaataaagtagctattagtaaagcattttctcattcatcaaacctttgtttcatgcacactactgaatgaaatcaataatagt

SEQ ID NO: 165016 - DNA, 601 bp, Human
cctggtttcagttacccatggtcaattgagctctgaaaatattcaatggagaattccaaaagtaatcaattcataggttttaaaatgtacgccattctgagtagcatgattaaatctcttgctgtcccgctctgcacaaccaggaacatgaatcatccctttgtccagtatatcaacgttgtctacactatccatccgttagtcacttagtagccatgtcagttatcagatcaaaaaaaaaaaaaaaacatagcatttcctgtatagggtttagtagtaactgcagttttaggcatctackggagatcttagaatgataccccctgagtgtaatgagggactactacacctttaactaatcatcatttacttttcaatcaaaatccaacctaaatgataaaaagatttgaacaagaggcatttctcctagtctcaggttacttaacttttacacatttaaaatagctattagtagccaggcacagtggtgcatgcctgtagtcccagctattcaggaggctgtgaggcatgaggatcgcttgaatccaggagttcaaaaccagcctaggcaacatagtgagacaccccccccaacccccga

SEQ ID NO: 165017 - DNA, 601 bp, Human
cctgaaattgtcttaaaataacagcaaatgttgactttagtctccccttatccacggtttttgctttccctggtttcagttacccatggtcaattgagctctgaaaatattcaatggagaattccaaaagtaatcaattcataggttttaaaatgtacgccattctgagtagcatgattaaatctcttgctgtcccgctctgcacaaccaggaacatgaatcatccctttgtccagtatatcaacgttgtctacactatccatccgttagtcacttagtagccatgtcagttatcagatcaaaaaaaaaaaaaaaacatagcatttcctgtatagggtttagtagtaactgcagttttaggcatctactggagatcttagaatgataccccctgagtgtaatgagggactactacacctttaactaatcatcatttacttttcaatcaaaatccaacctaaatgataaaaagatttgaacaagaggcatttctcctagtctcaggttacttaacttttacacatttaaaatagctattagtagccaggcacagtggtgcatgcctgtagtcccagctattcaggaggctgtgaggcatgag

SEQ ID NO: 165018 - DNA, 601 bp, Human
tctcatttgccacaacatgttcacacatacatcccttcacagaaattatgggaataatagttgcttctgagaaggtggaaataaagatccccgatgattaatttatgctagcaagaagtagaacaggtatgcttaacccaaaaccttctgtttaggtttcagctcttgatcaacaacaaaaacctgaatgctgccattataaattgtcctgatttaatgaattcatatacacacttaacacagagctttgtacatagtaagtactcaatagatgttacctatttttattactgacactatyacaaataatatagcctccaaatggcttcaaatagtatcacagaaaaacatgagcactacctaaccaataacagagaaaaaattatcatggaaattacttatgtatggatagattagacaattgtgggtttcgtttttttcttttttttgatgtgagttaattcttgcttctaccctagagtctctctaatggtaaaatggccactcttggtgaacattaatgcaagagtccagtccacagaccattgcacagactctgagggatgaacagggatgaatggactacactttataattgagt

SEQ ID NO: 165019 - DNA, 601 bp, Human; identical to SEQ ID NO: 165010

SEQ ID NO: 165020 - DNA, 601 bp, Human; identical to SEQ ID NO: 165011

SEQ ID NO: 165021 - DNA, 601 bp, Human; identical to SEQ ID NO: 165012

SEQ ID NO: 165022 - DNA, 601 bp, Human; identical to SEQ ID NO: 165013

SEQ ID NO: 165023 - DNA, 601 bp, Human; identical to SEQ ID NO: 165014

SEQ ID NO: 165024 - DNA, 601 bp, Human; identical to SEQ ID NO: 165015

SEQ ID NO: 165025 - DNA, 601 bp, Human; identical to SEQ ID NO: 165016

SEQ ID NO: 165026 - DNA, 601 bp, Human; identical to SEQ ID NO: 165017

SEQ ID NO: 165027 - DNA, 601 bp, Human; identical to SEQ ID NO: 165018

SEQ ID NO: 165028 - DNA, 601 bp, Human
acatctagaaagagctccagctatgcctcagagagaaaaatcccaggagtggatgggaaaatatccatgcacagaaaaaaaaaaaaaaaaaaaaaaaggagaaaaggtacaaaccatcaggtaagtttctgacccaagtttaccaatcttgtttctcatttcacctaaatgtaaactaggaaaactacacaatccacaatataaattattgttacttgacttgtgactggtcagtctccaaatactcctttcccacagcatgagaaggaaaatatgtttcctatcagtccttctcacaacmgaagagagaaatgtggtttgtcactaatgaaacactgaaaatgtaccactgtcaccagttaacctaatctacaatctgctggttaaaagcaggtcagcctgaagcatataaaaagacgtctgcctttcaaaactggctaaagctgtcaaatcggatcgcaggttttacaaatacaatcacctaaattcagccctgctccataaaccagaaagcagaaccagcttccataactggccacgcagcctcccaccccaccccacccccgcccttgacagtgagtgggtcggagtagccacgatg

SEQ ID NO: 165029 - DNA, 601 bp, Human
atgaggtcaggagatcgagaccataccggctaacacagtgaaacccccgtctctactaaaaatacaaaaaaattagcggggcgtggtggcgggtacctgtagtcccagctactcaggaggctgaggcaggagaatggcgtgaacccgggaggcggagcttgcagtgagctgagatcgcgccactgcactccagcctgggcgacagagcgagactccgtctcaaaacaaacaaacaaacaaacaaaaaaaacagctattctacttagcttgacttcaaattttaaaaataagtcaaggtcaragtctttggcaaaccacaatgaatatctggaagtaatgtctatacacattagccaacgatgtggatagtaaaaattacttaatcattccatttttttctgttagctctacaaaattactgagtcctaaattccatcccccaccacaattataatttcacttaggccagacttgtaatctgtccacaaaactgttttccaactgctgcatagagcagcattcttctggctcaggttcctggaatttccccaaattcatgattttcacttgtttatgtctagatccccaaccgggagaaaac

SEQ ID NO: 165030 - DNA, 601 bp, Human
aacatactttcaaatggttcagaaagatagtattatgtatatatgtggaaagataaagcaaatgtgtcaaactgctaacatgctgggaaaaccaggggaagggttttgagatttctttgtactattcttgcaacttttctataagtgcaactatttcaaaatttaaaaagttaaatacaggtatatgtccctattaatatatgggtccactttagaagtgttgccaccatttcttttatgctagaaatccaaatctctccaacattcttaatgactttaaaacagctattctaggctgggygcggtggctcacgcctgtaatcccagcactttgggaggccaaggcgggcggatcatgaggtcaggagatcgagaccataccggctaacacagtgaaacccccgtctctactaaaaatacaaaaaaattagcggggcgtggtggcgggtacctgtagtcccagctactcaggaggctgaggcaggagaatggcgtgaacccgggaggcggagcttgcagtgagctgagatcgcgccactgcactccagcctgggcgacagagcgagactccgtctcaaaacaaacaaacaaacaaacaaaa

SEQ ID NO: 165031 - DNA, 601 bp, Human
ctctagctctttattatagatataaaaactatctttgttaacagatgactttaaagaccattgccacacacataaggatgaaagactttactcaatggcacaaatcagtcagaactaaaaatggaacttagataccaaatgcaagtcattgaacttatatcctaatagtttaacaaagtggtttaaaagaatacataaaatttaccatcttaacctttttttttttttttgaaacagcgtctcactctgttgcccaggccggagggcagtggtgctacctgggctcaatgcagcctcaaaygcccaggttcaagcaagtctcgtgcctcagcctcccaagtagctgggactacaggtgtgaaccatggcgcctggctaattttttttttggtagagatggggtttcgccatgttgcgcaggctggtctcgaactcctgagctcaggtgatccatctgcctcagcctcccaaagtgctgggattacaggtgtcagccaccatggttggccccatcttaaccatttttaagtgttaagtgttaactatatgcacatcgttaacagtttatggtaatcttttaactgtaattcctaactttatt

SEQ ID NO: 165032 - DNA, 601 bp, Human
ttttttttgagacagagtctcgctcagtcgcccagactgcagtgcagtggcgcgatctcagctcactccaacctccgcctcctgggttcaagcaattctcctgcctcagcctcctaagtagctgggattacaggcacgcaccaccacacccagctaatttttgtatttttagtagagacgggtttcaccatgttggtcaggctaatctcaaactcctgacctcgtgatccacccacctcagcctcccaaagtgctgggattacagacatgagccactgcacccagccggtttttttgcttyttaattaaaaaaagaaaaacagcaagaataagctataaaatctttctgagtcatacccaaaaggataatatataaagtcacctatccctattttaacatacattttgtaatttttaaaatgtatatttctgtactttaaatacttcctttaatccttttagtaataaaatatagcagcttttaatcatgaccagaaatgttatatgacattgactgtaatactaaaaacacagtcaatttacttcactttaagaaaggacaagactcttagtagacacattggcaggcatcataatttta

SEQ ID NO: 165033 - DNA, 601 bp, Human
atcaacaagcaaaaaacaaccctattaaaaaatgggcaatggacatcaacagacacttctcatatgtggccaacaagcatataaaaaaatgctcaacattaactaatcattagagaaatgcaaataaaaaccacaatgagacatctcacaccagtcagaatggctattatttaaaactcaaaaaacaacagatgctggcaaggttgcagagaaaaggaacgcttatatactgctggtgaggatgtaaattagttcagccactgcggaaagcaatgtggcgatttctcaaagaacttagaayattcgacccagcaataccataattgggaatatacccaaaggaatatgaaccattctaccataaagatacatgcatgtgcatgttcatggcagcactattcacagtagcaaagacatggaatcaacctagatgcccatgcaagggatggactgggtaaagaaaatgtggtatatatacaccatggaatactacacagccattaaaaagaatgagatcatgtcctttagagcaacatggacagtgctggaggccattatcctaagtgaattaatgcaggaacagaaaaaccaaacatggaat

SEQ ID NO: 165034 - DNA, 601 bp, Human
aaacgtctaataaccagaatctataaggaacttaaatcaacaagcaaaaaacaaccctattaaaaaatgggcaatggacatcaacagacacttctcatatgtggccaacaagcatataaaaaaatgctcaacattaactaatcattagagaaatgcaaataaaaaccacaatgagacatctcacaccagtcagaatggctattatttaaaactcaaaaaacaacagatgctggcaaggttgcagagaaaaggaacgcttatatactgctggtgaggatgtaaattagttcagccactgcgsaaagcaatgtggcgatttctcaaagaacttagaacattcgacccagcaataccataattgggaatatacccaaaggaatatgaaccattctaccataaagatacatgcatgtgcatgttcatggcagcactattcacagtagcaaagacatggaatcaacctagatgcccatgcaagggatggactgggtaaagaaaatgtggtatatatacaccatggaatactacacagccattaaaaagaatgagatcatgtcctttagagcaacatggacagtgctggaggccattatcctaagtg

SEQ ID NO: 165035 - DNA, 601 bp, Human
ctccacagcaatgatttcaaatatcctctcctgatgtttcttctttttcttttttggaaacaaagtctccctctattacccagtcttgaatacagtggcacaatcacagctctctgcagcttcaacctcccaggctcaagcgttcctcccatctcagcctcccaagtcgctgggaccacaggtacacgccaccatgtccagccaattatttattttttgtagaggcagggtcttgctgtgttgcctgggctggtcttgaactcctgggctcaaacgatcctcgcaccttggcctcccagartgcttggattacaggcatgagccactgtgcctgcctcctgatgtttcttaaactgccaacacattctgccccctactcttagaaggtagcctcacctcctacttcacaatgacaactaaagccatcaagggacctgatttccttttctgatactcaacatagaaattcctgtccctgccctattacaattcctgtccttgccctatcacaatggaagctgctgtggatcctttctcctgggtctaatcccttcatctgggatctagattccattctctcgaatctactcagagactgtaa

SEQ ID NO: 165036 - DNA, 601 bp, Human
gaatgcccccctacccaactttgctttaaccagattaaccaaactaacattgatggagcactgtactaagcagttttatacatagtatcctatttaaaattcctacaaagtctatgatggaggtactagtattactctgacttcacagatgaggaaactggagcttagcagctacacaggtaggaagcagagtcaggttattctaagtccaggtagtctgactccacagtttgagttcctaattaccagcacacatcaaagcaccaccatttttagctgttttatacatgggtcattcctstaagattgcacttggcaaacattcttgtgcttaaaaaaaaaaatagcattgtcagaaagaaaaatataatctcaaaagacctcttttcctgctctaaaaattctataactctaaaatcctattttaagcagaagagtagtacagaatatgactaaagagtaaaaaaatacatgtccattattgaaaaggttttaaaggaaacaaattttcattttattattttataacccattgcctctctacactttaggatcaatcctcttttaacaatagttatgagaggaaaaggagccaaattct

SEQ ID NO: 165037 - DNA, 601 bp, Human
aatttacccagagctggaaacttaaaaggagggtatgaattgaagggaagtcaggacagttcctggaatgaaatgaaagttcttagaaagcaaataccatacctgtttatattttgtatccccagaatcaaatacaatgtttgttttccaatgtacatctgcagaattaattatatggtaccctttcttttttcgttggaagagcatcatattttggaaaggactttgtaataaataaataattaaataaaattaataaaataattaaaaataaaaaataatttaaattatttaaatcacwtttcacaagaattgccagtaacaagctatttattaccaatatatatccggcatcatattttttattatgtttcacacatcatttgccataaaaattatgagatttccatcaccatttgaagaaaaaatccaagatttggtggcagaaggcccatacttgctgtaaattatagttctatcataagataaattaagtagttatcctaaggaaccatcaagcttttagaacttccaactggagattatatatactttttaaaagatttatcaaaattagatttataagcataaacaacaaaag

SEQ ID NO: 165038 - DNA, 601 bp, Human
tcaaataatgaagagatccaaaatgttgaaggctacagatcatgaagtacagtcaagtggggaaggaaggaagttcaggtgttctatcatgtgaaaagatgaggaatggcaccataggcataaggaaaaaataaaatcttggaactattcttatggaaaatggcaaagaaaagtgagaaaaagaggaactgtggatcaaatggcatggttacgtggcttaattcagcaataaccttaagctctggagctggagtgaagaaagcatagcatggaatttacccagagctggaaacttaaaagragggtatgaattgaagggaagtcaggacagttcctggaatgaaatgaaagttcttagaaagcaaataccatacctgtttatattttgtatccccagaatcaaatacaatgtttgttttccaatgtacatctgcagaattaattatatggtaccctttcttttttcgttggaagagcatcatattttggaaaggactttgtaataaataaataattaaataaaattaataaaataattaaaaataaaaaataatttaaattatttaaatcacttttcacaagaattgccagtaacaagcta

SEQ ID NO: 165039 - DNA, 601 bp, Human
ctgggattacaggcatgcgccaccgcacctggcctactaatattcttatctaataaaaattagaacgcaaattagccttctattgttaggaaaaatgtttaattacttcaaaacaactttcccactaatctacatctgataagaaactactatataactaaatgtaaattccttaaacagaacatattaactacctaactaggaactggtcaaattctactaccaattacatttggttacatactgtactcctacagtataggagtacagtataatcacaaataatgggtttgaaatcagycacgaaagttgatccctattgtttcagtcaaaatgcattcaataccaaaataattgataatggaaatatgtttttaaaatatgacactaaacagcagttttgccaggttttgactgttcaaatatgcttctggattcaaaaaaggaagcttgcagacagtatcttggaaccaaccaatatccagccctatctaatgcagactatcaagaaaccaccaatcattcatggtcatgtggaataattttaaacacaaggaacacaaagatgaacaagaatggtccctgtatatttcacaggaaa

SEQ ID NO: 165040 - DNA, 601 bp, Human
tgcaatgatgtcagaaatcggggcaacctcaagtttggctgctactctgggcaaaaggttctaaaagcaaaataagcagtgagttaacacacatacatagtgatggaagactataaatgatcagtaatgacatattctaaatgcatattctgtagaaattttaattcaaatattttatatttcgtgtgcacctttggatacacaacttcaagcacagctttttaaatagcctttgagattgagtacttaccattactctaactacattaagagtttcatgagttttacagtattaagccaycttaatgcaatatattgaactatgagatatgaaatttaataaacatcaattaccaagtgtgacagttgtggattattgaatttagataagaaaagatagaacaaatttagaagggtggtaaaattctcaaatactgaaaaagattatgcttgtatacatttacttaatgtatataaaagaaaaaaattcacagcagacatttcaccttttgtttaaattgatattgtataaaaaaaagagtaaggccaggtacagtggctgacacctgtaatcccagcactttgggaggctgaggatcac

SEQ ID NO: 165041 - DNA, 601 bp, Human
aggtcataaagaacaggtatgaatgtgctaagattttaagaggatttgagacactctggattagctatcacattaacagtaacctaaaccatgacaaaatattttccctcaaacattatggaagatgaaaagtctaatttcagaattagccattcatactggaatacacaactttaatcaggcaaaaaacgaagagttcactgccttctccgaccccactagagaccagtgtgctaagcaaaaaatcaactgaagagacactgaaatgaatttcttttctttttcttgagacagggtcttkctctgttgcccaggctggagtgctgtggcatgatcacaactcaccatagcctcgaccttctggctcaagcaatcctcccacctcagcctcccaagtatctgtgactacaggcatatgccaacatgcctagctaatttattttatttatttatttttgagatagggtcttattatgttgcccaggatagcctcaaactcctgagttcaagtaatcctcccacctcagcctgccaaagtgctgggattataggcacgagccactgcagctggctaaaatgaatttcttaatgcctatggaaa

SEQ ID NO: 165042 - DNA, 601 bp, Human
gttctatctataattgagaagccaaccatactctgcagaattcatggaagtccatcaataagatggcaccaagtggcaaagttatgcagataagatttataccatgctccccctggtgccagtgactaggtgtgcaacagaaaccccaaactgtgtattatgctcataatttcattttcctaattggttaaatgggaataatatcccaaacttcccaacttcttacatttgaaaaagatctgtgtacttctaaaataaatactaaaaataaaaaaaaaaatcaaagtattttcaatttacwtcttttaagattaatatttcacttaccaccagataccaccactttggcacctgttagctctggtcgatcactttttgttaatttctggtcaagccactctgatatttccactggtgaagtacttgatgctgcatacattaatacataataaaacaatgactatgatttcaagttctataacaagaattattttcaagagaaacacacaagtatataattccacgaaatttaagttaattactgtgaattttcagtgctcctaattaattctctctgataatggaaagacttaaggagact

SEQ ID NO: 165043 - DNA, 601 bp, Human
ccagctttatgaagtccccctgttggccagactcctcttctagctaccatccatttccctgcttccctatatagcaaaatccctcaaaaagttatctgtattcactgtctccaactccagccctcccattctatctctaaaaaccttttcattaaaatataacctacacacagaaaaagacaaatgtgctgctcaagagcattatcatacagtgaagacaaccatgtaaccactacctatgccttttattatttatttttttagagagggtcttgttctgtcacccaggctggagtgcagkggcataattacagctcactgcagccttaacctcctgggcttaagtgatttctcctgcctcagcctcccaagcagctgggaccacaggtgcacaccaccatgcctggctaattctgatattgtttgtagagacggggttttgccgtgttgcccaggctggtctcaaactcctaggcttaagcaatcctcccactttggcctcccaaagtgttgggattacaggtgcgagtcactgcacctggccagaattgttcttttaaacccactctaatcagacttttgcttccatcactccactgaa

SEQ ID NO: 165044 - DNA, 601 bp, Human
tgattaagcaacctctccagtttttccatagctcttctcctgtagttcagcattactggagaaaacatccaaatatccaaccatgtgaagtatattttcctctaaataaataaaccttaattcctggcagttatactaagttcccccagtcctttcattagctgtttcctaaactataatttcatatattttcttcttttcaaacttcctatacctctttagcatcctcattctcagctgatgactttgcttcttattcactgaaaaaaactgaaaggatcaaaagagaatttccacatgytccaagtaacacatctacccaccacctgcagctatgtccacattgtctcttgtctactcaaggacatcattccagtaattctgacttccctcaggggagaattactgagggagaataagggagtgacgtccttgagtgaagtgaaaaagtatgtgaagggaaggggaaaaagtgaagagaaaaaatatgactacttttccctctctactggagcattcccatcagcatagaagcatgttattacctgtcccagctttatgaagtccccctgttggccagactcctcttctagctaccatc

SEQ ID NO: 165045 - DNA, 601 bp, Human
tatgccttcaacttccttgttctcctcttatatcacaccacactcactcagaaaaacctccctcttccggctgattaagcaacctctccagtttttccatagctcttctcctgtagttcagcattactggagaaaacatccaaatatccaaccatgtgaagtatattttcctctaaataaataaaccttaattcctggcagttatactaagttcccccagtcctttcattagctgtttcctaaactataatttcatatattttcttcttttcaaacttcctatacctctttagcatcctcwttctcagctgatgactttgcttcttattcactgaaaaaaactgaaaggatcaaaagagaatttccacatgctccaagtaacacatctacccaccacctgcagctatgtccacattgtctcttgtctactcaaggacatcattccagtaattctgacttccctcaggggagaattactgagggagaataagggagtgacgtccttgagtgaagtgaaaaagtatgtgaagggaaggggaaaaagtgaagagaaaaaatatgactacttttccctctctactggagcattcccatcagcata

SEQ ID NO: 165046 - DNA, 601 bp, Human
cgcctgtaatcccagccacttgggaggctgaggcagagaactgcttgaacccaggaggtggaggttgcagtgagccgagattacaccactgtactccagcctgggtgacagagcaagactcatctcaaacaaaacaaaacaaaacaaaacaaaacaaaaaaaacttcaaaaataaaaaataagccttgaaaatgttgactacagcatcttaaaactgtgaatgaatatctcatagaatagagcactgggatgtaagatttttttttaatggacaagactgcatattgttttgaaatatataaaaaacatgttttcctgcatactatacaagtttaaactggctgagactcctattcactgaaaatctgtatcacctaagaaatataaacagtcattatcaactgtgattcaactttgagaccaaaatttcctgctcttccaagttttagacaggcttaactgaagaatattctagtatcacttatctatgtagaacagaattttctgaaattgatactataagacaaaatacagaaactaggtgttcaggaagatataagactaaaactgtcattcacagctcccaatttcaaaattctgt

SEQ ID NO: 165047 - DNA, 601 bp, Human
ataaatcaaaagtttattggccgggcatagtggctcatgcttgtaatcccagcactttgggagaccaaggtgggcggatcacttgaggccaggggttccagaccagcctagccaatatggcaaaacccagtctccactaaaaatacaaaaattagttgggcgggttggtgcatgcctgtaatccaagctactcaggaggctgagacatgagaatcatttgcaccctgaaggcagaagttccagtgagccgagatcacaccactgcactccagcctcagcgacagagcgagactatgtctcaaaaaaaaaaaaaaaaaaaaagtttgaggaaaactgggatatttacatcatttcaaagtacctccatataaaatatgtattacaatgggaaaagtaactttacagtggagaagttggcacatattgccttaatcaaaggattaaagtgaaaatcattaaatgaaagaccaaatgaaattgtataccatctgataggatgaggtatcacttctgtgatattcctgttcaagatatataatctaaattgaagacattagacaaatccaaattgagggacattctataaaacagctgtctggta

SEQ ID NO: 165048 - DNA, 601 bp, Human
gtaccataagtccatactgatataaacaaatgaataaatcaaaagtttattggccgggcatagtggctcatgcttgtaatcccagcactttgggagaccaaggtgggcggatcacttgaggccaggggttccagaccagcctagccaatatggcaaaacccagtctccactaaaaatacaaaaattagttgggcgggttggtgcatgcctgtaatccaagctactcaggaggctgagacatgagaatcatttgcaccctgaaggcagaagttccagtgagccgagatcacaccactgcacyccagcctcagcgacagagcgagactatgtctcaaaaaaaaaaaaaaaaaaaaagtttgaggaaaactgggatatttacatcatttcaaagtacctccatataaaatatgtattacaatgggaaaagtaactttacagtggagaagttggcacatattgccttaatcaaaggattaaagtgaaaatcattaaatgaaagaccaaatgaaattgtataccatctgataggatgaggtatcacttctgtgatattcctgttcaagatatataatctaaattgaagacattagacaaatccaaa

SEQ ID NO: 165049 - DNA, 601 bp, Human
caacccccacatcctcaccacctgtttctttgtttgatcatcaataaatagcatggcctcccagagcttggggcctttgcagcctccatactagagttggccctctgttcccactttctctcttaacctgtcttttctcattcctttgactcctccggattttgtagcccccatggcctggtgttgggtctgatcaccccaacaaaaagctatccaatcatcttaacagatgcagaaaacatctgacaaaattcaaaacacattcctaaaactctcagcaaatcagaaacagaagggaacytcctcaatttgataccattaagaaaataaataggtaagccatggactgtgagaaaatatttgtaaaacccgtatctaacaagaaacttgtaaaggaatatataaaatatgtctacaactcaataatgaaaacaagcaattcaactaaaaaagggcaaaagatttgaacaggcacttcataaggaagatgtttaaatggccaataatacaacgtgctcatcatcattagatgagcatcagattaattgcagggaaatgcaaattaaaaccagtaacatccaccaaaatgtctaaaacacca

SEQ ID NO: 165050 - DNA, 601 bp, Human
aaagctgccgtcaagaacaagcaatgatagctgtggcggttttacaaaaaagaaaaggggggcatgttgggagaagagctgagtgttgggagagaaactgaggcagggcttgcatgtctgacataatataaaagagttttggaatatgtctggggtccagggtctaaaatacctagtggcctttggaacatgtctaaacttgctggctccttgcttctagcacacccattatctcaagtagccatacgtttcaaagaaaatgctacaccatcacagctgtagctcatttgcttgatacatygcttcctttcaacccccacatcctcaccacctgtttctttgtttgatcatcaataaatagcatggcctcccagagcttggggcctttgcagcctccatactagagttggccctctgttcccactttctctcttaacctgtcttttctcattcctttgactcctccggattttgtagcccccatggcctggtgttgggtctgatcaccccaacaaaaagctatccaatcatcttaacagatgcagaaaacatctgacaaaattcaaaacacattcctaaaactctcagcaaatcagaaaca

SEQ ID NO: 165051 - DNA, 601 bp, Human
tgcttaaagagctaatcctactttaaaaactcacatacaaaagggaggggaccagcaatataagacactgcaaatgcaattgcatttagctttattaacattaaagtttttaaatttataaaaagatcaacccacgactgcagctgaacaactgacaggacaaaaggaaaataaaaaggctggacaagatatatgatggagggatgcacatacaaaaagctgggaaaaaggaaagataattatatggggaagacgatttgcttgtgtctctccaggtgacaaccaggtgtctgtgtgggtrcccaccaaacatctgaagatctatcatgagccacagcatctagtggacccacctgtacagtgcaaattgaaggtttaaggattgcttttttgcaatactattgcacaagaaggataagcctcgatttggtttctctatgccttctgttaatcagaaaaagcctgcttctcattaccaatggtaacttttaccccgcagtaattaaccaaagaggcagaagctgagttacaaatgcttcagcaatggcatgcctcccagctacagcaaaaaaaaaaaaaaaaagcctttgcttctgtttca

SEQ ID NO: 165052 - DNA, 601 bp, Human
tcagaaggacaaacagatcagactggattggagtatcatttttagcagtggccattgttgagcctctggctcccattcctcttgtttggctaactgccaaaccagtttgggtggagcaatggccactgaaacaggaaaaactggaagctttaaaataactggtgcaggaacaattgcaaaagggacatacagagcctactttctccccttggaattctcctgtatttgtcattaagaaaaaatcgggtaaatggagaatgctaacagatttgagggctgttaatgctgtaattcaaccgaygggcaagctacaaccagggctgccctccccaacaatgactccaaaatactagcctcttatagtgatagatctaaaggattgctttttttaccattcctttagctgcccaagattatgaaaaatttgcttttactgttcccgccataaataataacaaaccagtgcacaggtatcattggaaagtactgccacaaggcatattaaatagcccgactatttgtcaaacttatgtcgggaaagctattaagccagttggagaacagtttaaaaaaatgttatattatccattacatggatgat

SEQ ID NO: 165053 - DNA, 601 bp, Human
gactagtagatactggagctgatgtctctatttattgctttaaatcaatggcctcgacacttgcccagacaaaagacttccacgggtatcgttggcgtagggactgcctcagaagtttttcaagtcccttgattttaccatgtcaagggcgggatggcagggacaatccaacctattattacacctattcctgtcaatttatggggtagagacttattgcaacaatggggtgctgaaatatctattcctatggatcaatatagtgatattagtggacaaatgatgaaaaatatgggatatygctcaggagaaggactaggaaaaaataaaaatggccaatcagaaccttcagaaggacaaacagatcagactggattggagtatcatttttagcagtggccattgttgagcctctggctcccattcctcttgtttggctaactgccaaaccagtttgggtggagcaatggccactgaaacaggaaaaactggaagctttaaaataactggtgcaggaacaattgcaaaagggacatacagagcctactttctccccttggaattctcctgtatttgtcattaagaaaaaatcgggtaaatg

SEQ ID NO: 165054 - DNA, 601 bp, Human
ccctggtgtaagaaaggcaatcactgggcaaatcagtgccattctaaatttagcaaagatggacaacctctttcaggaaataggaagaggggcctgccttcggcccctcaacaaactgaggcatatccggcacagccagtgcccttaacaaacatacagctgtcccccgccacagcagacagtgctgccatagacctctgcagcacaattcctgtctccttcctagggagccaccaaagaaggtccccatgggagttaggggacccttaccctcaggaacagtcagtctattacttggaagttctagtctaaatttaaaaggtgtcactgtgcatatgggaataattgactctgatcataccagagagattcaactagttattagttcctcgactccgtggtctgcctccccaagagaatgaattgctcagttgttgctgctaccctacataaaactaggaagcagcacagtgaagagaacaggaggctttggtagtactaatccagcaggaaaagctttatattgggttaatcaagtgtctgataaaagacctatttgtatagtaactattcagagaaaggattttgaaggactagtaga

SEQ ID NO: 165055 - DNA, 601 bp, Human
caaaaaaggaatgtagaaatggaaatcaaaaggaaaaaccactaccatccatcaacagaaaagtcctggtgtatgtccctggtgtaagaaaggcaatcactgggcaaatcagtgccattctaaatttagcaaagatggacaacctctttcaggaaataggaagaggggcctgccttcggcccctcaacaaactgaggcatatccggcacagccagtgcccttaacaaacatacagctgtcccccgccacagcagacagtgctgccatagacctctgcagcacaattcctgtctccttcctrgggagccaccaaagaaggtccccatgggagttaggggacccttaccctcaggaacagtcagtctattacttggaagttctagtctaaatttaaaaggtgtcactgtgcatatgggaataattgactctgatcataccagagagattcaactagttattagttcctcgactccgtggtctgcctccccaagagaatgaattgctcagttgttgctgctaccctacataaaactaggaagcagcacagtgaagagaacaggaggctttggtagtactaatccagcaggaaaagctttatatt

SEQ ID NO: 165056 - DNA, 601 bp, Human
tgaagcatggcaaacccagcaagaaggacagaatatagctaattgggccactcttccttttaagttttaaaggaatttaagcaagccattattcaatatgaaccgaactctccttttgtgaaaactttgttgaaaaatgtggctcttgataataggttaataccatatgattgggatactttaacaaaatctgttctcactccgtcccagtacttgcagtttaaaacatggtgggctgaggaagctcaaactcaggcaagggaaaacacacaagtgcagtcacctgtgcttgtttcctttkaacagttactgggagttggccctaattggggtcgattagagaatcaagaagtaatggagggtgttgccattgttcagctgtgctctgtgtgcttatgggcatgggaaagggtaaatgttacagggggaaaaatatccttctttcagttgtctgacaaggacctaaagaaccatatattgattttattgcttggctccaagaggctgtggctgtatataaagccataactgataaaacagctcaggatgttataatacagcttcttgcatatgataatgctaatgcagagtgtcaaactgc

SEQ ID NO: 165057 - DNA, 601 bp, Human
ccagaagacaatggaacttaaaagtgctggggggaactatacctgaaattctatacctaagaatagatgtgtcaggacggccccggtaggcaccagtggcctttggaacatgtctaaacttgctggctccttgcttctagcactccccttatctcaagtagccatatgtttcaaagaaaatgctacaccatcatagctgtagctcatttgcttgatataccacttcctttcaacccccacatcctcaccacctgtttctttgtttgatcaccaataaatagtgtgggcttccagagcttgsggcctttgcaacctccatactagcgttggccccctggtcccactttctttcatcttttctcattcctttgactccgccggactttgtagcccccatggcctggtgttgggtctgatcaccccaatattcatggcacccaacatggggcgacaaagaccacagtgaaggaacgctagagcatgtgaaagcggaggatgcatcgtcagaggacacccagggacgactgaaagaagctcggtgaggaagctgagcgcttggaagaaccagggtaacaatgggatgaagttaaagcaaacattt

SEQ ID NO: 165058 - DNA, 601 bp, Human
aaatagtaacataaaacgtcccaaatgtggtaaaaggcatacatttatagatttaagaagcttgctatctgaagcaggttaaatacaaaaagacacacccctaggtataccataatcaaacccccttttttttttttttttttttttttttgagaaggtgtctcgctctgtcacccaggctggaatgcagtggtgcaatctcggctcactgcaagctccacctcctgggttcatgccattctcctgcctcagcctcctgagtagctgggactacaggcgcctgccaccatgcccggctaaytttttgtattttcagtagagacggggtttcaccgtgtaatccaggatggtctcgatctcctgacctggtgatctgcccacctcggcctcccaaagtgctgggttacaggcatgaggcaccacacccggcctatcataatcaaacttctaaagatctacgataaagataaaatcttgaaagcaacaacaaaaaacatacaaaggaacaatacaaataatggctgagctctcattagaaacaatgaagaccagaagacaatggaacttaaaagtgctggggggaactatacctgaaattcta

SEQ ID NO: 165059 - DNA, 601 bp, Human
acaagagtcagtgaccctgaaaatggaccaaaagaaatgatccaagctatagagtagggaaaaaaaagaggaaaaagaatcaacagaactccagcaatctgggaaagaacatcaagatatctaaaacatgtgtaactagagtcccagaacaaaagtgaggaaaaaaaaatgaagcagaaaaaatagtaacataaaacgtcccaaatgtggtaaaaggcatacatttatagatttaagaagcttgctatctgaagcaggttaaatacaaaaagacacacccctaggtataccataatcaaacccccttttttttttttttttttttttttttgagaaggtgtctcgctctgtcacccaggctggaatgcagtggtgcaatctcggctcactgcaagctccacctcctgggttcatgccattctcctgcctcagcctcctgagtagctgggactacaggcgcctgccaccatgcccggctaattttttgtattttcagtagagacggggtttcaccgtgtaatccaggatggtctcgatctcctgacctggtgatctgcccacctcggcctcccaaagtgctgggttacaggcatgaggcacc

SEQ ID NO: 165060 - DNA, 601 bp, Human
ttaaaagcatattaaaattatacaagagtcagtgaccctgaaaatggaccaaaagaaatgatccaagctatagagtagggaaaaaaaagaggaaaaagaatcaacagaactccagcaatctgggaaagaacatcaagatatctaaaacatgtgtaactagagtcccagaacaaaagtgaggaaaaaaaaatgaagcagaaaaaatagtaacataaaacgtcccaaatgtggtaaaaggcatacatttatagatttaagaagcttgctatctgaagcaggttaaatacaaaaagacacaccmctaggtataccataatcaaacccccttttttttttttttttttttttttttgagaaggtgtctcgctctgtcacccaggctggaatgcagtggtgcaatctcggctcactgcaagctccacctcctgggttcatgccattctcctgcctcagcctcctgagtagctgggactacaggcgcctgccaccatgcccggctaattttttgtattttcagtagagacggggtttcaccgtgtaatccaggatggtctcgatctcctgacctggtgatctgcccacctcggcctcccaaagtgct

SEQ ID NO: 165061 - DNA, 601 bp, Human
tataaagcctagaataagaaagtccctggataggtttaaaagcatattaaaattatacaagagtcagtgaccctgaaaatggaccaaaagaaatgatccaagctatagagtagggaaaaaaaagaggaaaaagaatcaacagaactccagcaatctgggaaagaacatcaagatatctaaaacatgtgtaactagagtcccagaacaaaagtgaggaaaaaaaaatgaagcagaaaaaatagtaacataaaacgtcccaaatgtggtaaaaggcatacatttatagatttaagaagcttgytatctgaagcaggttaaatacaaaaagacacacccctaggtataccataatcaaacccccttttttttttttttttttttttttttgagaaggtgtctcgctctgtcacccaggctggaatgcagtggtgcaatctcggctcactgcaagctccacctcctgggttcatgccattctcctgcctcagcctcctgagtagctgggactacaggcgcctgccaccatgcccggctaattttttgtattttcagtagagacggggtttcaccgtgtaatccaggatggtctcgatctcctgac

SEQ ID NO: 165062 - DNA, 601 bp, Human
tgacaagtctgtagacatgactgtgtttcctgctttacttctattgtccagtattgatatcaaggaatcactgaagaatatttttacatgaatccttggcaatgaacacaagtggtgatgaaatactcaaaaggttaaatagctttttggaatcccatggtttattctggaaaaaccaaattgacatttgcactgatgatgtgaaaatgatggtgggtaacactgccttagtggtagtttcaagtcagtggcaccaaactcactgcattcttcatggccacatactcacagttttttgttkttttttttttttaaagccactttcacctaaggtccttgataaagcagtaagaattattaaccttggcagagcacggtggctcacacctgtaatcccagcactttgggaggccaaggcaggtggatcacttaaggtcaggagtttgagatcagcctggccaacatggtgaaaccttatctccactaaaaatacaaaaattagccaggcatagtggttcacacctgtaatcccagctactcaggaggctgaggcaccagaatcacttgaacccgggaggtggaggttgcagtgagccaagat

SEQ ID NO: 165063 - DNA, 601 bp, Human
ctaaactggattttattttaacataaatgacatgagtttaagagccaaaagctgttattttagcttttcaagctagaaaagaaaaagtcactgaagaatcttaagttatcatatttcattggttagagaagtatagttgctgagagactaataaaggtgacattgctgaattcctgctttgaaaaatcaggaaaacaaatcatggcactgtcacattccagtggtacgtaacttgctgaataaaatatttagctgtaaacatgaatatgaagataatatttcatctgcaaaattatacttytgcctgacaagtctgtagacatgactgtgtttcctgctttacttctattgtccagtattgatatcaaggaatcactgaagaatatttttacatgaatccttggcaatgaacacaagtggtgatgaaatactcaaaaggttaaatagctttttggaatcccatggtttattctggaaaaaccaaattgacatttgcactgatgatgtgaaaatgatggtgggtaacactgccttagtggtagtttcaagtcagtggcaccaaactcactgcattcttcatggccacatactcacagttttt

SEQ ID NO: 165064 - DNA, 601 bp, Human
tttttttatccacatgtagataagctggatttttgtttgtattgctttgcttatgtagaaagtacagtaagtttacttgtgaagtagaaggaatggtcagtttctgagagtaagataatgatactaaataaggggttttaaaaggggtgacaatttaaaataaagtagttgaaatactaatagacgacaaaaatcagaattcagttcccatagacacatttgtagagatctggggctatgcaattcaacaattttctctggacagtagttctgataatgtgctcagggcgctagtcattcygcacaggtgtagtacagactgtctcaggaaaatgagaaagggcgagagctgagctagtagcactctagatataccaccccacttcaactccactttttcccatattatacatggggcttcctgataaaatttcctttgaagaagggttctacaactagatcactagtcactaccctagaataagcctgaacagcagatacgaaatcacataatttctgcctctcacgaaaatgcacttaatattaggcaattagtgtacactgagggacattattaaaaacgcagtcctatgaaaccact

SEQ ID NO: 165065 - DNA, 601 bp, Human
agacatattagcaaaattaaaaagggaggccctctttttttatccacatgtagataagctggatttttgtttgtattgctttgcttatgtagaaagtacagtaagtttacttgtgaagtagaaggaatggtcagtttctgagagtaagataatgatactaaataaggggttttaaaaggggtgacaatttaaaataaagtagttgaaatactaatagacgacaaaaatcagaattcagttcccatagacacatttgtagagatctggggctatgcaattcaacaattttctctggacagtmgttctgataatgtgctcagggcgctagtcattccgcacaggtgtagtacagactgtctcaggaaaatgagaaagggcgagagctgagctagtagcactctagatataccaccccacttcaactccactttttcccatattatacatggggcttcctgataaaatttcctttgaagaagggttctacaactagatcactagtcactaccctagaataagcctgaacagcagatacgaaatcacataatttctgcctctcacgaaaatgcacttaatattaggcaattagtgtacactgagg

SEQ ID NO: 165066 - DNA, 601 bp, Human
tctttacaaccctaacttaggaatgatttcttaaataagacacaaaaaatacatatcaaaaaggaaaaaaataagttgaaccacattaaaattaatgctctatcaaaaggtattattttttaaaatggaaaagacagacataaatgaaagaaaatgtatgcaacacacataaccaacaaaagatgtgtatccagaatacataaagaacttccaagaatcagcctggccaacatggtgaaaccccatctccacaaaaaatatacaaaaattagccaggtatggtggagggcacctgtagtcycagctactcaggaggctgaggtgggagaattgtttgaacccaggaggtagaggctgcagtgagccgagattgcaccactccactccagcctgggcaacacagtgagaccctgtctcaaaaaataaaaaaaaaaaattccaagaatcagtaagaaaaagataacttaatagaaaaatgagcaaatggtattaacattaaatattcaaagggaaaaaaaccataaatggatattccgcatatgtaaagatatctcactagtaatcacagaaaagcagataaaaagcacagtgagatttcatt

SEQ ID NO: 165067 - DNA, 601 bp, Human
tttaaaaaaacaactatcaaggatttgtaggagtgcacatttaaggtgcttatgaatctaagagagaccatccagtctactcagcagctgtatctcagctattttcctgacaggaccatatcttatgctcacattctataaccacgagcaaaaggaacacaaggagacatacatttttttagattttttttcatctaagactgcagacaatggttcacagccatctatttctggacctcaggagtggagaaaactgtccatcacttcttaggatccaatagtaagctcctttgctagaatstttccatacattttgactcaccactgaaccgcaaccatgataacagccccttctcccacttctcaccaccaaatctaactcaggcaactctttaatcagtacatttttttttacgtggtcttggttattcactaagagttatttgcattcatcatgtatctttaacatattttctcattgcttatttacattatggtacgtgtttggagcagtgtagaagaaataactgatactgtacagtttccacactattctgtccaaaaacataccaaataatgagtgtaataagtgttaagtaac

SEQ ID NO: 165068 - DNA, 601 bp, Human
gaagatatgtctgtgtatgtacaacatccaagaaaatctacagataaattagtaagagcagtatataaatatcaattgcattcctatatatctacatacttttataacaaaaattatgaaactgcctaaacaagtggagaaataaaatcatggtcacagatagaagatcaaatgttgcaaagattttgactctttccaaattaatctatacatccaatgttcctcacttgaagaattttcgctatctgaatatttgttacaatatgtactttttaaacccaggagtcactattcaaatttaaaaaaacaactatcaaggatttgtaggagtgcacatttaaggtgcttatgaatctaagagagaccatccagtctactcagcagctgtatctcagctattttcctgacaggaccatatcttatgctcacattctataaccacgagcaaaaggaacacaaggagacatacatttttttagattttttttcatctaagactgcagacaatggttcacagccatctatttctggacctcaggagtggagaaaactgtccatcacttcttaggatccaatagtaagctcctttgctagaatcttt

SEQ ID NO: 165069 - DNA, 472 bp, Human
ggatcgcttgaggccaggagtttgagaccagcctaggcaacacagcaagaccccatctctacaaaaaataaaaaacaaattagctgggtgtggtgggacacatctgtgatcccagctacttgggaggctgaagcaggaggatcacttgagcccaggaggttgaagctgcagtgagatgtgatggcaccactccactccagcttagctaatagagtgagaccctgtctcaaaaaaagtttatttggctgggcgcagtggctcacacttgtaatccaagcactttgggaggctgaggcaggcrgatcacgaggtcaggagatccagaccatcctggccaacacggtgaaactctgtctctactaaaaaatacaaaaattagccaggcatggggggcgggcccctgtaagtcccagctactcgggaggctgaggcaggagaatggcatgaacccgggaggcagagctggcagtga

SEQ ID NO: 165070 - DNA, 601 bp, Human
atgcatttggaagaaaagcaggggcccttatctagcctctgaagatttttcacatgaatggagattccatggctcagtagatggacttggttctttttagtgatagaatatgtagtcaaagattctttgaaatcttaaattcaaattcattcttagatataagctcctccatattcttttaatcagcctaccttttctcccaggacatatagggaactaagcaaatgtcttcttcacatctagtctaatatgtccagagcaggtgggatgtatatcactagcacacacttcattatgtacstcacattttttgttcaaaatgtaaatttaataacccagttgctcaactacaaagttaaaagaatttttttaaaacaaggacattaactatattgtgaaacacaattcaaaaatttaaatgtaaatcagaaaaaaagtgaaatttcaacccttggcctttcaatgttttctaattgtagatttcaattatgcaagatgtataggacctgaaacaagttttttttttcttaagagaatagtttcacattcaaatataacttcagctgtgctcagtggctcacgtctataatcccaactactt

SEQ ID NO: 165071 - DNA, 601 bp, Human
cagtctgttaaaagtccacaaagtatatttatcttagagaaagatccctaaaacaagatgagacctggtgaagagccaactgaagtttgtacatattaaaaaaaaaaaaaaaaagtattgtcaattttagctaacattagcttttactccatgttgctaaaagtatcagtttgtacattagctctgtgtctccttatcatgaataatgacaagctacactgtttagatttattgctctatcaaccacttgcatgtcaattagaaagcctctaatgcacacccaccacacacatgcaccagytggaagcccttcaaggagactgactcacaaaagaggcaaggctccgaaattatttttgttgttgttgttgatgatgtttctttcttttaatttatgtaacctgcactgaaaattaatactttccagctaaagattttgatctggctttcagtgaagtcaatatctggttccaaataactgctaaagggaaatgtctagaggcaaagccagaaaatgcatttggaagaaaagcaggggcccttatctagcctctgaagatttttcacatgaatggagattccatggctcagtagatggact

SEQ ID NO: 165072 - DNA, 601 bp, Human
gcccgtattatgaaattctcaggtgggattctggctaaactgagtttcacatgaagggaagattttacccatactcttggtttgaagctgaaattatatcccatccatgagacaacacccctttactaagattagctcctgttttattagaattcaagacaacacactagtcatcacagctatatgtactgtctatgttacgccagtaactatgctgtactttatacacacgacctcatttaactatgacaacaactctatagggtagaaatgattcctattttatagaagagaaagcagmgtctcaggcaggcttgctgagttgtccaaaattatacacacctagtaaaaggcaggttctccctccccagctttactgaggtatatttgacacataaaaattatatatatttaaagtatacaatgtgatgttttgatataggtaaacattatgaaataattaccacaatcaggctaattaacatatctatcacatcacaattactttttgtggtgagaacacttaaaatttactctcttagcaaatcttaagtatacaatccactcttattaactatagtcaccattctgtacaatagat

SEQ ID NO: 165073 - DNA, 601 bp, Human
ttctctttttggaagaggccccaaaactcaaagcacaactatctgtggctcttttctcaaacagctctctgcccgtattatgaaattctcaggtgggattctggctaaactgagtttcacatgaagggaagattttacccatactcttggtttgaagctgaaattatatcccatccatgagacaacacccctttactaagattagctcctgttttattagaattcaagacaacacactagtcatcacagctatatgtactgtctatgttacgccagtaactatgctgtactttatacacaygacctcatttaactatgacaacaactctatagggtagaaatgattcctattttatagaagagaaagcagagtctcaggcaggcttgctgagttgtccaaaattatacacacctagtaaaaggcaggttctccctccccagctttactgaggtatatttgacacataaaaattatatatatttaaagtatacaatgtgatgttttgatataggtaaacattatgaaataattaccacaatcaggctaattaacatatctatcacatcacaattactttttgtggtgagaacacttaaaatt

SEQ ID NO: 165074 - DNA, 601 bp, Human
gctgagcaggctgcacactgaataactctgaaggagggcaccactcttaacagtcactatagccctgcatttttattacaataactttccaacagatggcagtaaagtaacttgagacaccagtactttataatttgtacaaaagagttgtgtggacttgaagtactgggtggccagaatcccctgtggtacaaatattctaactgtctaagtgtaccataataggaaagagttgagcagcactgggtaactgattttactgttgttgatattcttactgtaccttacaggtaatataaasatgactaattctctgtgccctgtcctcaagaagctcacagtctaacaattacaggttacggcaaggtcacaaaaatctgtaatccaataaaggaaaatggaaaagaggtgtgatagagctacagtctctcatcagcccctcactttcctacctgccactgagaagtggaaaagccgttaggagcagaaaacagattaggggacaatatctttaccttctgacaaacaggggcccacttttgccatctatccccatctgttcctgctcccttaagtcctttagacaaaacaagcttttaaa

SEQ ID NO: 165075 - DNA, 601 bp, Human
ggctcgtccttagcatagtatcagatttcccaagacacattgatgtgtcactcacgggttgaggtttattcaaatattgattttctcagcccactaggtggccaggtgggctcctgaggtagcctcaggactaccatgtacagctgagcaggctgcacactgaataactctgaaggagggcaccactcttaacagtcactatagccctgcatttttattacaataactttccaacagatggcagtaaagtaacttgagacaccagtactttataatttgtacaaaagagttgtgtggactygaagtactgggtggccagaatcccctgtggtacaaatattctaactgtctaagtgtaccataataggaaagagttgagcagcactgggtaactgattttactgttgttgatattcttactgtaccttacaggtaatataaacatgactaattctctgtgccctgtcctcaagaagctcacagtctaacaattacaggttacggcaaggtcacaaaaatctgtaatccaataaaggaaaatggaaaagaggtgtgatagagctacagtctctcatcagcccctcactttcctacctgccac

SEQ ID NO: 165076 - DNA, 601 bp, Human
gtttaccgtatcactgtggttaagaacctaggctctgtagcctcattgcctccattcaaatcccacctctgccatctgatagctgcatgaccatgggccattcatgtaacctctctatgcctcagactgctcatccaaaacactggaattataagaactcctgctttatagggttactgttgaggctcgtccttagcatagtatcagatttcccaagacacattgatgtgtcactcacgggttgaggtttattcaaatattgattttctcagcccactaggtggccaggtgggctcctgargtagcctcaggactaccatgtacagctgagcaggctgcacactgaataactctgaaggagggcaccactcttaacagtcactatagccctgcatttttattacaataactttccaacagatggcagtaaagtaacttgagacaccagtactttataatttgtacaaaagagttgtgtggacttgaagtactgggtggccagaatcccctgtggtacaaatattctaactgtctaagtgtaccataataggaaagagttgagcagcactgggtaactgattttactgttgttgatattctt

SEQ ID NO: 165077 - DNA, 601 bp, Human
gcttgtaaagaaagctccccaggatactctgatgtatagccagagctggagaaccactacaataagtgatccctcagctctttggcagcctgaatctgacaactgtctagccccctgcagtactccctgatctttacaagcataaagtgtccaactgctcctagagcagcaccatgtaacctggaaaaggaaacaatctagtccccaaagtgagttaatcatctaaaaatgagatgagcttgttttttgaatcaacttgttctatagttaccaaaagcctgaagacaagaacaatttggcrtaataagactgtgtcttagggtggggaggaatgctgcagaaagtatggatgaggataaaaagcaattgcatgctctgtgattctaccttcaatgtatccagtgtgtcaattgtgaccctacatagtcggacaatgcaaggaggccctgacatcatactgtctctcagacatggacacttgcataagtagtaaacttcttccactactttctatttaagatttagaagtaattcaataggcttttttttttttttttttttttgagatggagtctcactctgtcacccaggctggagtgca

SEQ ID NO: 165078 - DNA, 601 bp, Human
ctgttggcatggggtgagaattttcactggtatcttcttgacaggcagaatcttttatttttagagaagcagaattctagctatgtctgaactggtctggctaaaaatatactttaaggctgctggtgttggagtttctttcttttatttatttattttttcttaatgcagcaatcacattttccccattggcactgctgttttcatagttcagtaaagaaacctaccatccaactgtaaaatctgactggttttgggccagttcatttagaagctacaaagaggtagtgcatgcatttcraattagaagaagttaagcctgttaaaagttttataatcttttatatcaagcttccatctgaatggataaatgcaggaatgtcagaggcatctctgacttcatgaaaggtaagttcataattcaaactatatattattatgcatgaattaatgtgtcatattctgaaatatatgttcagaatcattacacaggactttcagagtagtccaagtagcaagttaaaatcaagtgtttcctggccgggcgcggtggcttatgccagtaatcccagcactttgggaggctgaggcaggagaatgg

SEQ ID NO: 165079 - DNA, 601 bp, Human
agggaatgcaactgtcagatttaaaccattctaatatcccattttagaactaaagactgtctcctatgcagataatggggctatgacaacacaggacgacacagacaacaggataagacagtgacaacaagggctatatctttttaagcattcccagcttctagtacaaggaatggtcttaataaacatctgttgactagatggagatacaaagtcttggctgacccccaacaccagtctccttacttcaactgttccctatttgctctgacgtacactacctagtgtctctcccacaatycagccctgttggcatggggtgagaattttcactggtatcttcttgacaggcagaatcttttatttttagagaagcagaattctagctatgtctgaactggtctggctaaaaatatactttaaggctgctggtgttggagtttctttcttttatttatttattttttcttaatgcagcaatcacattttccccattggcactgctgttttcatagttcagtaaagaaacctaccatccaactgtaaaatctgactggttttgggccagttcatttagaagctacaaagaggtagtgcatgc

SEQ ID NO: 165080 - DNA, 601 bp, Human
caggattctaattaaaattgcagcttgcagggaatgcaactgtcagatttaaaccattctaatatcccattttagaactaaagactgtctcctatgcagataatggggctatgacaacacaggacgacacagacaacaggataagacagtgacaacaagggctatatctttttaagcattcccagcttctagtacaaggaatggtcttaataaacatctgttgactagatggagatacaaagtcttggctgacccccaacaccagtctccttacttcaactgttccctatttgctctgacrtacactacctagtgtctctcccacaattcagccctgttggcatggggtgagaattttcactggtatcttcttgacaggcagaatcttttatttttagagaagcagaattctagctatgtctgaactggtctggctaaaaatatactttaaggctgctggtgttggagtttctttcttttatttatttattttttcttaatgcagcaatcacattttccccattggcactgctgttttcatagttcagtaaagaaacctaccatccaactgtaaaatctgactggttttgggccagttcat

SEQ ID NO: 165081 - DNA, 601 bp, Human
ggtggctcacgcctgtaatcccagcactttgagaggccgaggtgggcagatcacaaggtcaggagatcaagaccatcctggctaacacggtgaaaccccgtctctactaaaaaacacaaaaaattagccgggcgtggtggcgggcatctgtagtccaagctactcgggaggctgaggcaggagaatggcgtgaacccaggaggcggaggttgcagtgagccgagatcgcgccactgcattccagcctgggcgacagagcgagactccgtctcaaaaataaataaataaataaaataaaatmcaatagaataaaataaaacaattattctgggatattctaacaatatgaaagctaaagtatcttgtcagcctgttagtaagggacgttaaacagctttaagtccttatgtacatagcaaatagattaataaaagaagcaaattacttatatctcttataaaagctgtcaaacatttctcttatttgctataaaaatattcttaaatgcaggccaggcatggtaactcatacctataatcccagcactttgggaggtggaagtgggaggatcacttcagcccaggcgttcaagaccagcctg

SEQ ID NO: 165082 - DNA, 601 bp, Human
cacaaaaattaggctaaaaaagtcctttctgtacgctattatttgacttctattttctttagatcataagccaaaataggtaatgctaattaattctcacccataatttgtataattaattgtatttcttaatgttatataaagatattaccttatatgtttcttaatgttatataaatatattttttaaaattataattttaaaatataattacaatacataaaatacaaaaaataaaaataaaatattaaaaatataaaatatataacattaagaaatataattatacaaatattgtattttttattttttaatcaaaagtattaaatatttgatttttaaaatattttaaatatttgattttttaaaaacgagatcgccccagtaaggaatatattcaccaaaccactttgtctgtgctcttgtgtcagaattactacagtattcacctacaataagctcattctgatttcagctgagaaaacaacttcatgcgtactctgtaggttcctagagtctgtcaaaggtgcgatttttactgcaccttatccaaggtacaatagtagtggtgagccacccagctgtagtacctgctgagcc

SEQ ID NO: 165083 - DNA, 601 bp, Human
atgtccagagattaaataacttagccaagataatttaactagtatgtggccaaggcagaattggaattaaagctcttaattactataacatattatttctgagggaaaaacaaacttgtcctttataactaatgattgttgaagggtcaagcaaaacaattaatataagagaataaaatgttatgcatattcatttttactccagatacggttctacttggtgagcaaaatatcacctagggaattattagtctaacagctgtatatacatgttatacatgatacaatttgcaatttaaarttttcacacaaaaattaggctaaaaaagtcctttctgtacgctattatttgacttctattttctttagatcataagccaaaataggtaatgctaattaattctcacccataatttgtataattaattgtatttcttaatgttatataaagatattaccttatatgtttcttaatgttatataaatatattttttaaaattataattttaaaatataattacaatacataaaatacaaaaaataaaaataaaatattaaaaatataaaatatataacattaagaaatataattatacaaat

SEQ ID NO: 165084 - DNA, 601 bp, Human
atccataatatataaagaacactaacaactcaagaacaaaaagataatgtgatttaaaaattacaaaggatctaaataaactttctccaaacaaaatatacaaatggccaataagcagatgaaaagatactaaatgtcatttgccatcagggaaatacaaatcaaaaccacaatgagataccacctcacactcattagaagggctatatttaaaaagacagacaataacatacattaatgagtatatagaaaaactggagccctcacaaatttttggtgggaatgtaaaagggggcagccrctttgaaaacaacctgacggttattcaaaatgttaaactcagagttaccaggtgacccagcaattccattcctagacatccatccaaaagaaatgaaaacataggtctgcacaaaacctcatatgtgaatgttcatagcagcatcattcataatagccaaaaaggggaaaaacccaacatgtccatcaaatgataaatgaatgaacaaaatgttacatacccctacaatggatattatttggcaagaaaaagaaacaaagtactaacacaggctataacatggatgaactttgaaaacct

SEQ ID NO: 165085 - DNA, 601 bp, Human
agctgtccaagggggctgcagggaatgtcacacagatactctgaaaactggtccagccacttgtgcaaaatatcaattacccagtcttccaaggggctttcggctgccttagctcacaaagattccagctgaactcaccactgatgaatacagcctctcaattatttaagagagctacatttccattaggtggaaataatgtgttcgtacaaaatttattaaggaaattgtcgacatgttgtttcttccgaatgtcactgtctccagcctattaaaaggcccatgtttaccatggagccarcaggcatttgctcaggggtggcattaagtgctggcaccacttctcccagctttcctcagtggagagaccatgagctcatgccagtcacacagatgacatgctaactgagtttcacacgggacctgtatatttcatgaaaaataagataaagcccaactacttttaccacgaagtgaaacactaatttggtttagaatatataactttttaaaattttaccgaatatatccttaccacactccccatgaaagggttgagaggattttctctatcatctatctttttttattagatcaacca

SEQ ID NO: 165086 - DNA, 601 bp, Human
ccttttcccattcccttccaacaaaacatccccaaacttcaacctgtatcaaattccatcaaaagaagccgctcaaaccagcaccctgtcagcaattaaacacaatccgaaaagaatgaaaaggccgaacctggccgtacattgatgtacatgttatgtgataaatgccagagccttggatctcattaatgtcctcaagccattgttctctaagtccagtgagactcattgacctttaaaatcaccctgattagtgaaacctctcacttctcccatccagggtgtcccattttccccagamcctgggaatggcatgggaactgctgtgtgggagactgcaagaaggagaccctggagctaaagccaaagggtggtcctcttgggagagagcttaccacctgtttaagccaggactgtgcagaaagggagagtccaaagagcagtctctcactggtctggcttttgtgaactagcctcctaactgtaaccacctttgctagataatcagacccaaacctaaaatccccagcccgagctcccaccatctctaggtccagaggaccaggaataagcaaataaaaccaagcgatagaattccagt

SEQ ID NO: 165087 - DNA, 601 bp, Human
ttttttttttttcctgaaactcatcagctttttgctagaatcaaactttgagacttggtacttttctgaatatgggtctctggaccagtgagcaaatggctttccctttgagcctcctcctggccttagactcctctggctgtagttaataggagagcaacaagtcctttccaagtaaaatggacaagaaaatgcctgctaagcctgggcctcctggcttgttgtcactcccttttcccattcccttccaacaaaacatccccaaacttcaacctgtatcaaattccatcaaaagaagccrctcaaaccagcaccctgtcagcaattaaacacaatccgaaaagaatgaaaaggccgaacctggccgtacattgatgtacatgttatgtgataaatgccagagccttggatctcattaatgtcctcaagccattgttctctaagtccagtgagactcattgacctttaaaatcaccctgattagtgaaacctctcacttctcccatccagggtgtcccattttccccagaccctgggaatggcatgggaactgctgtgtgggagactgcaagaaggagaccctggagctaaagccaaaggg

SEQ ID NO: 165088 - DNA, 601 bp, Human
gccagcaaggactgagacgctgttctgcaccagccccgtgcactccaggtgcctcccgtggaccctacggggcaggggctaatattacagcttgggatccagatgggaaggtgaggatcaagtgacaaagtgcctctccgtggtcacagagcatggcagagttggaattctctaagtccatcgcattcctcatttagggtgtagctatgagaagggacaagctctttgctgtccactttatctcaattatttctctcttctcttgaagagaatccagtgggttgggaactattagttccayttccagatggggaaaacagaggctcagagtctaaaagactgggccaagaccaagaagcaaggaaacagcagaataagatttcagagtcagtctgctgaccacgccacaaaccatcctgaggcctaaatatgtatcgagtgtctttcggataacctcccaaactctcacattcctgacgttgaaaccatttcagaagcttttgccccacactcgaaagtgtaaagttcacccttgtgggtctccaggtggttggcaaagggagcccctgaacctggaaaagcggtgccccttgttaggtgt

SEQ ID NO: 165089 - DNA, 601 bp, Human
ccagcatggaataataatggcttgatttaacattgcaattatctctctgagcactttagcgcatatgattacccctatttgatgaaagaggaaatgggaaaaggtagaaatgaagtcacttgtttaaggtcatatcatgagtcacgagggaaatggagacagaactccagcctcccacacctgaaccgtgactcccactaaagagatgccattgtttcaatgaccctgcaatgacaaccatcctaacagccagcaaggactgagacgctgttctgcaccagccccgtgcactccaggtgcytcccgtggaccctacggggcaggggctaatattacagcttgggatccagatgggaaggtgaggatcaagtgacaaagtgcctctccgtggtcacagagcatggcagagttggaattctctaagtccatcgcattcctcatttagggtgtagctatgagaagggacaagctctttgctgtccactttatctcaattatttctctcttctcttgaagagaatccagtgggttgggaactattagttccatttccagatggggaaaacagaggctcagagtctaaaagactgggccaagacca

SEQ ID NO: 165090 - DNA, 601 bp, Human
attgctgaaacagagactgtagggccaagaaagcccaaaatatttactctctggtcctttacagacaaggtttgctgaccgtactttgactggttttataaacattttatgattctaatagtttttaagctaattttcttgagtcctcaggcacttgaacatattcttaaataataaaacattttttatgtcttgctagtggatggatctcttgccaggaggtcaggtgggtttcctgatggaagaggcaggaagcaactggccccattcttcagccctgagccctttctagttgcctggrctgctctcctggcaaatactgagaggacctggggaggcttgccttgggatttaccttttccttgagagggaaaggcatgggctctgcggtcatttggtgccacctcctccacaagcctcagtcttctcatctgtgattggggtgtatcatcttcctgcactgagacagcactgcttaaagggccagcacaaggtagaccctcttttcacccagggcccagagttccttgaaagggaatgatctttttgacgtcttggcttctcgatgatatttctatattgtagtcagctgagggctcag

SEQ ID NO: 165091 - DNA, 601 bp, Human
gcacaccttgttggctctgcctccctggagaaccttggctaatacgacacccatgcccctttgtttgcatctatgtctgtggttgttttcatgctgcaaaagctgagttaattgctgaaacagagactgtagggccaagaaagcccaaaatatttactctctggtcctttacagacaaggtttgctgaccgtactttgactggttttataaacattttatgattctaatagtttttaagctaattttcttgagtcctcaggcacttgaacatattcttaaataataaaacattttttatgycttgctagtggatggatctcttgccaggaggtcaggtgggtttcctgatggaagaggcaggaagcaactggccccattcttcagccctgagccctttctagttgcctgggctgctctcctggcaaatactgagaggacctggggaggcttgccttgggatttaccttttccttgagagggaaaggcatgggctctgcggtcatttggtgccacctcctccacaagcctcagtcttctcatctgtgattggggtgtatcatcttcctgcactgagacagcactgcttaaagggccagcaca

SEQ ID NO: 165092 - DNA, 601 bp, Human
tacattactgaacaatgtcagatgggccccaggggaagcatttcgacctttctgatggggatttgccaaggaatggagctgggaagtcacacataagagagagccctgcctgcctatcatgtctgattagggatgggccaaggaggaaaggaactttgccgatcatcgggatgagaagtgggaagcaagcccccttggtaagcgggaggcatgatgtcagtatctgaccctgatggagggcctgcatggtcttctttcacagacttggccaaggacccggaggccacacaaggaaaagtcytttgcacttggcagtttgtgaagctttttctcagctgctacctcgggtgctttgtaatagcccagtaggggaaagaggggctgatggggcagtggggtgattctcccctaacaggtggggttgtttcagactcaccagcctgcctaatcacatgagccaattccttacgtcaatctctttctgcggataggcacaccttgttggctctgcctccctggagaaccttggctaatacgacacccatgcccctttgtttgcatctatgtctgtggttgttttcatgctgcaaaagctgagtta

SEQ ID NO: 165093 - DNA, 601 bp, Human
cctggttctggagtagcctccaatcttttcctcctagacactttccacgcagcagctggaggacccttctgaaatgcagatctgactgcacctctgccctgtgtccactggcttccagaggaagattgtccccatcacctagcagccccgggctctcctaataccaacagctgacatttgctagtgctccctgtgtgcctgcccctgtgctcagaactctgtgtgtcttattgtaagggggtccttctgacaactccataagactgggactaatattctccccatttatggatgagaaaaygggacacagaaagatcatatagtctgtccaagctatcccagcaagtacacagcacccagacagattggatgtgagttctgcccatcctgggcttgaccaaaccacctgcaatttcaaaacaaatgctccacacaccccaccctccaagcctttgcacaaagggtttcctctgacaggaacatctttctcaacccactcatccactcccatcacactttgacctggctaattcttactcattattcaaaactcagcctcagttgcctcttccaggaagtctatctggattagttccctcct

SEQ ID NO: 165094 - DNA, 601 bp, Human
aggtggaccctccacctggttctggagtagcctccaatcttttcctcctagacactttccacgcagcagctggaggacccttctgaaatgcagatctgactgcacctctgccctgtgtccactggcttccagaggaagattgtccccatcacctagcagccccgggctctcctaataccaacagctgacatttgctagtgctccctgtgtgcctgcccctgtgctcagaactctgtgtgtcttattgtaagggggtccttctgacaactccataagactgggactaatattctccccattyatggatgagaaaatgggacacagaaagatcatatagtctgtccaagctatcccagcaagtacacagcacccagacagattggatgtgagttctgcccatcctgggcttgaccaaaccacctgcaatttcaaaacaaatgctccacacaccccaccctccaagcctttgcacaaagggtttcctctgacaggaacatctttctcaacccactcatccactcccatcacactttgacctggctaattcttactcattattcaaaactcagcctcagttgcctcttccaggaagtctatctgg

SEQ ID NO: 165095 - DNA, 601 bp, Human
gctgtctggctccagagctaccttcgtaactgctgtgtactgcccaggccccttcagtcctctcatctccagcctccagcttctccctccaggtggaccctccacctggttctggagtagcctccaatcttttcctcctagacactttccacgcagcagctggaggacccttctgaaatgcagatctgactgcacctctgccctgtgtccactggcttccagaggaagattgtccccatcacctagcagccccgggctctcctaataccaacagctgacatttgctagtgctccctgtgtkcctgcccctgtgctcagaactctgtgtgtcttattgtaagggggtccttctgacaactccataagactgggactaatattctccccatttatggatgagaaaatgggacacagaaagatcatatagtctgtccaagctatcccagcaagtacacagcacccagacagattggatgtgagttctgcccatcctgggcttgaccaaaccacctgcaatttcaaaacaaatgctccacacaccccaccctccaagcctttgcacaaagggtttcctctgacaggaacatctttctcaacccac

SEQ ID NO: 165096 - DNA, 601 bp, Human
aagattctagagcctgccaagattctacagtgagtaagtggcaaagctgggattcctaccaggctgtctggctccagagctaccttcgtaactgctgtgtactgcccaggccccttcagtcctctcatctccagcctccagcttctccctccaggtggaccctccacctggttctggagtagcctccaatcttttcctcctagacactttccacgcagcagctggaggacccttctgaaatgcagatctgactgcacctctgccctgtgtccactggcttccagaggaagattgtccccakcacctagcagccccgggctctcctaataccaacagctgacatttgctagtgctccctgtgtgcctgcccctgtgctcagaactctgtgtgtcttattgtaagggggtccttctgacaactccataagactgggactaatattctccccatttatggatgagaaaatgggacacagaaagatcatatagtctgtccaagctatcccagcaagtacacagcacccagacagattggatgtgagttctgcccatcctgggcttgaccaaaccacctgcaatttcaaaacaaatgctccacaca

SEQ ID NO: 165097 - DNA, 601 bp, Human
cacgatgttctgagcagttctcgtggattaactcatacatattcacagaaactctacagctccggtgctgttgccatgcccactttacagatgaggaaactgagttaagattctagagcctgccaagattctacagtgagtaagtggcaaagctgggattcctaccaggctgtctggctccagagctaccttcgtaactgctgtgtactgcccaggccccttcagtcctctcatctccagcctccagcttctccctccaggtggaccctccacctggttctggagtagcctccaatctttycctcctagacactttccacgcagcagctggaggacccttctgaaatgcagatctgactgcacctctgccctgtgtccactggcttccagaggaagattgtccccatcacctagcagccccgggctctcctaataccaacagctgacatttgctagtgctccctgtgtgcctgcccctgtgctcagaactctgtgtgtcttattgtaagggggtccttctgacaactccataagactgggactaatattctccccatttatggatgagaaaatgggacacagaaagatcatatagtctgtc

SEQ ID NO: 165098 - DNA, 601 bp, Human
atctctttatctcaggcaaaaacagcattggcatccttgtctttcatccattaactttatattgaatgataattctggttgatctgaaggtaatgaagtactcacgatgttctgagcagttctcgtggattaactcatacatattcacagaaactctacagctccggtgctgttgccatgcccactttacagatgaggaaactgagttaagattctagagcctgccaagattctacagtgagtaagtggcaaagctgggattcctaccaggctgtctggctccagagctaccttcgtaacygctgtgtactgcccaggccccttcagtcctctcatctccagcctccagcttctccctccaggtggaccctccacctggttctggagtagcctccaatcttttcctcctagacactttccacgcagcagctggaggacccttctgaaatgcagatctgactgcacctctgccctgtgtccactggcttccagaggaagattgtccccatcacctagcagccccgggctctcctaataccaacagctgacatttgctagtgctccctgtgtgcctgcccctgtgctcagaactctgtgtgtc

SEQ ID NO: 165099 - DNA, 601 bp, Human
gtgatggctgggctggcctgttagaagatcagcagtgaattaacctactggggagggggcgcctaccacaccatctaactcctggccgaaggcttcccacacagcttagctgcaaaggtaggggactcacgttaagatctctttatctcaggcaaaaacagcattggcatccttgtctttcatccattaactttatattgaatgataattctggttgatctgaaggtaatgaagtactcacgatgttctgagcagttctcgtggattaactcatacatattcacagaaactctacagctcyggtgctgttgccatgcccactttacagatgaggaaactgagttaagattctagagcctgccaagattctacagtgagtaagtggcaaagctgggattcctaccaggctgtctggctccagagctaccttcgtaactgctgtgtactgcccaggccccttcagtcctctcatctccagcctccagcttctccctccaggtggaccctccacctggttctggagtagcctccaatcttttcctcctagacactttccacgcagcagctggaggacccttctgaaatgcagatctgactgcac

SEQ ID NO: 165100 - DNA, 601 bp, Human
cagtgatggctgggctggcctgttagaagatcagcagtgaattaacctactggggagggggcgcctaccacaccatctaactcctggccgaaggcttcccacacagcttagctgcaaaggtaggggactcacgttaagatctctttatctcaggcaaaaacagcattggcatccttgtctttcatccattaactttatattgaatgataattctggttgatctgaaggtaatgaagtactcacgatgttctgagcagttctcgtggattaactcatacatattcacagaaactctacagcwccggtgctgttgccatgcccactttacagatgaggaaactgagttaagattctagagcctgccaagattctacagtgagtaagtggcaaagctgggattcctaccaggctgtctggctccagagctaccttcgtaactgctgtgtactgcccaggccccttcagtcctctcatctccagcctccagcttctccctccaggtggaccctccacctggttctggagtagcctccaatcttttcctcctagacactttccacgcagcagctggaggacccttctgaaatgcagatctgactgc

SEQ ID NO: 165101 - DNA, 601 bp, Human
ctgtagactgtgttctgagcccacaaagtcatctctaactcctgcccacagcactgcaaagcattctgattcccattctacagtcaagaaaacagaggcccagggaggtaaagcagaggcccaaagccaagggtcaaggaagggaatgagcacccactgtatacccagagctttcctgcacattcactttcaatctgcacaatagttcttcaatgtgggctgtgctagtttgattcaacagatggggaagctgaggctcagagctgggaagtggttgcacacagctaggaagtggacaagmcacgacttgctctgggtctttcagacttcaaaacccactttggccacccgccaagccagaagatacttggctaaatgcttttctgagttctctgaggtctttgtccctgtgtcccagactgtcccatgtcagtcctttcggctgtgtgagggctttggaatttttctctcccactctggtactgtcactgaccttggccacggctccaccttcactccctctccctgctggcctccctgcctgcctccagttccttctccgattcctccttcctaccctgaaatgccggtcttggcaata

SEQ ID NO: 165102 - DNA, 601 bp, Human
ccgacttgctccccaagtcctccttgtcattgagcccaagggtggagggggtgaaaaaagacagaaagctctggcatctctcccattcctcagagggcagcagggcagcctggcattgcagggagcaaatctgcaaaagacccaaaaagaccacagtggcaaatgatcaaaacacatgcactggtctgccccaggctcccctgtccagtgtctgagaaaaccaaaatgaacgccactgctaagccctgggctacccatgttcatactactggtggtgcataaaggtaggggactttgtgcytgtgagaaagagaagacagacctggagaggtgaaatggctttagacccaggacacatggctgcaggtggcaattgccagaattggaagtaagatcttcccgtagtgttctgcgtgctcacctttccccctccacgtctgactcccagacaggaaaccccatctccactaaaaatacaaattctctcccaggcttctgcaggtgtgaagcacactgctaactcttggtaaagtgggacagagaagtgcagcatggcagagaacacacaggagaggacacaggagggttcatcaggcctggg

SEQ ID NO: 165103 - DNA, 601 bp, Human
caatgcccagtgcgtatgttgggccagatggcttggactcttggcagccaattcagctgctcaagaacatggttgtgcttaacttcatcagcttgactctgcttcagttcaccatggagtagaagcatgatacccatcagtttaattagtttaatgagggctgagggaactggtccacattttgagtttgttgcacagaacaaattggtttgcctttctccctccttgatcatttaagcattcaagaggctgctctcaatcatttccgaaaggggttttcactcccttctgtaaggagttrggcactgtccagggtaccaacatgactgggagttcaggaagtcagttcttcaagaggtgcttttctgaacaatgaggactcagagtacactgactaaacattaaacccactagaagactggaccctctactgtaagggttcctgatccaatataaggcaatgtttaagctttttacctaaagcatcgtctccaaagtcaggtgcacaggagatcttttgagatttgggaatataatgttaggatttctgtgtatgattatttaccttcttttaaagttctactctttgtttatgatgtgt

SEQ ID NO: 165104 - DNA, 601 bp, Human
ctagctgctgcttctggagtcccttacccaatgcccagtgcgtatgttgggccagatggcttggactcttggcagccaattcagctgctcaagaacatggttgtgcttaacttcatcagcttgactctgcttcagttcaccatggagtagaagcatgatacccatcagtttaattagtttaatgagggctgagggaactggtccacattttgagtttgttgcacagaacaaattggtttgcctttctccctccttgatcatttaagcattcaagaggctgctctcaatcatttccgaaagrggttttcactcccttctgtaaggagttgggcactgtccagggtaccaacatgactgggagttcaggaagtcagttcttcaagaggtgcttttctgaacaatgaggactcagagtacactgactaaacattaaacccactagaagactggaccctctactgtaagggttcctgatccaatataaggcaatgtttaagctttttacctaaagcatcgtctccaaagtcaggtgcacaggagatcttttgagatttgggaatataatgttaggatttctgtgtatgattatttaccttctttt

SEQ ID NO: 165105 - DNA, 601 bp, Human
tatccagcctcatctcctggacccacaaaccaaaagagagtgcctgggaatgagagagcaaaagagagacagacagacagggagggctttgatggaaaccaagacatcaggaggtctctgcctctgattcagggttatttgaatcaagggaactcatttggcctcaagcacttaatcattttattcctctttctggttttattttgagacattaagaggaaagaagcattatggggattgaagagggctttttctctttctagctgctgcttctggagtcccttacccaatgcccagtgcrtatgttgggccagatggcttggactcttggcagccaattcagctgctcaagaacatggttgtgcttaacttcatcagcttgactctgcttcagttcaccatggagtagaagcatgatacccatcagtttaattagtttaatgagggctgagggaactggtccacattttgagtttgttgcacagaacaaattggtttgcctttctccctccttgatcatttaagcattcaagaggctgctctcaatcatttccgaaaggggttttcactcccttctgtaaggagttgggcactgtccagg

SEQ ID NO: 165106 - DNA, 601 bp, Human
tttatactgaaggtcattatctttctttctttatcccgcagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccrgctccagtgcacatctgtgtgagctgggagtcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaac

SEQ ID NO: 165107 - DNA, 601 bp, Human
gctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggtgaaaaagggtctgcgacagggttactttgtrgaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaag

SEQ ID NO: 165108 - DNA, 601 bp, Human
cataggaagtatccgactctttgggaaacacaaaagccttcctcgacatgtctgtgagccagaaaaacaagcaaatgtgagaggtttctcagatcacacagatctatcccctcacttacgtatagaatttaagattgagaaacagactgaccccttctccagttacacaccacacacacacacacacacacacacacacaccatgaaggatgctccactgttctgttcatacagtcttttttttttttttttgagactgttcatgcagtcttagaccccacccccatacctcagatcaaawctctcccatagcctggggtggcccttacctgtctggccaaaagcatgagagaggctggtcaagaccaagaaacacaacagcttctccatggtcacgtcctgctgccagtgatacaagggcctgaattcactcctttggaaaagatgtattcggctgaaagttcaggggctagaagtcctagatctcttgccttagagctacctcctcctgcctggatttatatccaaagcagtaagggagtttgcgccactatgtaaataattttccaacattgcttgttggggcaggtgtcagagcttc

SEQ ID NO: 165109 - DNA, 601 bp, Human
attctcaggcgctgaggagggtggagcaggcctgcaatgcatataggggaacaaaggcccagagacagagacgtgggaaccatgcagtgtaaaaaagcgggaggtaccagagacagagacgtggggcccatgcggtgtaaaaaaccgggaggtaccttcaggacccacagctgggcctcagggccacagctggggtttggtgaacacttcgccttgcacttcatacttcagtgcccgccagttcaggacattaggactgaagggcccgccaagatagatggtgttaatctcatctggtgasagcacaaagtcccacatgttcacatttccaatgtctcccaccagggactggcttccttcaaagttcccaccgaaggaatcctgctcctgccccaagatgatgcttgcttctgcccccacagtgtatcccttcttcagactcttcctcaccctgggcttcccatctacccagaactccacgatccctgaggcggactcccagcttgtacaaatgtgtactggagctactgtgacttcaggaacctcgaataatatttcagacccacccactgtaaaactgtatcctatatccttagaccaa

SEQ ID NO: 165110 - DNA, 601 bp, Human
tgatggatacaaacccaccttacaggcggtgaaaagccttcttcagggtctcagaccttaatgccaatcattcagttttagtggcttctgatttctaatttctagatattgttgttaatgaggatagttggcttttgtgtggattaaggttaaaatcaggaagtgcatatatcatgttaatgagcacatagtgaattataagcattttgaaatttttagtggtagagaaaaataaaagcttcgtctaacctaatctcttcattttatggacaagaagactgagtcacagtaagattaaaaygatttgttcagatttagatggcaaggccagaattcgaatctgtgccttggtctcaatgaggtcgtgcttttctccgtggcattttactacgtgttgtgcttcctttgtcatctgaaggatataacctctcttattttttacaaaaggctagagaatctccaaaatttggaagcctaatccatacaagaagttccttggattcaaaacttctcaaatgatgatttttagcattttgcttcttttcttatgaagtgacaactagtataccctctaacctgtcttgatgacttatatacctgg

SEQ ID NO: 165111 - DNA, 601 bp, Human
gtactgtaaatgaacatgttctagttgcctcacatctttaccaacacttggtattttagtcttttctggtaggctacaattgttttttaaaacttaaaagcaaaataatatttgaacccctttttgaaagaaaatcttacccagaattccaatataaaacaagagctgctttggttgaggtgagtctaaactagaccatatttccttcttttgtttttgagatggagtctctctgtgtcatccaggctggagtgcagtggcatgatctctgctcactgcaacctccatctcccaggctcargtgatcctcccatctcagcctcccgagtagctgggattacaggcacgcatcaccatgcccagctaattttttttttttttttttgtatttttggtagagccccatgttggccagactggtctcaaactcctgagttcaggcaatccatgtacctcagcctcccagagtactggggttacaggtgtgagccactatgcctggccagccatacttcttttttaaagattgaatccctactctcaaaaactgctttttggggaataaggcagaaaatacaaaattattacatagtgccaagtt

SEQ ID NO: 165112 - DNA, 601 bp, Human
ggtaggctacaattgttttttaaaacttaaaagcaaaataatatttgaacccctttttgaaagaaaatcttacccagaattccaatataaaacaagagctgctttggttgaggtgagtctaaactagaccatatttccttcttttgtttttgagatggagtctctctgtgtcatccaggctggagtgcagtggcatgatctctgctcactgcaacctccatctcccaggctcaggtgatcctcccatctcagcctcccgagtagctgggattacaggcacgcatcaccatgcccagctaattttttttttttttttttgtatttttggtagagccccatgttggccagactggtctcaaactcctgagttcaggcaatccatgtacctcagcctcccagagtactggggttacaggtgtgagccactatgcctggccagccatacttcttttttaaagattgaatccctactctcaaaaactgctttttggggaataaggcagaaaatacaaaattattacatagtgccaagttgtaaatatcccatgttcattataataaagaatttattgcccacagtcagtcatcctgtgtgcttttc

SEQ ID NO: 165113 - DNA, 601 bp, Human
ttttcatgaagctatcagagaacaagtctgtttatttgtgaaaacttctcctttgtgaaggcactgcctaaggatgctattgggctattggggttgtgtcttttttggttttttttttggagacagggtcttgctccatcacccaggctggagtatagtggcaagattgtagctcactgcagccttgaactcctgggttcaaatgatcttcccaccttagcttcctgttagtagctgggattacaggtgcatgccatcatgcctggctaattttttttttttttttttttttttttttggkggagacagggtctcactatgtgttacccaggctggattcgaactcctggcctcaagcagtcttcctgccatggcctcccaaagtgctgggattaccgctgtgagctgccatgcccagcctccttttacaagctatattgaagagagaagtgactgagacatcttagctggagaggaggaattgaataaacaagggatacaagtgacagagtaaaatgggctgtgaaaggaaatcagagagctgatgaaacattgcatttcaaagtgtgtcagggaaagattgagaagaagcagaaccaga

SEQ ID NO: 165114 - DNA, 601 bp, Human
aagctcatggaattgcaaaactacaattttgtttttaaaagaaaaacattgattgtaatgtgtaaaatttacaaaactgatacacttttaattgggattatattggtttataaaaacatttagtgttttttttttttttttttgagacagagtctcgcactgtcttctgggctggagtgcaatggcatgatctcggctcactgcaacctctgcctcacgagttcaagtgactcttctgcctcagcttcctgagtagctgggattgcaggtgcgtgccaccacacccagctaattttttttktgtgtgtgtgtttttaatagagatggggtttcaccatgttagccaggatggccttgatctcctgacctcatgatccgcctgcctcggcctcccaaagtgctgggattataggcgtgagccaccgtgcctggctcaaaacatttagttttaataggcattttagggtatgtcttagtccatttgggctgctataacaaaataccacaaactgggttcttacaaacacagaagttgatttctcgcagttttggaggctgggatgtccaagatcaggcactgatggattcagcatctagtaag

SEQ ID NO: 165115 - DNA, 601 bp, Human
tggcaaatggaaaagggttgatactttgaagctggctagactttgtttaaagtctttcattgacactaactggttttgtaacattgcatcaaatactatctctctccgtgtctccattttcttatctataaaacagggaagatggtgatgatggtaatgataccatccaacatctactgaacatttgttatgtgccaggcagtatgctgagctctctgtgtgccttatctcatttagtttttatatttaccctttcacactcacccataggtgccttaaacatcttaattttatagatgarggacttgaggctcccagaagttgaggagcttgtcctccgtcccacagttggaagatggtagagccaggctgtggactcaggtctttgtcttcatctatacttttagctcttgttgtatatacttacagcatttatgaagacaaactaaaacagtgtgacagtggctaagcacacgttttagagtcagacagacataggttcaaatcctagcactgtcctttattgattatgtgaccttgagtgagttatttggttttgtctagtcttggttatctcatctttcctttagttttcttatcc

SEQ ID NO: 165116 - DNA, 601 bp, Human
taccgagccctatatatactatgttttttcctgtgcatatatacctgtggttaatttataaatcaagcacagtaagattaacagcagtaactaattataaagtagaacaattataacaatatgccagtattactacttttgagctttatggccatgattaagttaaacaagagttacttcaacgtaagcactgcgatactgctacagtccatctgataacagagggctactaagtgactaatggtgggtagtgagtgtacattgcatggacgtgttgaacaaagggatgatttacatcccwgtctagacagagtgagacaatgttagatttcatcatgctactgagaatgacatgcaatttaaaacttatgagttgtttatttctggagtttcccatttaatgttttcagaccacagttgactgcagagaactacctgaaactgtggataaaggcttactgaaatagtatccattaaggatgataataataactatccatagggttgtcgtgaggatttagttagaatgactataaagcccttagccaagtgcctggtatataatgagaggttgaaaatgttacctgttgtctttattatt

SEQ ID NO: 165117 - DNA, 601 bp, Human
gcacgatctcagctcactgcaacctccgcctcctgggttcaagcgattctcatgcctcaattctcccgagtagctgggactacaggcgtgtgccaccatgcctggctaattttttgtatttttagtagagacgggatttcaccgtgttaaccaggatggtctctctctcctgaccttgtgatccgcccaccctggcctcccaaagtgctgggattacaggcatgagccactgcacccagtcaagaaatccttcttcacttagtctatcctaatgccatataccactctattttaattactrcagttttagaaaatgtcttcgagttagccaggcgcggtggcttatgcctataatcccagcactttgggaggctgaggtgggcggatcacttgaggtaaggagttataccccagcctggccaacacggtgaaacgccatcattaccaaaaaataaaaattagctgggcatggtagcgggcacctttagtcccagggaatggaggcagaagttgcagtgatccaagattgtaccactgcactccagcctggttgacagagtgagactctgtttcaaaaaaaaaaaaaaaaaagaaagaaaga

SEQ ID NO: 165118 - DNA, 601 bp, Human
tggtcatcacagttggggaagtggaggtgatactgctggcctcaaatagaaagaggccagggtgttgctaaacatcctgcaattataggacagctactacaacaaagaatttattcagccccaaatgtcagctgtgccaaggttgagaaactgtattttaaagggaatgccttaaacaatattttattattatgcagaattccaaacacaaaaataaattggtaaacagaattcccaataccaacagttaactattgtaggccagtatttaactcctttccttcccccaacttctgctgamttattttaaaacaaatacaagatatcacatcattccatctgtaaatacttctctgtgtgtcactaaagtagaggttcccaaattatggtttcagaatacccaaaaaatccttcagaccctcccagaagatctccaaggctaaaactattttcacaatggtactaagatgttatttgaattttcattctgttgacatttgtgctgatagtgcaaaagagttgaaaattgtggatgccttagcacaaatcaaggctctggcaccaaactgtacttagtggtcattgtacttttagtactgtc

SEQ ID NO: 165119 - DNA, 601 bp, Human
gtagaggttcccaaattatggtttcagaatacccaaaaaatccttcagaccctcccagaagatctccaaggctaaaactattttcacaatggtactaagatgttatttgaattttcattctgttgacatttgtgctgatagtgcaaaagagttgaaaattgtggatgccttagcacaaatcaaggctctggcaccaaactgtacttagtggtcattgtacttttagtactgtcaaattctcttctgcttaaaaaaaaaaccaactagatttaagtaagaatgtgattcatgaagcagtacrgttttttttagtcttctacctaatggttttagtgatcattgatgaatcattgcccagacctactattttattaagtctggccaaatggtggtagtctaatttaaaatttccttctgtattcattaatgatatttttctataaagaagactgtgcttataccaactgtttagttactcctaaatatcctttgtgtaggaaatggaggaaaatgatttatttattttttcccagaacagagttcactctaaagggaatatgtttaatgaattttgttgtatttattttaatgtacattattg

SEQ ID NO: 165120 - DNA, 601 bp, Human
atatgtttaatgaattttgttgtatttattttaatgtacattattggtatatgctgttagttttctttctctttgttgatatcttttatcaagttaaagaatttctcttctatttctagttcactaagagttttcaaagttaatggatattgtattcattttccattgctgtgtagtaagttaccccagaatttagtggctgaaaacaacaaacataaaagtttctgtgtgtcaggaatatggacacagcatagctggatcttctgcttcagagtccctcacaaggctgcatcagggctcractggggaaggaatgatttcctagttcatgtggtatttggcaagattcagttccttctctgtcttaggtggagggccttagtttcttgctgtgtgtttctgtatatggctacttaacatggcagcaggcaaacaagaagagccagagaaagtaaagaagatggaagttacatcttttccagccttatctcagaagtgacatcctatcacttttgccatattcatgagaatcaaattcctaggcccagctaaaatcaagtagacgggattacacgaaggtaggaatatcaggagttgggaa

SEQ ID NO: 165121 - DNA, 601 bp, Human
aaaccctttctctggctcatcttttcctggattccccacatctctctggctcacagaggctcctttcattgttattctagtcagacgtttggatttctttcagagctttagctgcctgcgatgcgtttctgtatggctggtgccacccttagggtgaagagctcagaaaaagtgttaaaaataatgagaatgattcttacgctccttagaccactgtggtctttcccaattatttttgcctgaaatgaggggttttgcccagagtttttgctgctcacatttgtgcatagtgtggacttayggttctaattttattctaaggatctttatatttctcagggttttttgttttgttttttgaaaaagtcttagtttcttagcaggttatttttggtttatttaattctgggttggcaataattttctcttagtgttttgaagatattattccaccatccactagttgcagtggttgctgttgaaaaacctgctgtcaataattgtcaggcctttgttatatgtcatttctctgaccactttaagctctttatcttttgtgtattttgtttttattactgtattttgtgagtaggtgtggatt

SEQ ID NO: 165122 - DNA, 601 bp, Human
taatttttacttggaacgtgttgagctctttggatcagtgagttttatagtttatataaaatttggaaaattgtgtactttttttttccaaattttttttctcttctttctcctttccttcaggactccaattacacatatatgagactgttggaaatgtttccatagttcactgatttttttcaattttattttcaaaaataggctttgttttttatagcagttctggattcatggcaaacttgaacagaaagtgtagagagttcccatatatgacttatccacacacatgcactgcctmccccaatatcagtatcctactggtatatttattacaatcgatgaatttatattgacacattattataacccaaagtccatagtttacattaacgttcactcttggcattgtatattctgtgggttttgacaaatgtatactaccatatatctaccattttagtatcatacagaatattttaactgtcctaaaaatcctccgtgttccccctatttatcctttcctttttcagccccttggcaaccactgattttttattctagccatagttttgccttttccagaatgtcatggagttgg

SEQ ID NO: 165123 - DNA, 601 bp, Human
tttacttttttctgaaaccttttatattatctgaactcatcacgtgtgggcagcactgtgttgctgtgttcatgaaacatttataagttatgtactagtttgctttatttcccagtatatcagttttgttcagtaacaatcatttgatagattagtgctcacctttaaattttttaaaattttgggcagctgatggctatgtgtgttatctcctatttctttatgttatcctggattcagagccatagaatactacctagattctttaggaaagtctttgtgtgcctgacattctgtttattcttttcatatatttaaaaaaatatatttaatacatgtatttttccataaaatatatgttgtcatattgggttcagatcttggctttaccacttactgactgtgggaccttgaatcagatacctaacctttgtatgcctcattttcttcatgtgtaaaatggtgatagtaatggcatttacgtcatagggttgttaataaggtttaaatgcattaataatatgtaaagagcttaggatagtatctggcatctaagtgctataaatgtgtgttagctcttattatttttaccacaactacc

SEQ ID NO: 165124 - DNA, 601 bp, Human
acttttttctgaaaccttttatattatctgaactcatcacgtgtgggcagcactgtgttgctgtgttcatgaaacatttataagttatgtactagtttgctttatttcccagtatatcagttttgttcagtaacaatcatttgatagattagtgctcacctttaaattttttaaaattttgggcagctgatggctatgtgtgttatctcctatttctttatgttatcctggattcagagccatagaatactacctagattctttaggaaagtctttgtgtgcctgacattctgtttattcatttcatatatttaaaaaaatatatttaatacatgtatttttccataaaatatatgttgtcatattgggttcagatcttggctttaccacttactgactgtgggaccttgaatcagatacctaacctttgtatgcctcattttcttcatgtgtaaaatggtgatagtaatggcatttacgtcatagggttgttaataaggtttaaatgcattaataatatgtaaagagcttaggatagtatctggcatctaagtgctataaatgtgtgttagctcttattatttttaccacaactaccacc

SEQ ID NO: 165125 - DNA, 601 bp, Human
cgtgtgggcagcactgtgttgctgtgttcatgaaacatttataagttatgtactagtttgctttatttcccagtatatcagttttgttcagtaacaatcatttgatagattagtgctcacctttaaattttttaaaattttgggcagctgatggctatgtgtgttatctcctatttctttatgttatcctggattcagagccatagaatactacctagattctttaggaaagtctttgtgtgcctgacattctgtttattcttttcatatatttaaaaaaatatatttaatacatgtattyttccataaaatatatgttgtcatattgggttcagatcttggctttaccacttactgactgtgggaccttgaatcagatacctaacctttgtatgcctcattttcttcatgtgtaaaatggtgatagtaatggcatttacgtcatagggttgttaataaggtttaaatgcattaataatatgtaaagagcttaggatagtatctggcatctaagtgctataaatgtgtgttagctcttattatttttaccacaactaccaccaccactgcatatattactgctagtgtccatgccaggaga

SEQ ID NO: 165126 - DNA, 601 bp, Human
ttaaaaaaatatatttaatacatgtatttttccataaaatatatgttgtcatattgggttcagatcttggctttaccacttactgactgtgggaccttgaatcagatacctaacctttgtatgcctcattttcttcatgtgtaaaatggtgatagtaatggcatttacgtcatagggttgttaataaggtttaaatgcattaataatatgtaaagagcttaggatagtatctggcatctaagtgctataaatgtgtgttagctcttattatttttaccacaactaccaccaccactgcatrtattactgctagtgtccatgccaggagaaccatgtctgttccctaggtggcatatgggtgtgtgtatgtaaagatgaggtgactgtgtggtcttgtgctgctctctctgagccctccttggcctctggagtaatagtattgctgtccacctggtcaatgtgtcctgctgataagtgctgttgcagtctgtggtcagcaaatggtccagtggttctccttgcttcactggcctcaccttggctcatgctgactctgaggtttgggtgtcatattctttaagccctggacctgggcagtaag

SEQ ID NO: 165127 - DNA, 601 bp, Human
atatttgaagaaataatgggccaggtgcagtggctcatgcctgtaatcccagaactttgggagaccaaaacaggcaggtctcttgagcccaagagtttgagaccagcctgcgcaacagcgtgaaaccctgtctctacaaaaaatacaaaaattaaccatacgtgatgacatgtgcctgtagtcccagctactcaggaggctgaggttggaggatcacttaagcccaggaggccatggctgcagtgagctgtgattgcactactgcactgcagactggacgacagtgtggaaccctgtctcaaaaaaaaaaaaaagaaaaaagaaaaaaagggaaagggaagtgaaatagtggctaaaaccccaaatttgatggaaaagcatgcatttatgcatacaagaagctcagtaaactccaagcaggataaaaccagagattcacagctagacacatcataatcaaactgttgaaagccaaagatagaatctttaaagcggcaagagaaaagcagctcatcatgtacagggtaacctcagtaagatgaacagcagacttctcaccagaaactatggtgcccagaaggcaatgggttgatgtactcac

SEQ ID NO: 165128 - DNA, 601 bp, Human
ctgcactgcagactggacgacagtgtggaaccctgtctcaaaaaaaaaaaaaagaaaaaagaaaaaaagggaaagggaagtgaaatagtggctaaaaccccaaatttgatggaaaagcatgcatttatgcatacaagaagctcagtaaactccaagcaggataaaaccagagattcacagctagacacatcataatcaaactgttgaaagccaaagatagaatctttaaagcggcaagagaaaagcagctcatcatgtacagggtaacctcagtaagatgaacagcagacttctcaccagwaactatggtgcccagaaggcaatgggttgatgtactcacatccctgaaaggaaaaagcccaacaaaaactaccatatctggcaaaactccccttgagaaatgaaagagaaagaagatattcctcataaaccaaaactgtgagaattgtagctagcagacctgcctacaacaaatgctaaggggaattcttccagctgaaatcaagatgcactagatggtaactcaaatctgcatgaaagaataaagaacatgggtcaagttaactacatcggttaacttagcactggcccaagctggttc

SEQ ID NO: 165129 - DNA, 601 bp, Human
aaaaaagggaaagggaagtgaaatagtggctaaaaccccaaatttgatggaaaagcatgcatttatgcatacaagaagctcagtaaactccaagcaggataaaaccagagattcacagctagacacatcataatcaaactgttgaaagccaaagatagaatctttaaagcggcaagagaaaagcagctcatcatgtacagggtaacctcagtaagatgaacagcagacttctcaccagaaactatggtgcccagaaggcaatgggttgatgtactcacatccctgaaaggaaaaagcccarcaaaaactaccatatctggcaaaactccccttgagaaatgaaagagaaagaagatattcctcataaaccaaaactgtgagaattgtagctagcagacctgcctacaacaaatgctaaggggaattcttccagctgaaatcaagatgcactagatggtaactcaaatctgcatgaaagaataaagaacatgggtcaagttaactacatcggttaacttagcactggcccaagctggttcccagaaaaaggagaccgtccaataatcaactgccagaggacaggaaggatgaaaccatattt

SEQ ID NO: 165130 - DNA, 601 bp, Human
agaaatgaaagagaaagaagatattcctcataaaccaaaactgtgagaattgtagctagcagacctgcctacaacaaatgctaaggggaattcttccagctgaaatcaagatgcactagatggtaactcaaatctgcatgaaagaataaagaacatgggtcaagttaactacatcggttaacttagcactggcccaagctggttcccagaaaaaggagaccgtccaataatcaactgccagaggacaggaaggatgaaaccatatttttctctcctcttcactttcaggagccctgcacayttcccatatttcagtatataatttttgagtaaattagcaaggtgagatcttttcaccagtctaattctactaaaaaaaaaaaaaagtaggcttagtattattagtccatagggaatgcagtttaaaaccacagtgagatacccctctatattcaccagaatggttaatattaaatgaatggacattacagagtaatggcaaggataatgttggtaggagttaaactagtataaccatttggggaaactatatattatggctacttagcaaaacatgcctagcttataaccctacaaatcc

SEQ ID NO: 165131 - DNA, 601 bp, Human
ttacagaagaatatttatagcagcactattcatagtaatagctgaaagctagaaatggatccaagtacctatcaacagggggatgtataaataaaatacattatattcatgcaattagatattactcagcaataaaaagaagcaaaccagtgatacatacaacatggttgaagctcagaaatatactaagtgtacacagccagctgcaaataagtatatactgtaggtttccatttatatgaagttcaaaagtagctaaaaccaatcttttgtgatagtagttagaatagtggttattctrgggggctgactgggaggcaacacaaaagagactgttgaggggctagaaatgatcactgtcctatctaggtggtggttacatggctgtatatataaaattttgagttacacacttcagacagtgttgctgttaagatctgtgtatactccatattatgaaagataatttttaggatcttaaaaaaaatcttgattgctctgtcagtgttattgaaatcaaggatgtataatattatcaagttcaatcatcctaaaaggaaattcaattatagtttcatttttgtaactgttaaaagcatta

SEQ ID NO: 165132 - DNA, 601 bp, Human
catatattgggggagggggtgtggcagaaatgcatacacatattgtacatgtagcaatgaggttagattagatggctactttttctctttctttccttctttccttcctttccttcctttccttccttcctttcgtcctttttttttgacagggtttccatctatcacccaggctggagtgcagtggtacagtcttggctcactgcaacctcctcctctcgggctgaagtgattctcctacctcagcctcccaagtagctgggattacaggcatgtgccaccacgcccagctaatttttayatttttagtagagatgaggttttgccatgttgcccaggctggtcttgaactcctgacctcaagtgatccacccacctcagcctctcaaagtgctgggattacaggtgtgagccactgcacccggccaaggtggctactttttaaagtatgccatagtttagccttcaactatatatgccttatggaacctccagtttaatgctgctgttgatacccctcttagattttctaatgagaccttcctcagcactttaataatgaaatctactatatgactcaaggttgatgtgtcttactcag

SEQ ID NO: 165133 - DNA, 601 bp, Human
ttagttttcttatgcatgcagatgctaaaaccataaataaaataccagtaaatagaattcagcagtgtagcaaaaactgatcagctattatgaccaaatagtttttatttcagcaacaaaagaatagttcactactagaaaaatctgtcaacagaatgtactacatcaataaattaaaggagaaaaccatatgatcatatcattcagtgctgaaaaggctctgggtacaattcagttgtcattcataataaaagctcttaagaaggaacaggaaaaacactacctagatatagtaaagactgcactcaacatgtttttactaagcatccattatatgcccagtaatattccagcagttaacagacaaaacatttagagccatctcattttttaaaaaagaaggagttgaatgtttagtttgtcagatggtaataagcgctttgaaataagaaataaagcagggaataggaggttgccaagagctgggatgtaggaattgtcagggaaggactcattggtaaggtgatatttgagtagagaactgtaggagagcaagtcaacaaagcaggcaaaaattccagccatcatgtatcctacggtc

SEQ ID NO: 165134 - DNA, 601 bp, Human
accatatgatcatatcattcagtgctgaaaaggctctgggtacaattcagttgtcattcataataaaagctcttaagaaggaacaggaaaaacactacctagatatagtaaagactgcactcaacatgtttttactaagcatccattatatgcccagtaatattccagcagttaacagacaaaacatttagagccatctcattttttaaaaaagaaggagttgaatgtttagtttgtcagatggtaataagcgctttgaaataagaaataaagcagggaataggaggttgccaagagctgrgatgtaggaattgtcagggaaggactcattggtaaggtgatatttgagtagagaactgtaggagagcaagtcaacaaagcaggcaaaaattccagccatcatgtatcctacggtctcatggtgggggagggggcaatacaaaaaacatgataaaaacatatagcatattagaaggttatagtggaaaaaaggaaaaacagaggaaagtaaaggggaccagggcccagaggattttgaaggtcagattataaagttagtagtctcattgagaaggtgatatctgagcaaagtctcaaagga

SEQ ID NO: 165135 - DNA, 601 bp, Human
attgatcgctgagcccagaggcttaatcacactcaaggtcttatttggtgaggctatatacattatgtgtggttgtcatttttcttgtgattttagcagccattgatcctcagtgcctagattcatcaatttgttgactattgtaaagtgctgatattctaattctgatctcttttctacatcttacttggaacaattttatgaagagacatatccttgcctctatattttttggttgcccagggttacagcttttcatatacaaaaagcataataaatacttgattcttttgcttttttkgggccagttttcaagataatggtttggttccttttcatcttcccaagagaccaattttatatgtttctatctgttgcaattagcatttttattgagttcaaattgttccttctctggccactagatgcttctacacattgcctcctgagtacttttgctgtgacctcagttgtgtctgatagcttccttgctacctggtatgataacatctggtgtgacaagatagtacatgctcagctgagcttagtgatcagctgggactacaggtgcccgccgccacgcccggctaatttttgtatt

SEQ ID NO: 165136 - DNA, 601 bp, Human
ttgtaaagtgctgatattctaattctgatctcttttctacatcttacttggaacaattttatgaagagacatatccttgcctctatattttttggttgcccagggttacagcttttcatatacaaaaagcataataaatacttgattcttttgcttttttggggccagttttcaagataatggtttggttccttttcatcttcccaagagaccaattttatatgtttctatctgttgcaattagcatttttattgagttcaaattgttccttctctggccactagatgcttctacacattrcctcctgagtacttttgctgtgacctcagttgtgtctgatagcttccttgctacctggtatgataacatctggtgtgacaagatagtacatgctcagctgagcttagtgatcagctgggactacaggtgcccgccgccacgcccggctaatttttgtatttttagtagagacggggtttcaccctgttagccaggatcatcttgatctcctgatctcgtgatctgcccgcctcagcttcccagagtgctgggattacaggcgtgagccaccgtgcctggcttgtttattttatatcagtg

SEQ ID NO: 165137 - DNA, 601 bp, Human
tgtagaactacaaaaagccccaaatagtcaaagcaatcttgatagaaaagaacaaagctggatgcatcacagtatttgacttcaaaatatactgtaaagctatagtaatcagaatagcatggtactggcataaaaacagacatataaacgaatggaactgaatagagagcccccagaaataaacccacatatttatggtcagttgatcttaagggtgccaagaatacacaatagggaaaagacagtctcttaaataatgttgggaaaactggatatccacatgagaagaatgaagttagaytcttacctcacatcatatacaacaaccaactcaaaatggatcaaagttttatcttggaaaaaaaaaattttttttttcttttgagacagggtctcactctgtcacccaggctggagtgcagtggtgtgatcttggctcactgcaacctccgccttctgggttcaagcgattctctcacctgagccttcctagtagctgggactgcaggcatgtgccaccatgcccaactaatttttgttgttgttttcttttttctttcttttcttttttttttctttggtagagacggggtttcaccat

SEQ ID NO: 165138 - DNA, 601 bp, Human
acagtatttgacttcaaaatatactgtaaagctatagtaatcagaatagcatggtactggcataaaaacagacatataaacgaatggaactgaatagagagcccccagaaataaacccacatatttatggtcagttgatcttaagggtgccaagaatacacaatagggaaaagacagtctcttaaataatgttgggaaaactggatatccacatgagaagaatgaagttagactcttacctcacatcatatacaacaaccaactcaaaatggatcaaagttttatcttggaaaaaaaaaattttttttttcttttgagacagggtctcactctgtcacccaggctggagtgcagtggtgtgatcttggctcactgcaacctccgccttctgggttcaagcgattctctcacctgagccttcctagtagctgggactgcaggcatgtgccaccatgcccaactaatttttgttgttgttttcttttttctttcttttcttttttttttctttggtagagacggggtttcaccatgttggccaggctggtcttgaactcctgaccttaagagacccaccttccagctgggcacggtggctgac

SEQ ID NO: 165139 - DNA, 601 bp, Human
ctcggcctctcaaagtgctgggattacaggcatgagccacctgtacctggcctcaaaatggattaaaggtttaaatgtaaaacctgaaactgtataactatcagaagaagacataagggaaaagctctgtgacattggtctgggcaatgaatttttggatttgacctcaaaagcactggcaacaaaaacaaaaatggtcatatgggattatgtcaaacaaaaaagctctgcacagtaaaggaaactatcaacagagtgaagagacaacctatagaatgggttgatatatttgcaaaccatrtatctgatatggagttaatatccaaaatatataaggaactcaattcggcaagaaaacaaatctaaaaaaatgggcaaagaacctgatagacatttatcaaaagaagacatacaaatggccaacagttatatgaaaaaaatgcttagcatcgctaatcatcagagaaatgcaaattaaaactacagtgtacctcatacctgttagaatggctattataaaaaagataggccaggtgcagtggctcacacctgtaatccctgcactttgggaggccgaggtgggtggatcacgaggtcagga

SEQ ID NO: 165140 - DNA, 601 bp, Human
tgtcaaacaaaaaagctctgcacagtaaaggaaactatcaacagagtgaagagacaacctatagaatgggttgatatatttgcaaaccatatatctgatatggagttaatatccaaaatatataaggaactcaattcggcaagaaaacaaatctaaaaaaatgggcaaagaacctgatagacatttatcaaaagaagacatacaaatggccaacagttatatgaaaaaaatgcttagcatcgctaatcatcagagaaatgcaaattaaaactacagtgtacctcatacctgttagaatggstattataaaaaagataggccaggtgcagtggctcacacctgtaatccctgcactttgggaggccgaggtgggtggatcacgaggtcaggaggtcgagaccatgctggctaacacggtgaaaccccatctctactaaaaatacaaaaaattagccaggtgtggtggcgggtgcctgtagtcccagctacttgggaggctgaggcaggagaatggcgtgaacccgggaggcagagcttgcagtaagccaagattgagccactgcactccagcctgggtgacagagcgagactccgtctcaaa

SEQ ID NO: 165141 - DNA, 601 bp, Human
aggccgaggtgggtggatcacgaggtcaggaggtcgagaccatgctggctaacacggtgaaaccccatctctactaaaaatacaaaaaattagccaggtgtggtggcgggtgcctgtagtcccagctacttgggaggctgaggcaggagaatggcgtgaacccgggaggcagagcttgcagtaagccaagattgagccactgcactccagcctgggtgacagagcgagactccgtctcaaagaaaaaataaaaaaaaataaaaaaagataacaagtgttggcaaagatgtggagaaaaggragacctatacactgttggtgagactgtaacttggtacagccgttatggaaaacaacatggaggttcctcaaaaaattgaaaatagagctaccatatgatccagcaatcccactaccaggtatgtacccaaaggaattgaaatcagaatgtggtagatatacctgcactcacatgttcattacagcactattcacaatagccaagatatcaacccaagcatccattcacagatgaatggataaaaagaaaatgcggcatacatacacaatggaatactatttagcctttaaaaggaggaaa

SEQ ID NO: 165142 - DNA, 601 bp, Human
atttcttcttaaattttaaaaacatttcatatatatatatatatgtatttttttgaggcagagcctcactttgtctcccaggctggagtgcagtggtgtgatctcggctcattgcaacctctgcctcctgggttcaagtgattctcctgcgtcagcctctcaagtagctgcgagtacaggcatgtgccatcatgcctggctaatatcttctattttcaattagtttaaattggaaagcttttaaatctttgaaggcattctatttcacttataatttcttttaagattctcttgtatttaytaactcttgtcttccttctagtttagtttatttttgtaatgatttttccttccatttctaaattcctgagctctatcaccttatttctaatatgatttatgtatcattttctcagtgtcttttagcttgttttaaaatagtaagttacaattttaatgttttgtgggcatgtctttttttctctataggaatgttcttcttcttctctgttttcttttaacaactctttatggtatttgaccaaatacttttttgtcactcatttttactgaaaaacagttttctcaagcttttgggagg

SEQ ID NO: 165143 - DNA, 601 bp, Human
ggattttgagcaatggagtgacatgacctgactggtgttttaaaggctctgtctggtgatagactgagaatagaccatagaaatgtagaggaagaagtagggggacctattagaagaatgttgcagaaataggctgggtggatcacttgaggtcaggagtttgagaccagcctggccaacatggcgaaaccctgtctctactaaaaatacaaaaattagctgggtgtggtagtgggtgcctgtaatcccagctactcaggaggctgaggctggagaattgcttgagcccatgaggtggackttgcagtgtgctgagattgtgccactgcactccagcctgggcaacaagaatgtgactccatctcaaaaaaaaaaaaaaaaaaaaaaaaaaaaattgcagaaatccaggtgagagatgtttgcttggacttggggagcagcagtggagttaatgagaagtggccagatttgcatatattttgaggtatagttgataagatttcctgatggatttgatgtgaagtatgagagaatgtagttgaaaaataactctggttttgtcctgagcaactgtaagaatggagttgcttttaactgagat

SEQ ID NO: 165144 - DNA, 601 bp, Human
gaaaccctgtctctactaaaaatacaaaaattagctgggtgtggtagtgggtgcctgtaatcccagctactcaggaggctgaggctggagaattgcttgagcccatgaggtggacgttgcagtgtgctgagattgtgccactgcactccagcctgggcaacaagaatgtgactccatctcaaaaaaaaaaaaaaaaaaaaaaaaaaaaattgcagaaatccaggtgagagatgtttgcttggacttggggagcagcagtggagttaatgagaagtggccagatttgcatatattttgaggyatagttgataagatttcctgatggatttgatgtgaagtatgagagaatgtagttgaaaaataactctggttttgtcctgagcaactgtaagaatggagttgcttttaactgagattagaaggctgaggctgccgtgcgggtaaggtagactttaggggtgacataaagagctcagtttggactatgttgagcttgagatagttattagacttctgagtgaagatactcttcgtgattctgcgagtcccatgacagcatgaggtaaaaaaagaaagacattgggccgggcgcagtggctca

SEQ ID NO: 165145 - DNA, 601 bp, Human
gtaaaaaaagaaagacattgggccgggcgcagtggctcacgcctgtaatcccagcactttgggaggtcgaggtgggcggatcacgaggtcaggagattgagaccatcctagctaacacggtgaaaccccatttctactaaatatacaaaaaagtagctgggcttggtggcgggcgcctgtagtcccagctactgggaggctgaggcaggagaatggcgtgaacctgggaggcggagcttgcagggagccgagatcgcaccactgcactccagcccactgcactccagcctgggtggcagarcgagattccgtctcaaaaaaaaaaaaagtttatcatagaaaattggaaaatatggataagttaggtaagaaaataaaaatcatgctgcattgtaaacattctgatatgattctaaacatacatataacatgcatttagaacacatcgcttttttctttccaacttttaggttcagggagtacatgcacaggtttgctaccggtaaattgtctgtcacgggggtttggtgtacagattgtttcatcacccaggtaataagcatagtactctatgggtagtttttcgatcctcaccttcctc

SEQ ID NO: 165146 - DNA, 601 bp, Human
cagtaagggggttactgggtctaatggtagttctgagttctttgagaaatcttcgaactgctgtccacagtggctaaactaatttacattcccaccagcagatataagcatactcttttctttgttttgttttgttttaaaactaaagcttattctggccaatttactctactattttctaataacagctcatagatcagaaacggtctttgttttaaactttcctatccatatgaaacacaatgatgttggggtaagaggggccttttctctaaatgaaaatacaatacttattctgtayaattctagagggcccagagatgtggaaataatgtatttgtaagaattatattaaacaatctttatttgataaatagtaccttacaatcctaatgctatctatcaagcttcagtaagagcaatttcagcatcaagtaatgaacagtagctaaactgacaagagatcaatcaaaagggctttaaatggagcagcaccagctgatgtgctgctaaggctctgggcattcaggactctcctatggggaaaacggaatcaaaccagcaggtgctctggacctaagccttcacatcgtgacctgcc

SEQ ID NO: 165147 - DNA, 601 bp, Human
ccagatcttgggccatcttcttgtaggtcatgggtctgacacacatggttcaagttttcgtggctattgtgaatgggattgtgtttttgatttagctctcagctcggatattgttggtgtatggaaatgctatttttgtacaatgattttgtatcctgaaactttactgaagttgtttatcagatctagaagcttttgggcagagactgtggggttttctaggtataaagtcatatcgtctgcaaatatggaagatagttgacttccactcttcctggatgcctttatttttcttactackctatctaggacttccagtactgtgttgagtaggagtggtgagagagggcatcctggtcttattctggttctcaatgggaatacttccagtatggtatgcttccagcagcacatcaactggtgctgctccctttaaagcacttttgattgatttcttgttagtttagctattgttcattacttgatgctgaaattgctcttattgaagtttgatagatagcattagaattgtaaggtactatttatcaaataaagattgtttaatataattcttacaaatacataatttccacatctgtgg

SEQ ID NO: 165148 - DNA, 601 bp, Human
atcctgaaactttactgaagttgtttatcagatctagaagcttttgggcagagactgtggggttttctaggtataaagtcatatcgtctgcaaatatggaagatagttgacttccactcttcctggatgcctttatttttcttactactctatctaggacttccagtactgtgttgagtaggagtggtgagagagggcatcctggtcttattctggttctcaatgggaatacttccagtatggtatgcttccagcagcacatcaactggtgctgctccctttaaagcacttttgattgatytcttgttagtttagctattgttcattacttgatgctgaaattgctcttattgaagtttgatagatagcattagaattgtaaggtactatttatcaaataaagattgtttaatataattcttacaaatacataatttccacatctgtgggccctccagaacatttcagcatgttctggatgttggctgtgggtttgtcatagatatcacttattgttttgaggtatgttccttcgatgcctagcttgttgagagtttttaacatgaagggatgctgaattttattgaaagcattttctgtg

SEQ ID NO: 165149 - DNA, 601 bp, Human
ttttggaaactgtgtctccgtctgttagtggtcattatcctcagtctcttaggatcagagtttttcttagattacaaaactggatcatacagacctgacttccaggtctgcgttctctccactacactttgctgcctcttagaaaaacataagctaaataactagaacccatggaaagagggaaaagtgaagcccagagagctgatgcgggactaagaggcaactctgagagtttcaatgtggaatgtttgtgtggctccccaaccagaccgtgacctccttgaagattgggactgcatcrtatcttgttctcattttctattttattttaatgatctatcctttgggttgaacgaatgtgtttcttgaacccgataagtgcaacactgagtaaacacttgtttcttttctcccttccatcctcccaacttagtagcttcaatacattcttagctctcctcacttgctattctctaaccataccacgtggctgggcacggtggctcatgcctgtagtcccagcactttgggaagccgaggtgggcagatcacctgaggtcaggagttcaagaccagcctggccaatgtggcaaaaccccac

SEQ ID NO: 165150 - DNA, 601 bp, Human
caagaccagcctggccaatgtggcaaaaccccactaaaaatacaaaaattaactgggtatggtggtggcctgtaatccccagctactcaggaggctgaggcaggagaatcgcttgaacccaggaggcagaggttatagtgtgctgagattgcgtcactgcactccagcctgggtgacagagcaagagtccgtctcaaaaaacaaaaacaaaaaaaaccccaggttatctccatgaatgtgaatattgatgtggtccttctgtcaggaagacatcacctgagaccacacacagaaagcctawttttccttaggatacagtcctacatcagggttgacaaagtttttttgtaagggttagatagtaaatattttagattttgcaagccatatggtctcttcctcagctactcaactctgccgttgtactacaagagcagccatagacaatctatacatgaatgagtgtggctgtgttccagtaaactttacttatggatattgatactcagatttcacatgattttcatgtgtaatgaaatgtgattatttttatttaaaacattaaaaatgtaaaagccattttttgcttgcaggccagaca

SEQ ID NO: 165151 - DNA, 601 bp, Human
atattgtctctaacctctgtcatttcatttatgatgctatgtattatgtgtacctttgtctctcttgctggattctgagtatcttgagaggtaggccatggcctagtcagtcatctttgtatccttaatatcaaacccacatagtgggtatttaagaagtgactgttgaatttgaattttatgcttgatatatataaaatgtcatttctgctgatcttaaagagaaacacttgactgatatgcataggtttcccatgttcttccccttgagaggccatagttaactgcatttgctgctagyggctcttgtaaactcagtggttatacagcaaagcctttgcaaagtcttttattttagagctctttttcagacaagaaatgattatactttttcttcaaatcatttattcaatcataatgataaatatggctttcactattctgatgaagcagagctaccatcagtgtgaaataataatagccgttgtttagtgagcatctactacattccagtcaattcagattttttctctagatttttggtgaccttctgattactattaatttacattttttttattgttctctacatgtcaaacaa

SEQ ID NO: 165152 - DNA, 601 bp, Human
gaggccatagttaactgcatttgctgctagcggctcttgtaaactcagtggttatacagcaaagcctttgcaaagtcttttattttagagctctttttcagacaagaaatgattatactttttcttcaaatcatttattcaatcataatgataaatatggctttcactattctgatgaagcagagctaccatcagtgtgaaataataatagccgttgtttagtgagcatctactacattccagtcaattcagattttttctctagatttttggtgaccttctgattactattaatttacattttttttattgttctctacatgtcaaacaaaacaaagcaacaatatcaaaaacccacatgctttttcttcatactgtctatattattgaatgacagacaaacatctgtccttcaagtcaaatattaattaatcatagactcctttctctttttcttcaccccgccttatctaattggccactgtcttagcttttttttttttttttttttttaaagatggagtcttaccctgttgcctagtctggagtgcagtggtgtgatctcggttcaccgcaacctccatctcctgggttcaagcaa

SEQ ID NO: 165153 - DNA, 601 bp, Human
taaatatggctttcactattctgatgaagcagagctaccatcagtgtgaaataataatagccgttgtttagtgagcatctactacattccagtcaattcagattttttctctagatttttggtgaccttctgattactattaatttacattttttttattgttctctacatgtcaaacaaaacaaagcaacaatatcaaaaacccacatgctttttcttcatactgtctatattattgaatgacagacaaacatctgtccttcaagtcaaatattaattaatcatagactcctttctcttyttcttcaccccgccttatctaattggccactgtcttagcttttttttttttttttttttttaaagatggagtcttaccctgttgcctagtctggagtgcagtggtgtgatctcggttcaccgcaacctccatctcctgggttcaagcaattctcctgcctcagcctcccaagtagctgggattacagacatgcaccaccacacctggctaatttttgtatttttagtagagatgggatttcgccatgttggccaggatggtctcgaactcctgacctcaaataatccacccactttggtc

SEQ ID NO: 165154 - DNA, 601 bp, Human
agctgggattacagacatgcaccaccacacctggctaatttttgtatttttagtagagatgggatttcgccatgttggccaggatggtctcgaactcctgacctcaaataatccacccactttggtctcccagtgtcttagcagttttaaaaattatctttggaatttgtctcatctctatttctaattcatttaatctaattgaagccttaatcatttcttttcttccaacatgttgagcatctgttctgattttcctgaccccacttgcctcattctccaattattcttcccatagttrtcagcactgaatgctaataataatactttgttcatatcagttgttattaaaactcttcacttattccttattatcttcaaggtaagcccagcttcccagtcatgacatacaagactctatgtgtgaccccaatacttaacacagatgtgtttcagaattcagaattttttggattttagaaaagtaatacagtttatgcaatacatatataacatcctctgctcattcctgaacactgatgggagtgaatggcaggtgcttttaataattacgctgaggtaaattatgctaggtgtaaac

SEQ ID NO: 165155 - DNA, 601 bp, Human
tttaatctaattgaagccttaatcatttcttttcttccaacatgttgagcatctgttctgattttcctgaccccacttgcctcattctccaattattcttcccatagttatcagcactgaatgctaataataatactttgttcatatcagttgttattaaaactcttcacttattccttattatcttcaaggtaagcccagcttcccagtcatgacatacaagactctatgtgtgaccccaatacttaacacagatgtgtttcagaattcagaattttttggattttagaaaagtaatacrgtttatgcaatacatatataacatcctctgctcattcctgaacactgatgggagtgaatggcaggtgcttttaataattacgctgaggtaaattatgctaggtgtaaactggacctgtcctgggcaaacgaggatgttctttacacagtttaagaatgtcaagcaaagaacattagggatgaagcaatacagggagaatagatagagtgaagggagcagtgggttaagtggagtcctggagaaatatttgaaaagggagaaaggaatgtggctcctgaggtaggagggaaacctggagca

SEQ ID NO: 165156 - DNA, 601 bp, Human
gaaaaattattaaacactagccttctgattaagagaaagttgctattaaagtgacattacagtttttattttaataagttatgctcacgtctttacaatatattatttcagaaagtgctgaaaattcagagctagattatatagcctaccagttgagtctatttcaaatcagatcttatacattcttttctttattgcagtaagatatatttaacataaaatttaccactctgacactttttaaagtgcacaattcagtggcattaaatacattcacattgttgtgcaactgtcaccaccrtccatctccagaacattttttgtcttcccaaactgaaattctgtacccatactcttcattgcctggtccctgtcaactgcagttttttgtgtcacttgtatatattcttttttgaaactacatttcaaataagacaaccatgctagcataagttcactgataggctatttgattccaaggtgaaaattccttggctttgtctgatattctcttgtttatatcagtgtccttccctccctacaaccatataaccgtatcatgtttttattctgtcttttgataactttaattgacaaattt

SEQ ID NO: 165157 - DNA, 601 bp, Human
ttccccttttcaattcattattagcagctatatgggaagagctgccttcttgtaaaccatcacatatgagggcaaattaaaaaaaacaataatcgctatcctctttacactttttatatatatataaatatttccattataaaaatataagctcattatatgaaacttacaaaattcaaaggataagagaataaaaatcacctgtaatgttcccacctagacacatacacatattattcttttttattttcttatttatttacacatattattcttaatattttgatgtattttctctccwctgcattatgttaaacaaaggtaagattacgtatatcatcttacctttatatacacagttttgtatccagtccttttaatattcacgagcattttcccattgtgtgcatgctttttaaacataatttttatagttataaaccttcatagaagccaccttaaattctttctgaagcacagtagtaaatgaatgaataaatcaacaaacaaaatacatttccctggtagatgttctacaattgattttaccattttgttgtttaccgttttctctttgacaaattgtgctgcagtgaacatc

SEQ ID NO: 165158 - DNA, 601 bp, Human
ccttaaattctttctgaagcacagtagtaaatgaatgaataaatcaacaaacaaaatacatttccctggtagatgttctacaattgattttaccattttgttgtttaccgttttctctttgacaaattgtgctgcagtgaacatctttgcagatactcaattttaggattttttttttaaggtaggatcaataaaaatagaactaaaccagggtaaagtatctgagatttttaaaaggtgtttgatatctattgatactaaaaaacctttgggctggccacagtggctcacgcctgtaatsccagcattttgggaggctgaggtgggtggatcacttgagctcaggagttcaagaccagcctggacaatgtggcaaaaccccatctctacaaaaaatacaaaagttagccaggtgtggtggcacatgcctctggtttcagctgcttgggaggctgaggtgagaggattgcttgagcccagaattttgaggttacagtgagctgagattgtgccactgcactccagcctgggtgatggagcgagatcctgtctcaagaaaacaaaaacaaaaaacaaacaaacaaaaaacctttgaactgcc

SEQ ID NO: 165159 - DNA, 601 bp, Human
gtagatgttctacaattgattttaccattttgttgtttaccgttttctctttgacaaattgtgctgcagtgaacatctttgcagatactcaattttaggattttttttttaaggtaggatcaataaaaatagaactaaaccagggtaaagtatctgagatttttaaaaggtgtttgatatctattgatactaaaaaacctttgggctggccacagtggctcacgcctgtaatcccagcattttgggaggctgaggtgggtggatcacttgagctcaggagttcaagaccagcctggacaaygtggcaaaaccccatctctacaaaaaatacaaaagttagccaggtgtggtggcacatgcctctggtttcagctgcttgggaggctgaggtgagaggattgcttgagcccagaattttgaggttacagtgagctgagattgtgccactgcactccagcctgggtgatggagcgagatcctgtctcaagaaaacaaaaacaaaaaacaaacaaacaaaaaacctttgaactgccagcataattgaggtaatttattttagatttttgttggttttaatagatttcattgattaatgtaattg

SEQ ID NO: 165160 - DNA, 601 bp, Human
atgggccccagagaaagaggtggctggcgaaggtgttttccttagttatggggtgagagtgggagaaaaataacattttgactgagaatataggatttatatctctaagcctaaaaatactgggttggtttttttttttttttttttttggtacaattctgggtagtctgcaagtaatattgagtcagcacattttagggacatattacccaatattgaatggataatcatgcttcatggttactgtgactcacatagtaaattggtaatgaaacgttaacatattttataccctgtcccmccatagtctctaatcctaaaattatagtatatttcagtaaatggtgctgtctaggttacatcgtcagccttcttgcatagattcttaaccttttagacttaggaacttatttgagaatttgatgaatcctgtggatccccacctcagaaatacagacacatgaatacacagatttcactcacaatttcagtggatacatagatataccagaagtccatcagattaaggactcctattagccacaatttcagtggatgcatgtgtgccagaagcctgacagattaaggactcctattttat

SEQ ID NO: 165161 - DNA, 601 bp, Human
cctgtagtcccagctacttgggaggctgaggcaggagaatggcatgaacctgggaggtggagcttgcagtgagctgtgatcactccactgcactccagcctgggcaacagagcgagacaccgtctcaaaaaaaaaaaaaaatccagatagtaaatatattatgctttgtgggccacagttgggctctttgttctttacttgaagatccagattttcatctggcatcatttctctttagcctgatgcacttcctttagcagttcttatagtaaagacatgttgactactaatgctcttaggtttttttttttttttttaatttgaaaatgtgtttgttttttttttaatttgagaatattttgctggacatagagttctaggctattggtcgttttgtattttttttaactttcaacattaaaaagatactattttattggcttcccatgtttttgatgaaagtcagctgacattcttatgaatgtaattttttttctttgactgctataagatttttccctatttttggttttcagcagtttgattataatataccaaattcgtagctccgttctactgccatctcctgtgtgggcctcag

SEQ ID NO: 165162 - DNA, 601 bp, Human
gttttgtattttttttaactttcaacattaaaaagatactattttattggcttcccatgtttttgatgaaagtcagctgacattcttatgaatgtaattttttttctttgactgctataagatttttccctatttttggttttcagcagtttgattataatataccaaattcgtagctccgttctactgccatctcctgtgtgggcctcagttttgattagtttttattagcctacctttgaattcattgatcccttctttttctgtgtccagtctgctgttaaacccatctggtgacttmttcatttcagatcatttatttttcagttctagaatttccctttctctgctggaattctttgctctttacccattctgttgatcttttcctctaaattatttaacatattcataataacttttaaagtcttcatccacggatctctccctgttgactttgtttctttattatgggttataggcacaccttggagagactgtgggtttggttccagaccaccaaaataaagtgaatatcccaataaagcaagtcacacataatttggtttcccagtacatataaaagttatacactacattg

SEQ ID NO: 165163 - DNA, 601 bp, Human
ttttgtattttttttaactttcaacattaaaaagatactattttattggcttcccatgtttttgatgaaagtcagctgacattcttatgaatgtaattttttttctttgactgctataagatttttccctatttttggttttcagcagtttgattataatataccaaattcgtagctccgttctactgccatctcctgtgtgggcctcagttttgattagtttttattagcctacctttgaattcattgatcccttctttttctgtgtccagtctgctgttaaacccatctggtgacttcwtcatttcagatcatttatttttcagttctagaatttccctttctctgctggaattctttgctctttacccattctgttgatcttttcctctaaattatttaacatattcataataacttttaaagtcttcatccacggatctctccctgttgactttgtttctttattatgggttataggcacaccttggagagactgtgggtttggttccagaccaccaaaataaagtgaatatcccaataaagcaagtcacacataatttggtttcccagtacatataaaagttatacactacattgt

SEQ ID NO: 165164 - DNA, 601 bp, Human
ttctagaatttccctttctctgctggaattctttgctctttacccattctgttgatcttttcctctaaattatttaacatattcataataacttttaaagtcttcatccacggatctctccctgttgactttgtttctttattatgggttataggcacaccttggagagactgtgggtttggttccagaccaccaaaataaagtgaatatcccaataaagcaagtcacacataatttggtttcccagtacatataaaagttatacactacattgtagtctgttcagtctgtagtagcattrtgtcaaaagaaaacacaatgcatatgccttaatttaaaatactttattgctaaaaaaaaaatgctagcaatcatccaagccttcagcaagtcataatcattttgctggtggagactcttacctccatgttgatgactgctagaccattcagggtggtggttgctaaagattggggtgactatagcaatttgttttgttatgtaatattctatatcctttgctgtcttttcaacaatattcacagcatcttcaccaggagtagattccatctcaagaaccactttctctgctcattcttaa

SEQ ID NO: 165165 - DNA, 601 bp, Human
tttgggaggccaaggtggatggatcacctgaggtcaggagttcaagaccagcctggccaacatggcgaaactccatctctactaaaaatacaaaaattagctgggtgtggtggcgcatgtgtgtaatcccagccactcaagaggctgaggcaagagaatcgcttgaaccggggagggagaggttgcagtgagccaagattatgccactgcactccagcctgggtgacagagcgagactccatctcaaaaaaaaaaacaaaaaacaaaaccaacttgacagtagaaattactccttgatccrtggactacagaatggatactgtgttagcaagcatgaaaacagcattcatctccttgtatatctctatcagaactcatgggtgacaaggtgcattgtcaacgagcaatagtattttgtgagaaatcttttttcctaagcaataggtctcaacagtgggctgaaaattgcatttttatgttatggagatagcttctttccttaatcttcataaacaaacaacctctactagcctccaacttttcctctcacagcctttataaaattgaagagaattagggccttgctctggattaggctttg

SEQ ID NO: 165166 - DNA, 601 bp, Human
cacacaccttcaatttgtaaaaaacacaacatctgcaaagcacaatgaaatgaggtatgcctgtactcatttgcttcttcacatgtcttagaagttttaactgcatactggaccttttgtataacagaggggtagagaatgaactaggtaatactttttgttttatttttgttaaagagagcagttctttcctccagcaggtagctaaggtgatcactcaaatttgacagtgaatcaagctgagctggggctgagcagtagctttaattgatttcagtttgcctctggattcaaatgagawtaaggaaatttgacttttagcccaaccttagctttctatatcatttagacgaggggttcatttctttgattttagcaagattgcagctgggaggcagttgggttgaagattaaattaatttactttacctctggattgcaactatagcagggccctggaacccaagcaccacacagcattgggagatctctttctgtctctcactgtgctcccaccagcacttactaagattctcttgtagtattacatgtaattgtcaggtcaagagatttgtttttacacttgggactctttcagatt

SEQ ID NO: 165167 - DNA, 601 bp, Human
tgctttttcatggctttacagaaaagtatgaagtttagtttatctggtgttttcttgttttgatgagagcagtggtcttttgggatcagctgcattcaaaccaggttggaacgctttagaatgatggcattaagattctttgccttctgctttcaaccttccttttcaacctcatctctttttattcttttaaccacaccacagtgcctccctttcattcccacagcacattgtatacctccatacctttgttccttctgccttgattgtccttcttctcatcttacaactttgtcctttraaactcaactcacatgacacctcttctgtgccacagatcctcctgctacaatgtacctacctttacttgtgtactttcacattatattgtgatgatttatattatatgctgctgcttttaaactaaggacatgccagacatgccttcatctgaaaatgttaatatagttcaaagtgttgctatagtctttgtttagttaaagtaacaactttctggtctgaaaaaaaaaagactatgcatcccttcaacagaataagatagttttaaaagtaatgatatgggagcatctcttaagatatg

SEQ ID NO: 165168 - DNA, 601 bp, Human
ttgtgtactttcacattatattgtgatgatttatattatatgctgctgcttttaaactaaggacatgccagacatgccttcatctgaaaatgttaatatagttcaaagtgttgctatagtctttgtttagttaaagtaacaactttctggtctgaaaaaaaaaagactatgcatcccttcaacagaataagatagttttaaaagtaatgatatgggagcatctcttaagatatggtcagtgttatgttttaccatttgtatttagaaaaacagctgtgtgtgtatgtatgtatgtatgtaagtatgtatgtatgtatgtatgtattaatttattttgaaacggagtctcattctgtcacccaggctggagttcagtggtgcgatctctgctcactgcaacccccgcctcctgggttcaagcaattctcccacctcagcccctagagtagctggtgttacaggtgcatgccaccatgcctggctaatttttatatttttagtagtgacagggtttcaccaagttgcccaggctggtctgaagctgctgacctcaggcgatctgctcaccttggcctctcaaagtgctgggattacaggcgtg

SEQ ID NO: 165169 - DNA, 601 bp, Human
tacttgacaattacttgatgctcaataaaatgattcttattagcaaaataaaccttacacgtagaaaaagaatatgccaggaaccaagaaaagggatattcagatatgaggctcttggagttacggctcagctcacaaggattctgccgtaggtgagaaatgctccattacccagaggcaaagccccagaggttgtggcagcactttatgactatgtatcagtctgggctcagtcagggaaacattgagccactgttaagtgttataggagtgaggggtttaatatagtaattaaggcctrtgcaaatatgggaggactagagaagtgaaggtctgcacgttttttattgtatactggacacgttgtttacaataggagtagggaatgagctggatacagctacagttggaagaccagaggaataggcactgatgactgaaacctgcagctctagagagggcagagaagtgctaggaaactgcctctcgctgccaaagtaggactcagtgtgggatcccaaggaaaggtctgtgaagactgccacggggataaagtggagctttaggagaggccagtggagcgactgcatctgactgccct

SEQ ID NO: 165170 - DNA, 601 bp, Human
tggtggtggtgccagttgaccatccagcataggccattcctttgccagcctggcttacatacacacctacttaaaccatatttaactgccagataaagctaaatgctctgcttaacatgttgtaactatcgcttagcaaactgaaaacatgctaagcactccctcaaagaggagatgctgtatttcatattgtgctttgtacatttctggctgatatgaatgtattccactagctgagtcacatcccctctttgatatcctaaaacttacatatactgagatacagagttagccatttcctttttttttttttcttggcaaggtcttgttctgtcacccaggctgcagtgcagtggcgccatcatagctcactgcatccagaatctcctgggcccaagcgatccgcctgccttagcttcttgactataggtgtgcaccaccacacctagctaaattttttttatttttaactttttgtagagacaagaggtatcactgtgttgcccaggctgctcttgaactcctggcctcaagcaatcctgttgccttagcctctcaacgtgttaggattataggcatgaaccaccgtgcccagccagag

SEQ ID NO: 165171 - DNA, 601 bp, Human
aactgccagataaagctaaatgctctgcttaacatgttgtaactatcgcttagcaaactgaaaacatgctaagcactccctcaaagaggagatgctgtatttcatattgtgctttgtacatttctggctgatatgaatgtattccactagctgagtcacatcccctctttgatatcctaaaacttacatatactgagatacagagttagccatttcctttttttttttttcttggcaaggtcttgttctgtcacccaggctgcagtgcagtggcgccatcatagctcactgcatccagaayctcctgggcccaagcgatccgcctgccttagcttcttgactataggtgtgcaccaccacacctagctaaattttttttatttttaactttttgtagagacaagaggtatcactgtgttgcccaggctgctcttgaactcctggcctcaagcaatcctgttgccttagcctctcaacgtgttaggattataggcatgaaccaccgtgcccagccagagtcaatacaccttatattagagagtattattagacagggaaaagtggaaaaaagaattcgttaatatattcagtatatattcat

SEQ ID NO: 165172 - DNA, 601 bp, Human
tgttctttgcctggtggggtggcctaaaccttcattctggggtgtatgtaccaataaatggccatattgttttgctctaatatcccgttaactttccataataaacaagtgtaatagaaaatcctaggttccaggcaatttctttccttcttccattgagtatttttttcccattgtgtattttaaacttggttcttccttgataatcgggatcaatcagcctagctattatagtacctgccttacttgtctttggctaagtggcatgaggagcaagaagtgctgagttaacagtctcagytctctgttcagtggaaataatgttgtgtctcccccaaagaagcacttctcccttgaggattaagacctgtaaactgggagagcccacagctgctgcgagttttcttttggggaaggattttgataatatttagtgaatatagggctatttcgattttcttgttcttgtatcaattttgataaattgtattttttaaagtaatttggccatttcacttaagttgtcaaatttgttggcaggaagctgcagtattttcttagagtccttctaatctttgtcaaattgatagtgataactttt

SEQ ID NO: 165173 - DNA, 601 bp, Human
tgggttcctttataatactcttgtgaatgcatttacttttgttttagcaggcaatcaactcaggtaggctggattatacattgttttgccttttgcaggcagtgattcaaatcccaattcagttatcaaagcaaagcctttgctaaactggtttgggtttgtcctgtgcatgtgtgattcagaggttaaggtgagacccgtgtaggtgcatacataaaagtggagagctccttcacctgctgtttctgctccaggagtttgctctgactccctgtctttctttggctcctttccctgcttsctctgaccagaaagaaaacaattcctatcagagttttagccacctacgtgtgctgcttagtgactgaagctgtcccaccctcaaggaaaaacttgatgagaaaaaaataaacaaacagaaaactcaccctgtaaggtcacttctccaactttttacttccctccacaatctgcctgcttttatttactttccagatcctcatatagttttttgttttgttttgttttgctgtgttttgagatggagtttcactcttggtgcccaggctggagtgcagtggcacaatcttgtctcactgaa

SEQ ID NO: 165174 - DNA, 601 bp, Human
tgccattatggtgaataagatattttgtaagggaaaggatgctggtttttgacagaaatgttgtgggcagagaaggaaatcttcattgagtaaaagcagtgtcctttttagatggaagcggtccagtgtgatcatcctgctacagatggctgcccagaccccctgggagcagcgctttattggggcaccattgttggcctctcctgttggcaggttggacacttagccatgattgttgccaggtcagccttgacaggtggaagcctgtgtcactgagcacatgcatgaccttcattcctgytgctctcacagtaggatatgaactttgttcattagcgttctgagcaagggaaacagtggctgataaaataatgagtcattttgtccacttggttattgagagcctcctctgctgagattatacattggtcatcatttacatgggacacaaataccctcacactttgtcctgtttgagaatagtttattgacatagctcttttctatatcttaccacaagtttcccaaccttattctaagtttctgaatttccagtcaaaccatctgctgctgaccacaaatcagtgtggattcgtattta

SEQ ID NO: 165175 - DNA, 601 bp, Human
gtgcttataaagtatagccatgtgcccattgtttctgtcatgaagcgtcaccagttggctgctgtgactcagagatcttttcatccttcccttgggttcagggaatctatttctctgacagcctttcccattgttatttctagcctgcagcgaacaagcactaaagagctttttagggatgttgttgcccccttcaccaatgtatttctcaaaggcttggtaaaggagtgagttctctagacattcctgggatgtagttaggagatcagtgaacagatcagtcatacgtattaaatacacyccagtattccttattttctaaccttttgaataaattttattttgagactgagttttgctcctgttgcccaagctggagtgcaatggcactgtctcagctcattgcaacctctgccttccgggttcaagcacttctcctgctcagtctcctcagtagctgggattacaggtgcccgacaccatgcccagctaatttttgtatttttagtagagacagggtttcaccatgttggtcaggctggtcttggaactcctgacctcaggtgatccacccaccttggcctcccaaagtgctgggatt

SEQ ID NO: 165176 - DNA, 601 bp, Human
gtaggaacctgacccaacacaggcaaataaaggtctttccctgggactgtgaaatggtaccaagggaagaaaggtggtttctctctggtagggagggccactggatataaggcacaggaactgttgctggaagcgttagacactgctgactgcttgttcctttttccctgttagtaaagactattcctttaaaaaaccaaaaaaggtagataaaaatgccagatattcattttcccatatactcttgtgggtggaatgaccacttgaccatttttttgtagccagtgatacataaggagatttttttttaacagggaaaaaaagagcttacaaattttatgtgcacatgtgtgcatgggagttatacaattcttttaaaaaaaaaactcaaatggctagatgattgacacttttgtaccaccctgagatacagaaagaataggggcttggatcatggccaaacaagttatggtggcaaaacaggttatgggaggaagagaagaccacctttgcctggctagcaaaggtagtcttgaactctcacaggcagcagccctcagaaagaatggatagtagccagtgataaatgtttctagcagac

SEQ ID NO: 165177 - DNA, 601 bp, Human
agacagggtctcgctctgttgcccagagtgctctggaatgcagtggcacgatcatagcttactgcagccttgacttcttgggctcaggtgatcctcccaccttggcctcccaaagttctgggattataggcatataggcatgagccactttgtctggcctaaattttagttaaagaaattcttatctcattctttcagaattttcataggccttcaaagcaacaaccatggagttaaattcatttcctcaacttggcaggattttttttttcccctattgaagtattttgtcttttttttktgtgtgtgtgacagggtttcactcttcgctctgttgcccaggctggagtgcagtggcatgatgatagctcactgtagccttaaactcccctgggctcaagccatcctcccacctcagctccctgagtagctgagaccataggcatgcaccactatgcccaactaattattgtattttttgtagagacaagatgtcaccatattacccaggctggcctcaaactcctgagctcaagtgattcacctggcccggcctcccaaagtgctgggattacaggagtgagccactgtgcccagccat

SEQ ID NO: 165178 - DNA, 601 bp, Human
caaaaaattagctgggtgtggtggcatgtgcctataatcccagctactcgggaggctgaggcaggagaatcatttgaactcgggaggcggaggttgcagtgagccaagatcatgccataactctccagcttgggtgacagggcgagacttgatctcaaaaaaaataaaataataaaataaaataaacaaattatgctggctacaaaattttcttttgcaaatactaaatgttggaaaatgatggagcagtgggcagtgatccttagcttatgtggtctttgaactccctgcagtaatattkggacctctatgtcttgatgcaagttgattttcctgggaatagaatctatatcgttcctcatattttccaggatttcatgaaacaaagagttaagaactacagtagtggagcaatattcatggtgctttttctttttcttttgaaataattaaaaacttacagaaaggctgtaagaataatacagagaaatcctgtgtattctttcccaaattcatgtgtttgtcttctctctctttctctctccttataaaatatttcaatgttgttagttatctcaaaatggactttgtagtttttttt

SEQ ID NO: 165179 - DNA, 601 bp, Human
tttatccctttcaattaaaaaacaatcagtggtcgggcactgtggctcatgcctatgatcccaacactttgggaggcagaggcaggaggatcgcttaagcccaggaactcaagaccagcctgggcaacatagggagaccccatctctactggactggtggcatgtgcctcttgtcccagctgcaggaggctgaggtgggaggattgtctgagcccaggatgtcaagcctgcagtgagctgagattgcaccactgcactccagcctgagtgacagagtgagaccctgtctcaaaaataaatwaattaattaaaaataaaaacgatcaatgtggaaaaaacttgaagactgtgcaaatagccatatgttgcttaacgatgggaatacattgtgaaaaatgtgttattaggtgattctgtcattgtgcaaacaccatagggtgtacttacataaatttagatggtatagcctgctacatagctaggctatatggtttagcctattgttcttaggctacaaaactgtacagcttgttactgtactgaatattgtaggcagttgtaacactatgataagtattatataaacatgtctaaacatagg

SEQ ID NO: 165180 - DNA, 601 bp, Human
tcaaaaataaataaattaattaaaaataaaaacgatcaatgtggaaaaaacttgaagactgtgcaaatagccatatgttgcttaacgatgggaatacattgtgaaaaatgtgttattaggtgattctgtcattgtgcaaacaccatagggtgtacttacataaatttagatggtatagcctgctacatagctaggctatatggtttagcctattgttcttaggctacaaaactgtacagcttgttactgtactgaatattgtaggcagttgtaacactatgataagtattatataaacatrtctaaacataggaagatacagtaaaaatacagaattataatcttatgggaccactgtcataagtgtggtttattactgaccaaaatgtcattatgtggcacatggctgtatcttgcttttcatcaggctttacactctagatgagcatccattgattattcttacccacaccaatggtacagttatgatagttggaaaatgctgcttttttccaactccactactccctccatttcatggtattctaatgaatgatcattgtcacaaaattcaacacctaattgtatctgttatgataat

SEQ ID NO: 165181 - DNA, 601 bp, Human
attacggagggagtaggggtgatggtggggtaacattgttaaaatgattctaagttcaatcaggcaagaataacaagaaaaaaaaattcgggccaggtgcggtagcacacgcctgtaatcccagcactttgggaggccaaagcaggcagatcacctgaggtctggagttcgagaccagcctgaccaacatggagaaaccctgcctctactaaaaatacaaaattagccaggcatggtagcacatgcctgtaatcccagctactcgggaggctgaggcaggagaatcgcttgaactcaggaygcggaggttgcggtgagccaaattcatgccattgcactccagcctgggcaacaagagtgaaactccatctcaaaaaaaaaaaaaaaattctgatttcactgcgtaattttaaaaataatattttaattttgttttgaactaaatattttaaaattatttgtgttcataaattatttagaattgtttttaagggttttctaagttacatttttgttactcctttctgacttaaatataatatagttaaagaatattatctaaatgatactaattctgtaaaatgttgttgaagcttaatga

SEQ ID NO: 165182 - DNA, 601 bp, Human
tgtgaatcttactgtgtgtgtgttcctgagaaggatgtgtattcactaattaatgggtgctgggttttattggtaggccagaagtcaaacttgacagttatgtagcccttaattcatgctaatgttttgtatcattggtctgtaaataactgaaagagctgtgttgaaatcttccactttgtggatagatttgttcatttctctctaaagttgtcaaattttgctttattttgaggctattttttgagagcttacaaatttagattcattagcattttctagcaaattgaacattttattrtaacatacggactatcactaaaaatgctttttgtcttacagagtagaattgctaaataaaatacaggatgctcaattaaatttgaatttcagataaatgttgagtacttttttagtataagtatgttctacatattgcaaaaattattcatttttcacaggaacagaaaaccagataccacgtgttctcacttataagggggcactaaatgatgagaacacatggacacatggcggagaacaagacactggggtgtactggagggtggagggtggaggagggagaggatcaggaaacata

SEQ ID NO: 165183 - DNA, 601 bp, Human
tactgtgtgtgtgttcctgagaaggatgtgtattcactaattaatgggtgctgggttttattggtaggccagaagtcaaacttgacagttatgtagcccttaattcatgctaatgttttgtatcattggtctgtaaataactgaaagagctgtgttgaaatcttccactttgtggatagatttgttcatttctctctaaagttgtcaaattttgctttattttgaggctattttttgagagcttacaaatttagattcattagcattttctagcaaattgaacattttattgtaacatacrgactatcactaaaaatgctttttgtcttacagagtagaattgctaaataaaatacaggatgctcaattaaatttgaatttcagataaatgttgagtacttttttagtataagtatgttctacatattgcaaaaattattcatttttcacaggaacagaaaaccagataccacgtgttctcacttataagggggcactaaatgatgagaacacatggacacatggcggagaacaagacactggggtgtactggagggtggagggtggaggagggagaggatcaggaaacataactaatggg

SEQ ID NO: 165184 - DNA, 601 bp, Human
tcaaatgctttttatttttcccacttgttttgtgcttttgtggactgttttctttttgcatgattttaaaaaaattccatgttctcttactattattttagacattacacatatttattattttgttaacctttaaatattactgtcaggccaggcacggtggctcatgcctgtaatcccatcactttgggaggccaaagcgggtggatcacctgaggtcaggtgttccagaccagcctggccaacatggcgaaaccccgtctctactaaaaatataaaaattagccaggcggggtggcargcgcctataatcacagctactgagaaggctgagtcaggagaatcgcttgaacctggaggcagaggttacagcgagccgagatcatgccattgtactcgagcctcggcgacagagcaagactctttctcaaaaataaataaataaataaatatatattactgttcaaactctacttgataaagttatttaatatttttaaatccccacacaaacatcctaactctgataactacccttttaatgcttatgctattactgttgaatatttaagttctttttttaacactatatgttagacat

SEQ ID NO: 165185 - DNA, 601 bp, Human
agtgaaagtccattgatcctgtttcgtaattggatgaagagtgtccaaactattgccagtagctttctgttttcccatcatttttcaacccagaaatatttatttttctttccagggaggcattagcagtaccctggaagctcccctcctacccctccaaattattccctcctcctctttacttttctccaaagataatctctgtcctgaatcaaaaatcgtccccgcttcctggtagcacccgatctggaagaaacccaaaatcacctaaccaaaacctgaatcatataatagtcttttytaatactcttttactgagacattccacaattcccaattatatgtgttattccttgctgaaatgaataatgaacccaacatgtgcaactacagctatgttcctggtaacctttggctgggaggattgacaatattcatttgtgtctggtttctttctttctttttttctttttcttttttttttttttttttttgagacggagtcttgctctgtcccccaggctggagtgcagtggcacaatctcggctcactgcaagctccacctcccgggttcactccattctcctgcctcagcctccc

SEQ ID NO: 165186 - DNA, 601 bp, Human
cggcctcccaaagtgctgggattacaggcgtgagccaccgcgcccagcctggtttctttctttttaacattttgtaagattcatgtttttgcatgtagtcatagttttttttgtgtgtgtgatggaatttcactcttgttgcccaggctggagtgcaatggagtgatctcgtctcaccacaacctccgcctcccaggttcaagcgattctcctgcctcagcctcccgagtagctggtattacagacatgtgccaccacgcccggctaattttgcatttttagtagagatggggcttcaccmtgttggtcaggctggtctcaaactcctgacctcaggtgatctgcccgcctcagcctcccaaagtgctgggattacagttgtgagccaccgtgcccggccttgttcatttttgttatttaatattatgctataattacataactatttggaactttttgactctgttttaatgttgatacacagtatctttgtacatatcatttggtgaacatgaataatgcatttttgttgggagtatgcctgggagttatattgggagttcccaagaccactcatagtaatcagaagttatgattatga

SEQ ID NO: 165187 - DNA, 601 bp, Human
atccatgttacaggatgtgacaggacttcctttttaaggctgcatagtatttcattgtatgtctgtaccacattttgttcatccattcatctgttgatcaatttgggttgcttccatttcttggctattgtgaatagtgctgcagtgaacatgatgtgcagatatctctttgagttcttgctttcagttattttgtgtatactcagaagtggaattgctgaattatatgggagttctattttttattttttcaggaagctgccgtactgttactccatagcagctgcactattttacatcccttccagtagtgcacaaaggttccagtggtgcacaaaggttccagttttccacagctcaccaacacttgttattttttttatttttttattttttatttttttaaatagtagccattctaatggatatgaatggtaactcattatggttttgatttgcatttctctgatgattagtgatgttgagcatcttttcatatgcttgttgtctatttatgtatcatctttgggaagaaatactttgttcatttttaattggattttttgattttttgctgtgaattgtagaagttctttatgta

SEQ ID NO: 165188 - DNA, 601 bp, Human
ggatgtgacaggacttcctttttaaggctgcatagtatttcattgtatgtctgtaccacattttgttcatccattcatctgttgatcaatttgggttgcttccatttcttggctattgtgaatagtgctgcagtgaacatgatgtgcagatatctctttgagttcttgctttcagttattttgtgtatactcagaagtggaattgctgaattatatgggagttctattttttattttttcaggaagctgccgtactgttactccatagcagctgcactattttacatcccttccagtagtgcacaaaggttccagtggtgcacaaaggttccagttttccacagctcaccaacacttgttattttttttatttttttattttttatttttttaaatagtagccattctaatggatatgaatggtaactcattatggttttgatttgcatttctctgatgattagtgatgttgagcatcttttcatatgcttgttgtctatttatgtatcatctttgggaagaaatactttgttcatttttaattggattttttgattttttgctgtgaattgtagaagttctttatgtaattctgaatatt

SEQ ID NO: 165189 - DNA, 601 bp, Human
atgtgacaggacttcctttttaaggctgcatagtatttcattgtatgtctgtaccacattttgttcatccattcatctgttgatcaatttgggttgcttccatttcttggctattgtgaatagtgctgcagtgaacatgatgtgcagatatctctttgagttcttgctttcagttattttgtgtatactcagaagtggaattgctgaattatatgggagttctattttttattttttcaggaagctgccgtactgttactccatagcagctgcactattttacatcccttccagtagtgcacaaaggttccagtggtgcacaaaggttccagttttccacagctcaccaacacttgttattttttttatttttttattttttatttttttaaatagtagccattctaatggatatgaatggtaactcattatggttttgatttgcatttctctgatgattagtgatgttgagcatcttttcatatgcttgttgtctatttatgtatcatctttgggaagaaatactttgttcatttttaattggattttttgattttttgctgtgaattgtagaagttctttatgtaattctgaatattaa

SEQ ID NO: 165190 - DNA, 601 bp, Human
gtataatttgacttatggggtacatagaataggtcaattcatagagatagaaagtagaatggaggttatcaggggtggggtatgatttcattcctgtaaagttcagagttactcttattggaggaaaggatacattatgactagaaggagggacaaggaaggccactgggtcatcttctatttctcaatctgtgtttactccatagaatttgattgagctgtttagctgtggtttgcacattttcctttacgtataaactttttacatatatacttttattaaaatctacttaaaatgggraaaaaaaagatatctagatttcagcttttaaatgctggtgcaatgatagccattttcggctgggtgcagtggctcacacctgtaatcccagcactttgggaggctgaggcagctggatcacctgaggtcaggagttcaagaccagcctggctaacatggtgaaactttgtctctactaaaaattagccaaacctggtggtgggttcctgtaatcccagctactcgggaggctgaggaaggagaattgcttgaactcgggaggcagaggttttgcagtgatccaagactgtgccactgcac

SEQ ID NO: 165191 - DNA, 601 bp, Human
atagccattttcggctgggtgcagtggctcacacctgtaatcccagcactttgggaggctgaggcagctggatcacctgaggtcaggagttcaagaccagcctggctaacatggtgaaactttgtctctactaaaaattagccaaacctggtggtgggttcctgtaatcccagctactcgggaggctgaggaaggagaattgcttgaactcgggaggcagaggttttgcagtgatccaagactgtgccactgcactccagcctgggtgacagagtaagactctgtctcaaaaaaaaaaaamaaaaaaaaaaacaagacaaaacactcatatctgaaatgtggtttacatagaatgttcttccaggcaaaaaaaacaagattaaaattactggttttgaaaatgtattctgttctttcttatatcaaagtcttgatgttggtggctagagagaacttcttaggttttctacctgtattagtccgttttcatactgctataaagaactgcccaagacggggtagtttataaaggaaagaggtttaattgactcatagttcagcatggctggggaggcctcaggaaacttaaaatcatagtaga

SEQ ID NO: 165192 - DNA, 601 bp, Human
ggttttgcagtgatccaagactgtgccactgcactccagcctgggtgacagagtaagactctgtctcaaaaaaaaaaaacaaaaaaaaaaacaagacaaaacactcatatctgaaatgtggtttacatagaatgttcttccaggcaaaaaaaacaagattaaaattactggttttgaaaatgtattctgttctttcttatatcaaagtcttgatgttggtggctagagagaacttcttaggttttctacctgtattagtccgttttcatactgctataaagaactgcccaagacggggtartttataaaggaaagaggtttaattgactcatagttcagcatggctggggaggcctcaggaaacttaaaatcatagtagaaggtcaagaggaagcaaggcactttcttcacaagtcacaaaggagaagtgctaagtgaaggatgaagagccccatataaaaccatcacatctcgtgagaactcactcactatcacgaggacagcatgggggaacctctgccgtgattcagtgacttccacctggtctctcccttgacacgtggggattatggggattataattcaagaggagatttggatg

SEQ ID NO: 165193 - DNA, 601 bp, Human
cacctggtctctcccttgacacgtggggattatggggattataattcaagaggagatttggatggggacacaaagcctaaccatatcactaccatttttcttttctttttttttcatgcctggattttttcgttgttccctcatgaacattttaaagtgtaattaagcaaaagagaatactatacaatggtttttaacaatttttttaagtttcccccctccccccaagacagggtttcccaatgttgcctaggctggtctcgaactcctggcctcaagtgattctcccacctcaccctcytaagtagctgggactacagacatgtgccactgtgcccagctgcctatacagtgtttttattttattttatttttttaagatggagtcttgctttatcacccaggctggagtgcagtggcattatcttggcttaccgcaacctctgcctcccggattcaaatgattctcctgcctaagcctcccaagtagctgggattacaggcacccgcctccatgcctggctaatttttgtatttttagtagagacagggtttcaccatgttggccaggctggtctcgaactcctgagctcgtgatctg

SEQ ID NO: 165194 - DNA, 601 bp, Human
ttttcttttctttttttttcatgcctggattttttcgttgttccctcatgaacattttaaagtgtaattaagcaaaagagaatactatacaatggtttttaacaatttttttaagtttcccccctccccccaagacagggtttcccaatgttgcctaggctggtctcgaactcctggcctcaagtgattctcccacctcaccctcctaagtagctgggactacagacatgtgccactgtgcccagctgcctatacagtgtttttattttattttatttttttaagatggagtcttgctttrtcacccaggctggagtgcagtggcattatcttggcttaccgcaacctctgcctcccggattcaaatgattctcctgcctaagcctcccaagtagctgggattacaggcacccgcctccatgcctggctaatttttgtatttttagtagagacagggtttcaccatgttggccaggctggtctcgaactcctgagctcgtgatctgcccgccttggcctcccaaattgctggggttacaggcgtgagccaccatgcctggcctttaatttttttaaaaagtaaaacttctttaattttctt

SEQ ID NO: 165195 - DNA, 601 bp, Human
tgaacattttaaagtgtaattaagcaaaagagaatactatacaatggtttttaacaatttttttaagtttcccccctccccccaagacagggtttcccaatgttgcctaggctggtctcgaactcctggcctcaagtgattctcccacctcaccctcctaagtagctgggactacagacatgtgccactgtgcccagctgcctatacagtgtttttattttattttatttttttaagatggagtcttgctttatcacccaggctggagtgcagtggcattatcttggcttaccgcaacctstgcctcccggattcaaatgattctcctgcctaagcctcccaagtagctgggattacaggcacccgcctccatgcctggctaatttttgtatttttagtagagacagggtttcaccatgttggccaggctggtctcgaactcctgagctcgtgatctgcccgccttggcctcccaaattgctggggttacaggcgtgagccaccatgcctggcctttaatttttttaaaaagtaaaacttctttaattttcttctcgcaagaattgaatagaatgatagaatgaatgccagtattttataa

SEQ ID NO: 165196 - DNA, 601 bp, Human
tggcctttgttacagaataggttgctaacctctgagtttctcagttttagcccattcacaaatgaaatagtttttttttgttgttttttttgagacagcctcactctgtcgcccaggctggagtgcagtggcatgatcttggctcactgcaacctctgcctcttgggttcaagcaattctcttgcctaaacctcctgagaagttgggactataggcacatgccacaacgcctggctaatttttgtatttttagtagagaccaggtttcgccatgttgaccaggctggtcttgaactcctgrcatcaagtgatctgcctgtcttggcctcccaaagtgctgggatcccagcctctctctctctctttctcactctctctctctcccgctctctctctctctctctctctatatatatatatatatattttttttttttttttttttttttttgagacagggtctcattctgtcacccaggctggagtgcagtggcataatcacagctcactgcagcctcaaccccacgggctcaagcaattctcctgcctcagcctcccaagtagctgggattacaggtgcgcacaaccacgcccagctaat

SEQ ID NO: 165197 - DNA, 601 bp, Human
tcgcccaggctggagtgcagtggcatgatcttggctcactgcaacctctgcctcttgggttcaagcaattctcttgcctaaacctcctgagaagttgggactataggcacatgccacaacgcctggctaatttttgtatttttagtagagaccaggtttcgccatgttgaccaggctggtcttgaactcctgacatcaagtgatctgcctgtcttggcctcccaaagtgctgggatcccagcctctctctctctctttctcactctctctctctcccgctctctctctctctctctctctmtatatatatatatatattttttttttttttttttttttttttgagacagggtctcattctgtcacccaggctggagtgcagtggcataatcacagctcactgcagcctcaaccccacgggctcaagcaattctcctgcctcagcctcccaagtagctgggattacaggtgcgcacaaccacgcccagctaatacttgtatttttttgtagagacgaggcttctccatgttgtccaggctgttctcgagctcctggaactcaagcaatctgcctcaggcaggaatcctgaaattctgggat

SEQ ID NO: 165198 - DNA, 601 bp, Human
cagtggcatgatcttggctcactgcaacctctgcctcttgggttcaagcaattctcttgcctaaacctcctgagaagttgggactataggcacatgccacaacgcctggctaatttttgtatttttagtagagaccaggtttcgccatgttgaccaggctggtcttgaactcctgacatcaagtgatctgcctgtcttggcctcccaaagtgctgggatcccagcctctctctctctctttctcactctctctctctcccgctctctctctctctctctctctatatatatatatatatattttttttttttttttttttttttttgagacagggtctcattctgtcacccaggctggagtgcagtggcataatcacagctcactgcagcctcaaccccacgggctcaagcaattctcctgcctcagcctcccaagtagctgggattacaggtgcgcacaaccacgcccagctaatacttgtatttttttgtagagacgaggcttctccatgttgtccaggctgttctcgagctcctggaactcaagcaatctgcctcaggcaggaatcctgaaattctgggattataggtgtgagccact

SEQ ID NO: 165199 - DNA, 601 bp, Human
ctcgacaactgattatgttaaaatttgaagacgtgtatgaggtttttgtttgtgagggctatatgactggcgtttctccagtatatgacactttgttcatccctatgttcctctttataaactgcagaaattctaaatataatgcattagttgtctattgcttgcaagtagtagactgaatgatggctccataaagatgtccacttccattagataaagaaaatgtgtacatatacaccatgaaatattgcacagccataacaaagagcgaaatcatgttctttgcagcagtttggatggmgcttgaggccattatcctaagtgaattaatgcagaaacagaaaaccaagtacctcatgttctcacttgtaagtgagaggtaaacactgggtacaaatggacataaagatggggacagtagacactgggaatacaagagggcagaagagggaaggaaaaataagggttgaaaaactacctattgggtactgtgctcactacctgggtgacaggttcaatcatatcccaaacttcagcatcacacactatacccctgtaacaaacctgcacatgtaccccctgaatctaaataaaagttgga

SEQ ID NO: 165200 - DNA, 601 bp, Human
agttctaatattcctcccacatttttggtatgtgtgacaatggaactttactcctgataccaaaatctgtatgatttatatatgaagcataacaaattattctaaaacgtattaatggcttaaatcaacaaacgtgttgtctcataggttctgtggttcaggaatccaggcaaagctacctagatgcttctagctcaggatctttcatgaagttgcagtcaagctgtcagctgggctgcagtcatccaaggctcagctgggagaggatctgccttcaagctctctcatgtgactgttggcrggcctcaggttttcactggctgttggctggagatgccagttatttgccacatgagcctctgtctacggcagttgacaacatgcagctggcctacctcagagcaagcaaccaagcaagagagcaagatagagtgctcaagacaaaagataacagactttttgtaacttaatctcagaagtaacatcccatcacttttgccaaattctggttgttagaagccagtcactagatctgtcccacacttgaagagggttaaacaaggtcatgttcttcataagattaatccaagtacagaattgg

SEQ ID NO: 165201 - DNA, 601 bp, Human
tcatgaagttgcagtcaagctgtcagctgggctgcagtcatccaaggctcagctgggagaggatctgccttcaagctctctcatgtgactgttggcgggcctcaggttttcactggctgttggctggagatgccagttatttgccacatgagcctctgtctacggcagttgacaacatgcagctggcctacctcagagcaagcaaccaagcaagagagcaagatagagtgctcaagacaaaagataacagactttttgtaacttaatctcagaagtaacatcccatcacttttgccaaatyctggttgttagaagccagtcactagatctgtcccacacttgaagagggttaaacaaggtcatgttcttcataagattaatccaagtacagaattggcttaataacatttctgacgatttttcctataacttgtaaaaccttggctatctgaaacccttgggaagtgaatcatccttaaaagctaagtttctggatagatttttaccatgaagggaccaaatcttaataatttggagtagaatcacttctgcatttgatcacatatttcttgccttttaaaataaattactgatcattatt

SEQ ID NO: 165202 - DNA, 601 bp, Human
ttgtaatggtgtctgttgacagccaaagcctcttgtatggaaacataccaccactgccacaagtaaaagctataaagcagtgttaaatactgtatatagagctcacatttgtatatgcatttcttttaggtcttatgtagtgtgtgtactgtggaagatcgagaaagtgcgttaggttgttagacaaaagacccagaaggcctgctagagatgccacaggtggaactaagaaagcaatctctgtgtcactcaggctttgagaaacttccttcagaatcataaaacattagaactgggaagrttaaaaaatctttagtctttttttcccagctccagtctcttgtgaataattaacagtaaagttaaagattatgggaattacgtgcctccttttttcccttgcacaacatagaatttgttttctaatagtagtttatttgttagctttgcattcccataagtgatggtttccagccttggcaaacccttgcagcctccagccacaagtcccctggacctcagagaatgtatatactgtatgtgcaccctaataacatgtttccttaaaactagtactactggatcctctaactttagtaca

SEQ ID NO: 165203 - DNA, 601 bp, Human
tgagaaacttccttcagaatcataaaacattagaactgggaaggttaaaaaatctttagtctttttttcccagctccagtctcttgtgaataattaacagtaaagttaaagattatgggaattacgtgcctccttttttcccttgcacaacatagaatttgttttctaatagtagtttatttgttagctttgcattcccataagtgatggtttccagccttggcaaacccttgcagcctccagccacaagtcccctggacctcagagaatgtatatactgtatgtgcaccctaataacatrtttccttaaaactagtactactggatcctctaactttagtacatgtctttcatgtccaacttttcagaggccgccaaactagcaaccctaaactcatttgtcactatcaaaacataatatacgaatatggaaagctaatataaaaatggtaagggactgagccatttggaaggtaacttaatgtaagtgcctgaaaaacagggatacaaaaaagcaaagggacaagaagcaagccagttcaccctgaaccctacaaatgtttgggaattagaaacatcaagtattacaaattaggggaaa

SEQ ID NO: 165204 - DNA, 601 bp, Human
aagagcgagactccatctcaaaaaaaaaaaaaaaagtattcaaagacaagaatatcaacctgagttcaccagaacttggggaagaagtggagaaacctcctgggccaacaaaattttttgtaaaataagtggtcatttcagactgtgccaccccttccccccaagctggcataacaccactcagggagaattttcctagccctgcagtttccaaggtgagaggaaggaattggaggtgtgtattcagtctcctcactggtctgggaatcttcccagggagcccactcccgtcccatcaggragagccaggagagctgaactatctggggtaaagtggggacaaagagcagggcactgattgtagcaactagtatatggatcttgcagctactctgtactctaattagccgagacaccctattgacaaggatggccagtgtcttagtgccactggggtgtaatcagtgggaaggcctgaatccctggtcggattttccacaaaacttagtgctcacatggaaccttcccgtggcccagaaacagctataagattgggattaagctgggcatggcagctcatttctgtaatcccattttggga

SEQ ID NO: 165205 - DNA, 601 bp, Human
catcagggagagccaggagagctgaactatctggggtaaagtggggacaaagagcagggcactgattgtagcaactagtatatggatcttgcagctactctgtactctaattagccgagacaccctattgacaaggatggccagtgtcttagtgccactggggtgtaatcagtgggaaggcctgaatccctggtcggattttccacaaaacttagtgctcacatggaaccttcccgtggcccagaaacagctataagattgggattaagctgggcatggcagctcatttctgtaatcccaytttgggaggccaagttgggtggataatttgagcccaggagttcaagaccagcctgggcaacatagcaaaatcccacttctaccacaaaaacaaaagttagctgcatgtggtggtacgtgcctgtaatcccagctacttcagaggctgaagcaaagagtcgcttgagcctgggagacagaggttacagtgagccaagatcgcaccactgaacgccagcctgggcaacagagcaaaactgtgtctcaaaaaaaaaaaaaagttgggattaacttccagtgtacacttaagcacttaagactt

SEQ ID NO: 165206 - DNA, 601 bp, Human
acctgcaaaacctagaagaaatggctgtgtcctcaaatgtgcaagcatcaacataaacaagcaatgattatgaaaacttagggaaatatgacaccaccaaaagaaaccaacaaagctccaccagtggactcagaagaattgaagatctatgaaatgtcagacagagaattcagaataagcctctttaaaaagttcagtgaatctgccaggcatggtggcttacgcctgtaatcccagcactttgggaggccgaggtgggcagatcacgaggtcaggggatcgagaccatcctggctaacayggtgaaaccccatttctactaaaaatacaaaaaataagcagggcctggtggtgggcacctgtagtcccagctactcgggaggctgaggcaggagaatggtgtgaacccaggaggcggagcttgcagtgagctgagattgtgccactgcactccagcctgggagacagagcaagactccgcctcaaaaaaaaaaaaaatgttcagggaatcacaagaaaatagagatagaaaattaaatgaaatttagaaagcaatccatgtatgtagtgagaaatttgacaaagaaatagaaacaagaaa

SEQ ID NO: 165207 - DNA, 601 bp, Human
aagacccaaataagcaaaaccagaggtgaaaaatgggacattgtaagtgataccaccgatatacaaaaagatcattagagactactatgaacaactatacaccaaaaaattgcaaagcctagaaggaatgtgtaaattctctgacacatacaacctaccaagattgaatcaggaagaaacaaaagacctcaacaaaccaataatgagtaatgagattgaagccatataaaaaaagtctctcaaccaagaaaagcccaggacctgttgcttcactgctaaattctgccagacatttaaagarctaataccaatcctactcaaactcctcaaaacaaaaatttttttggaagagaagggattacttcccaactcattctacaagggcaacattaccctgataccaaaaccagacaggatgcaacaagaaaatgacaggccaacatccctgatgaacacagatgcaaaaatcctcaacaaaatactaacaaaccaagtgcaacaatacattaaaaagatcatcctgggatacgaagaggggaagaacagacttacttgagggtggggggttggaggaaggagaggatcagaaaaaatacctatt

SEQ ID NO: 165208 - DNA, 601 bp, Human
caacaaaccaataatgagtaatgagattgaagccatataaaaaaagtctctcaaccaagaaaagcccaggacctgttgcttcactgctaaattctgccagacatttaaagagctaataccaatcctactcaaactcctcaaaacaaaaatttttttggaagagaagggattacttcccaactcattctacaagggcaacattaccctgataccaaaaccagacaggatgcaacaagaaaatgacaggccaacatccctgatgaacacagatgcaaaaatcctcaacaaaatactaacaaaycaagtgcaacaatacattaaaaagatcatcctgggatacgaagaggggaagaacagacttacttgagggtggggggttggaggaaggagaggatcagaaaaaatacctattcggtactatgcttattacctgagtgatgaaataatctgtacaccaagcctctgtgacacacagtttacccacataacaaaccagcacatgtacccctcaacctaaaaaaaaaaaaaaaaaaaatcatcatgataaagtggaaatccgagggatgcaaggatgattcagcatacccaaatcaataaacat

SEQ ID NO: 165209 - DNA, 601 bp, Human
tgctcaaaaagcattcagtagaattcagcatcccttcttgataaaaattctcaacaaacggtatagaaggaacatacttcggtgaggtgtagtggctcatgcctgtaatcccagcaatttgggaggctgaggtgagtggatcccttgaagtcaggagtttgagaccagcctggcccacatggtgaaaccccatctctactaaaaatacaaagcctgggtgatagagcgagactttatctcaaaaaagaaaaaaaaaagaaggaacatatctcaaaccatatatgacaaacccacagctaaygtcatgttcaacagtgaaaagctgaataatgaataatttttctctaagattaggaacagacaaggatgcccactctaaccacttctgttcaacttagtacttgaagtcctagcccaagcaattaggcaagagaaagaaataaagggtacccaaattggaaaggaagaaaccacattatctttatttgcagataacatgatcctgtatttagaaaaacctgaagactcctccaaaaactgctagaactgataaacaaattcacttaagtttcatgatacaaaatcaacataacaaaaatct

SEQ ID NO: 165210 - DNA, 601 bp, Human
catctcactgcctgactttgaataccacaaagctatggtaaccaaaacaccatggttctatatatatgtgcacacattttatacacacataggtatataaaacacctacaaatttttgttttttgagacagagtctcgctctgttgcccaggctggagtgcagtggcatgatcttggctcactgcaacctccgcctcctgggttcaagcaattctctgcctcagcctcccaagtagctgggattgcaggcacccatcacaaatgcctggctaatgtttttgtatttttggtagagatgggktatcaccatcttggtcaggctggtcttgaactcctgacctcatgatccacctgcctcggcctcccaaagtgctgggattccaggtgtgagccaccgcactcagcctagacctacaaaattatacttggagaatcctgacaaaaaggctggctgagaaagcacacccataattatactcaactctcatatagagaactctatttaactttgtagtgcttcatagccaagacttgccagaaattggcagaacatctctaacataagagagaccaaaagaaagaaaaatgtacctcggagata

SEQ ID NO: 165211 - DNA, 601 bp, Human
gcagggacaacatcaagccattcatgagggatctggccccatgacccaaacacttcccactaggccccaccttcaacactgggaatcacatttcagcatgagttggaggggaaaaatacccaaagtgtatcagaagggaaacacccaactgcagccctctctagccttcctgtcttacctaattggggagaagggaacctgagaagcacttgtgaaagtcacggcccaggcacacaggctcactaaaagactgagaactaattatgtgattataagacactccccccaccacacacacctyaccaccacaccaatcagtctcctgtgtaatgatagtggattactgctaaatgaactaattttcagaccctattctattttaataaggagtctttagggaaacgaagaaatgatagatacaaaaacaaggatgtgattgtaacaacgtgggtacagctggaggccattatcctaagtgaattaatgctgaaacaaaaaaccaaaaactacatgttccgaactcataagtgggagctagacattgggtattcatggacataaagatgggaacagtagacactgggtactgcaagagacagga

SEQ ID NO: 165212 - DNA, 601 bp, Human
cagactggaaattttaaataagtatgattaatatactaaaggctctaatggaaaaagtgaacaacatgcaagaaaggtgggtaacataagcagacaatagaaactctaagaaagaacccaaaagaaatactagaaataagcaatactataacagaaatgaagaatgcccttggacttattgatagagtggaaaggacaatagataacctgggaaagattcaatgagcttgaagatatgtcagtagaaagttccaaaacttaaactgcaaagagaaaaaagaataaatgacagaacatggcrgggcctggtggctcacactgtatctccacacttcaggaggcccaggtgggaagatcacttgagaccaagagttgagggccagcctaggcaacagagagagatctgttgactccacaaaaaataaaaaggaaaagaataggatatccaaaaactgtgggacagttacaaaattatatatatttaagtccttgctttggctgaacctaacactaaaattggaacaataccaagaagattgcacaacatggccctgtgcaaggatgatatgtaaggtcatgaagcatagaaaaaacatttcta

SEQ ID NO: 165213 - DNA, 601 bp, Human
tagtagagacggggtttcaccatgttagccgggatggtctcgatctcctgaccttgtgatccgcccgcctcggcctcccaaagtgctgggattacaggcgtgagccaccgcgcctggccaattttttaaaaaattaaaaaaaatatgtgtatgtaaaattgtgtacacacgatgggaataacagaggaaaagagagaaaggaatagaagaaccatttgaagtaataatgactattttcaaaactaaagacagatgccaaaccacaaatccagtttagaaagttaagaaaacaagcaagatmaataccaaatgccaggtgcggtggctcacacctgtaatcccagcattttgggaggccgaggtgggcagatcacttgaggtcaggagttcaagaccagcctggccaacatggtgaaaccctgtctctactaaaaatagaaaaattaggcctggtggcaggtgcctgtaatcccagctactcaagagactgaggcaggagaattgcttgaacctgggaggcagaggttgcagtgagctgggcaccactgcactccagcttgggcaaaagagtgagactccatctccaaaaaaaaaaaaaaaa

SEQ ID NO: 165214 - DNA, 601 bp, Human
ggtttgtagaaacatttggcttctgaatacctagctcattgctgtcaagcagaatcctccatcttttagtgcctgaaaatattcagatgtccagaaacattaaccaaaggaaattccatttctagctctgctgtttgtataggcaatgtagtgggtcagttttctgcactgtgtagaaattgctttgtcagtggaaaatgttattttcgtcggttttacagttcctaacttttgaggcatttgttccctggaggatactaaaagaaggaaatcttcagacagctgcccactgaatttttgygtgagcctttatttgatattttacccagaccccttttggttttttattacagtaacatcgcatacctaggttttttttttcttcttcatataagccttacctatctggaactgtcagtactaggaaggtacttatagtgttgaatgttcccactcatatttcctgttatgccttatgctttttataacaagccaaaaagaggaagaaagatttcaccatagatttgctaaaggcaatgtgggatgcaatgagtgtggtttaatggaagagccctggggtgcggcctctgagccttgctct

SEQ ID NO: 165215 - DNA, 601 bp, Human
tctcctagccagcccacatttgtgagcactcggtaaacacagagcaggagggaattacagtgaatggggatttccctcagtgctgcccactggctgctcttgaactgacaggcttctttctcattctaaactcaccagcagtggagcagtaaacccggccacggtcaggcatggcacatgtcctgcaatgatggggactggacctgttgccttaaactcacgcctgctttgtttttccaggtctataagggagaattccaactacctgactttcttaaagaaaaaccacaggtactgtgtctgctttttcctcctgatgtatactagattggctcttgcattgaagtaatatttttaaagagataatgaaattaaaaagacagaaacaagaaaaccaaaaagaaaagaagaaaagggatagtgatatgtgctggggaagaaagatcagcgtctgggacttgttgattttaacaataatttaacacagtcttaatttcagagagctcagtgtctcccaaaaccagggaaatactttattgataaccaaattctgattgcttgaggtcctgcacaagccgcccagtgggtaaagctgctccag

SEQ ID NO: 165216 - DNA, 601 bp, Human
cccctttgacttttctcatttggagcccagatgacttatatatacacatagtcactggcccctgggaaggacagtgagagtttgaaggattaaagccagcatggtggctcatgcctgtaatcccagcaatttgtgagaccgaggttggcagatcacttgaagtcgggagttcaagaccagcatggccaacatggtgaaacctcatctctactgaaaatataaaaattagccgagtattgcagaatttgcctgtaatcccagctacttgggaggctgagggagaatcacatgaaccgggagktggaggttgctgagccaagattacaccactgcactacagcctgtgtgacagaacaagactgcctcaaaaaaagaaaaaattagctaggcatggtggcgaggcctctggtcccagctacttgggaggctgaggcaggaggatcgcttgagcccatgaggtggaggttgccatgagtttagattgtgccactgcactccagcctgggtgacagagtgagaccctgtctcaaaaataaaaaaaattaagcagattcagagttttccctgtaacgtcttctctcactgacttgcattccaatcc

SEQ ID NO: 165217 - DNA, 601 bp, Human
ttaacaagagcatggtggtgagaattaatcatcatccaagagcctggctcataataagcgcacaatagtattgttattttcattatgaaccatgaaatatttcagctgaaagggacctggaggccatcaagcccaactccctgtttactgataaggaagctggtcccagagggagcaggtcgtttgtcaggaccatagtccataggcaaggaaacccagaactcaagagtggctgtttacttctggttacctgttcagccagggccccagccacccatccccacctccagtggctttcttygtgtgctggacttgcagatgtttttgccctactgcaatttttgtttgtttgtttgtttcttggttggtttttcaagtttgcccttgcttgttttaatgtattatggatggcttatgtgagtaacctatattgtctcattggactaagtgctacattgtagacaaggccagccttgccttctcagccctttttctatctgagtatgtggccctcatcaggcacatgtccagggacaccagctcatgagtggcaaagctggtttctcagcccagatctccaggtgcagctgctcagagttca

SEQ ID NO: 165218 - DNA, 601 bp, Human
cagttttgctccaaatgatgtggcaaagcctttgatcagttgtaacttgaacagccttttcaaaaaatctgatattggctgggcatggtggctcatgcctgtaatcccagcactttgggaggccaaggtgggcagatcacaaggtcaggagttcgagaccagcctggccaacatagtgaaacctcgtctctactaaaaatacaaaaattagctgggtgtggtggcagggacctgtaatcccagctacttgggaggctgaggcaggagaatcacttgaacccaagaggtggatgttacagtragccgaaatcgtgccattgcactccagcctgggtgacaagagagagacttcgtctcaaaaaaaaaaaattggctgggcgtggtggtgggcacttatagtcccagctactcgggaggctgaaggaagagaattgcttgaagccaggaggcagagaggttgcagtgagccgagattgcagcactgcactctagcctgggtgacagagcgagacttcgtctcaaaaataaataaataaataaataaaaataaaatctgatattgatagtgattttttctcatagtttacttgctgacctttgt

SEQ ID NO: 165219 - DNA, 601 bp, Human
tttgctccaaatgatgtggcaaagcctttgatcagttgtaacttgaacagccttttcaaaaaatctgatattggctgggcatggtggctcatgcctgtaatcccagcactttgggaggccaaggtgggcagatcacaaggtcaggagttcgagaccagcctggccaacatagtgaaacctcgtctctactaaaaatacaaaaattagctgggtgtggtggcagggacctgtaatcccagctacttgggaggctgaggcaggagaatcacttgaacccaagaggtggatgttacagtgagcmgaaatcgtgccattgcactccagcctgggtgacaagagagagacttcgtctcaaaaaaaaaaaattggctgggcgtggtggtgggcacttatagtcccagctactcgggaggctgaaggaagagaattgcttgaagccaggaggcagagaggttgcagtgagccgagattgcagcactgcactctagcctgggtgacagagcgagacttcgtctcaaaaataaataaataaataaataaaaataaaatctgatattgatagtgattttttctcatagtttacttgctgacctttgttttt

SEQ ID NO: 165220 - DNA, 601 bp, Human
gtgtggtggcagggacctgtaatcccagctacttgggaggctgaggcaggagaatcacttgaacccaagaggtggatgttacagtgagccgaaatcgtgccattgcactccagcctgggtgacaagagagagacttcgtctcaaaaaaaaaaaattggctgggcgtggtggtgggcacttatagtcccagctactcgggaggctgaaggaagagaattgcttgaagccaggaggcagagaggttgcagtgagccgagattgcagcactgcactctagcctgggtgacagagcgagacttcrtctcaaaaataaataaataaataaataaaaataaaatctgatattgatagtgattttttctcatagtttacttgctgacctttgttttttttttttatataatgtttttatttttactttatataatgatgtattgtgcatactccataccaggcataaaataccaaggattttatttgcatatatataagatgatatatatataacagatacgctaaattatatatacatctatatataaaattgtattcagttctcaaaccactctggcaagctggtagtattcctgttttgctagtg

SEQ ID NO: 165221 - DNA, 601 bp, Human
cgtgccattgcactccagcctgggtgacaagagagagacttcgtctcaaaaaaaaaaaattggctgggcgtggtggtgggcacttatagtcccagctactcgggaggctgaaggaagagaattgcttgaagccaggaggcagagaggttgcagtgagccgagattgcagcactgcactctagcctgggtgacagagcgagacttcgtctcaaaaataaataaataaataaataaaaataaaatctgatattgatagtgattttttctcatagtttacttgctgacctttgttttttttttwtatataatgtttttatttttactttatataatgatgtattgtgcatactccataccaggcataaaataccaaggattttatttgcatatatataagatgatatatatataacagatacgctaaattatatatacatctatatataaaattgtattcagttctcaaaccactctggcaagctggtagtattcctgttttgctagtgagaaaacaggttgaatgtgacttgcggtgcgttgatggattatagacataagaagcacatggacgctggtccgtcatgtcaaaatcccagatggc

SEQ ID NO: 165222 - DNA, 601 bp, Human
cttatcttttgggtccctttggcatttcaataacagtatctgtgttctctggagcttcctttaaagaaccttaggatccatttcttcacgtgaggaggaatcagggtgctgacccctggacacttaaagaaccttaggacccatttcttcacatgaggaggaatcagggtgctgacccctgggacacttaaagaaccttaggacccatttcttcacatgaggaggaatcagggtcttgacccctggacacttaaccttaggacccatttcttcacatgaggaggaatcagggtgctgcccmctggacacttaaagaaccttaggacccatttcttcacatgaggaatcagggtgctgccccctggacacttaaagaaccttaggacccatttcttcacatgaggaggaatcagggtgctgccccctggacacttgaagaaccttaggacccatttcttcacataaggaggaatcagggtcttgacccctggacactttaagaaccttaggacccatttcttcacacgaggaatcatggtgctgacccctggacatctggtgcccctgacagtgcccccacagtagcaacaatagcagatga

SEQ ID NO: 165223 - DNA, 601 bp, Human
cttaggacccatttcttcacatgaggaggaatcagggtgctgacccctgggacacttaaagaaccttaggacccatttcttcacatgaggaggaatcagggtcttgacccctggacacttaaccttaggacccatttcttcacatgaggaggaatcagggtgctgccccctggacacttaaagaaccttaggacccatttcttcacatgaggaatcagggtgctgccccctggacacttaaagaaccttaggacccatttcttcacatgaggaggaatcagggtgctgccccctggacacytgaagaaccttaggacccatttcttcacataaggaggaatcagggtcttgacccctggacactttaagaaccttaggacccatttcttcacacgaggaatcatggtgctgacccctggacatctggtgcccctgacagtgcccccacagtagcaacaatagcagatgacagtcagttatttagaaatgggcaggagcagccctggttttggccatctgcttgctttgcacccagcagctacttgcatgcatctgaaagcaccagagtgagggtgtgtgtgcctcccaggcagtcttcctg

SEQ ID NO: 165224 - DNA, 601 bp, Human; identical to SEQ ID NO: 24710

SEQ ID NO: 165225 - DNA, 601 bp, Human; identical to SEQ ID NO: 24711

SEQ ID NO: 165226 - DNA, 601 bp, Human; identical to SEQ ID NO: 24712

SEQ ID NO: 165227 - DNA, 601 bp, Human; identical to SEQ ID NO: 24713

SEQ ID NO: 165228 - DNA, 601 bp, Human; identical to SEQ ID NO: 24714

SEQ ID NO: 165229 - DNA, 601 bp, Human; identical to SEQ ID NO: 24715

SEQ ID NO: 165230 - DNA, 601 bp, Human; identical to SEQ ID NO: 24716

SEQ ID NO: 165231 - DNA, 601 bp, Human; identical to SEQ ID NO: 24717

SEQ ID NO: 165232 - DNA, 601 bp, Human; identical to SEQ ID NO: 24718

SEQ ID NO: 165233 - DNA, 601 bp, Human; identical to SEQ ID NO: 24719

SEQ ID NO: 165234 - DNA, 601 bp, Human; identical to SEQ ID NO: 24720

SEQ ID NO: 165235 - DNA, 601 bp, Human; identical to SEQ ID NO: 24721

SEQ ID NO: 165236 - DNA, 601 bp, Human
agcatcagaattcgggtacaaggctgcttttcactaggacatatcccagcctctcgctcagagtacccaaagcaaggcaggcttggaagacaggcatgacattgacaggtaccaggaggtgacccagcgtgggccgcgaacacagaaagaatcatgtattgattggagccttggaacttggcatactgcctctccttcactcattccctactccaggcctcagccttgccctatttgtggcctcctaaattctgtctaataattaaaccctctcctgtattttgagaacccttatccttgraatgacccttgttcccaaggaccttagtctgtagccttcaccatactgacttaagttgtcagaagcctcagtcttccaaataccaggggtaggtgacagacaggacaggcatccctgaaggtcttggcattggtcaacagtccatgcagccaagacagacagacagactcacctctttctccctggaaggctaggcttgcttgcagatgggggtcttcctggtggcctaatgcttggtgtggcaggcaggggccccgtctcctgagaatatgctccttttgcccaagcaacgttcttcct

SEQ ID NO: 165237 - DNA, 601 bp, Human
cagcagcatcagaattcgggtacaaggctgcttttcactaggacatatcccagcctctcgctcagagtacccaaagcaaggcaggcttggaagacaggcatgacattgacaggtaccaggaggtgacccagcgtgggccgcgaacacagaaagaatcatgtattgattggagccttggaacttggcatactgcctctccttcactcattccctactccaggcctcagccttgccctatttgtggcctcctaaattctgtctaataattaaaccctctcctgtattttgagaacccttatcyttgaaatgacccttgttcccaaggaccttagtctgtagccttcaccatactgacttaagttgtcagaagcctcagtcttccaaataccaggggtaggtgacagacaggacaggcatccctgaaggtcttggcattggtcaacagtccatgcagccaagacagacagacagactcacctctttctccctggaaggctaggcttgcttgcagatgggggtcttcctggtggcctaatgcttggtgtggcaggcaggggccccgtctcctgagaatatgctccttttgcccaagcaacgttct

SEQ ID NO: 165238 - DNA, 601 bp, Human
gtctgacatgataggaattgcaccttcagattgcatcatgaggaagacacctcttagctaactactgcctcccactcacgtttccttcctcatttattttccctactggcttctggggctagagaagattctagtttctgattgcagtaaaatcctttcataggaggcttctttaactaggcatttggatgaattaatttatatgtatacaaagagaaatttctttctcagttaaatcctgttacattatacttcagctcttaccatggccttgtcattgggttgaactggagctgtattytagattttgccaacaataacaagcgctgccaagtacttcagctgagatcacccaaataatactctactagcaaaagctttgcgtggcgttctaaccatcagaaactggtaagttctatatctccaaggtagaccaaggagcctgggccactgtgtgtgctggggagtgagaaaggcattgccaattgacctcaggttgggtcagttagtctcaggtggaaagacttggatatgtaacctttacacacaaccatgcattctgagagaagagtcaatgagcaagacaacatgaagtctgggg

SEQ ID NO: 165239 - DNA, 601 bp, Human
aaatctcaagctatgaaaatacaagaaaacttcggggaaactctgtaggacattgaagtgagcaaagatttcttgagtaatatcccacaagcacaggcaaccaaaggaaaaatagataaatgagatcatatcaacttaaaaaagcttctgcccagcaaaggaaacaatcaacaaagtgaagagacaatccacagaatggaaaaaaatgtttgaaaaccacccatttgacaaggtattaataaccagaatatataaggagcccaaacaactgtataggaaaaaaaatctaataatctagttwaaaatgggcaaaagatctgaatagacatttctccaaagaagttgtacaaatggcaaatagaaatataaaaaggtgctcaacaccattcctcattatagaatttcaaatcaaaactaccgtgagatatcatctcaacccagttaaaatggcttttatccaaaaggcaggcaataccaatgctggaaaggatttggagaaaagagaaccctcatacattgttggtgggaatgtaaactagtacagctatggagaagagtttggaagttcctcaaaaaactgtaaatagaactaccacatggc

SEQ ID NO: 165240 - DNA, 601 bp, Human
atagctacaaataaaataaaatatctaggaattaatttagccaaagaagtgaaagatctatacaatgaaaactataaaacatggacaaaagaaattgacaaggacaccaaaaaatagaaaaatattccatgtttgtggattggaagaatcaatattgttaaaatgtccactctactcaaagcaatctacagatttaatgcaatctttgtcaataacccaatgacattattcacagaaacagaaaaaattatcgtaaaatgtacatggaaccacagaagacccagactgtccaaagctatcytaagcaaaaaaataacaaaactggaggaatcacattacctgatttcaaattatactacagagctttagttaccaaaatgccatggtactgtcataacaacagacatatagaccagaacagaagagagaacccataaataattccctacgtctatagtgaactcattgttgacaatggtaccacaaacatgcattgaggaagggacagtgtcttcaataaatggttctgggacactggatattcatatgcataagaatgaaaggagacccttatctcttgacatatacaaaaaccaaatca

SEQ ID NO: 165241 - DNA, 601 bp, Human
aaacacaacatactgaaacctgtaggatattaagacggaagtttatacctataagtgcctgcatcaaaaaaaaacaagaaaaaataaaaacttcaaaccaaaaacctgatgacaaatcttaaagaactaaaaaagcaagcacaaattaaacccaaaattagtagaacaaaagaaataataaagatcaaagcagaaataaattgaaatgaagaaaacaatacaaaacatcaatgcaacaaaagtcggctttttgaaaagataaacaaaatcaataaacctttagccagaccaaaaaaaaaaagagaaagagatgacccaaattaataaaatcagagatgaaataggagacattacaatggatggcacagaaattcaaagaatcattagtgactgctatgagcaactatatgccaataaattggaaaatctagaagaaatgggcaaattcctagacacatacaacctaccaagattaaaccacaaagaaatccaaaacctgaacagatcaataacaagtaatgagatgaaaaccatgataaaaactctcccaataaagaaaagcccaggatccaatgatttcactgctgaattctgccaagta

SEQ ID NO: 165242 - DNA, 601 bp, Human
acaatatcacaacagtgcaactgtggtatgtaaagtactcttatcttaagtagaaagactaaaagatgaaccaataaaaatgataactacaacaacttttcaagacatagacagtaaaaacaaagttataaatagaaacaataaaaagttaaaaagtgggagacaaagttaaaatgtagagtttttattagttttctttttttgcttacttgtttgttaatgcaagcagagttaagttgttatcagcttacaataatgggctataagatagtatttgcaagcctcatagtaaccttgaatmaaaaaatatacagtagatatatgaaaaacaaaaagcaggaaattaaatcataccaccagagaaaatcaccttcactaaaaggaagacaggaaggaaagaaagaaggaagagaagatcaaaaaacaaccagaaaacaaataacaaaatggcagaagtaagtgcttacttattaataataatattgaatgtaaatggattaaactttccaatcaaagtacatagagtggctgaatggatgaaaaaacaagacctaacgatctatttcccacaagaaacacactccacctataaagacacatg

SEQ ID NO: 165243 - DNA, 601 bp, Human
agagacatggtttcaccatgttggccaggttagtagtgatgacctttttcatcaccaaggaaaaggtacatggatgtgttttggtcaagcaaattgggatccacaaaacttaatgggtgtggcagacttgtcacacttgcttcttcccgttgccttccctcctttcctcttttcattcccctgtcttgctcctgtttttctatcttaagacattttcccttgctacctgggtacttagccctagagggtttgtagcatccagatcccttggtcatctattaccaagattcagaaaggagawgttcttacaaattcttctaaatcacaggaggactttctagaggaggaataaagggatagaagcgagagaagcaagagtatagtgtatgtagcacagattagagtatgggttttggagtcagagagttctgaattcaattccacgttctgttatttgaccttgggcaaattacttttctgtgccctagttgccatttataaaatgtggataataatacatcctcattattattatcatgatcatcaactgcaaattcagtatgacctgattcttactttttcacactactaattttgtcag

SEQ ID NO: 165244 - DNA, 601 bp, Human
gctgaggtggacatccaggccaaagtgactcagcgagtttagggagcaggcatatatatatatatatatacttgttatataacctatttgtgtaagctcatgcttagctcagagccactattgtttgaaaaaggtataattgacctgccgatgctgtgcacgcaacttggcttggctcaacgtgccttgacatggtacaggctctggtgcccagagaaagagagagagaaccaaggctgtccatcttgcagactgatagagggcagccaggacatggctcagcatgcattcatgcccagarggagaaagagttaagctgctgaccctgaacgctaagggagagccggctgcgcagctgtgaatgggagcggctggagcaagcagctgagacagacagacagagagtatgagaaagctgctgatgaaagagctgctgaataaaactacatttcacctgtgtatggccccctgagtgttctttcagctatctgccacccacccactcccctaggaccttagcatgggctggaacctgaccctgagtgtgacatttggcatggtcatgaacctgacatatgccatgctaggagaactggcgttt

SEQ ID NO: 165245 - DNA, 601 bp, Human
gccatggatggtttcccaggaaaactatgaaaccactggaatgttatgaaaaatattttgcttatgtaatgtttctgggaaggggtacatagattttatcaccattttaaaaaagtcagtggtcccatcatgtttgaagaaccacaggtttaatgagggaagacaaccaacttaactagcataaggaggtatctcaggtgtagtactaggaaattatatactggatctggaagaggcagaaaggaggaagcgatcattctacatagatctgaagtttttctagaatgatagatgaggtgayacctgagatgaattttaggagatagctaagtttgtcagacaaactgtcagggagagtatggacttcctggaagagagcatggattataggcaggtggggaagcagcctggagctcttgaggaactacgagatgctcagcgtagttagtgcagaggtggcagggaggtggtttgagagacaaggctggagcaaaggcagaggcggcactgtgcaaggcctgatatgatgtaaggtacatggatgtgctttggtcaaggaataggctgaggtggacatccaggccaaagtgactcagcgagt

SEQ ID NO: 165246 - DNA, 601 bp, Human
tgaacccagcaatctcaggtttggtcttttgaagcaaaccaagatccccaggaaactgtggcatgttcacgtacttgccattgaacacagagttgttgatccaacgccaccttttctcttcacgatggtaaattaagccaataaaatacttctcagcatcagttatgtcctgaagaaacttctggaaataaaaaaaaaattttaccagtgagtcttttaatgatgcctctcttgagccaatgtgcccatgattatatctgatcctgggaataaggaaggccggtagagaactctgggaccrgctatagctgggactcacaactaaccctaaagaagtcattgtcaagattcagagggaatttggaaagcctgaggtcttgttaaaacacagactgctgggctcctggttaagtaggtctagtgaagggaaccaataatttacttttctacaaaatgcccaggtgatactgatgtttctgtccagggaccacactgtgagaatgaaggggaaggggtactgtacaatctaaaacagggtcatttaaaaaaatatgtcatgcttctatccataggattgtttttgttgccagaaattttgtat

SEQ ID NO: 165247 - DNA, 601 bp, Human
ataagaaaacatttattaaaatgtgtctcagggaatagatgggttggaagaaaggagaagagcagaacagagtcaagtgtcagcgtttgagctattccagggtgaacccagcaatctcaggtttggtcttttgaagcaaaccaagatccccaggaaactgtggcatgttcacgtacttgccattgaacacagagttgttgatccaacgccaccttttctcttcacgatggtaaattaagccaataaaatacttctcagcatcagttatgtcctgaagaaacttctggaaataaaaaaaaaattttaccagtgagtcttttaatgatgcctctcttgagccaatgtgcccatgattatatctgatcctgggaataaggaaggccggtagagaactctgggaccagctatagctgggactcacaactaaccctaaagaagtcattgtcaagattcagagggaatttggaaagcctgaggtcttgttaaaacacagactgctgggctcctggttaagtaggtctagtgaagggaaccaataatttacttttctacaaaatgcccaggtgatactgatgtttctgtccagggaccacactgtgag

SEQ ID NO: 165248 - DNA, 601 bp, Human
tggatcttgatatgaataaaataatttgctatatgaatactcttctttctccttatgaaagtttgatctctttcataagaaaacatttattaaaatgtgtctcagggaatagatgggttggaagaaaggagaagagcagaacagagtcaagtgtcagcgtttgagctattccagggtgaacccagcaatctcaggtttggtcttttgaagcaaaccaagatccccaggaaactgtggcatgttcacgtacttgccattgaacacagagttgttgatccaacgccaccttttctcttcacgrtggtaaattaagccaataaaatacttctcagcatcagttatgtcctgaagaaacttctggaaataaaaaaaaaattttaccagtgagtcttttaatgatgcctctcttgagccaatgtgcccatgattatatctgatcctgggaataaggaaggccggtagagaactctgggaccagctatagctgggactcacaactaaccctaaagaagtcattgtcaagattcagagggaatttggaaagcctgaggtcttgttaaaacacagactgctgggctcctggttaagtaggtctagtgaa

SEQ ID NO: 165249 - DNA, 601 bp, Human
ctttgttaggccaatggtcgcacagttgaaattctgattctgattggtaacactaaatgagaaaacaaaacaaaacaaaacaaacaaacaaaaaacaaagcatggtgatggcccatcattttagcccagcctcttcctgattccagagtgagagtcttgcaggagttttgcctggaagggcagcagactaccgggcccacacacgtctccatctgcgtagcctcctttttagctcagatccttttcctaatccagctccgcaaatgcagctctaaacccaccctttcctgtcagctctccygtgagcgtgtatggattcacagtcttggactaactaactcactctggcatttggttagaagcatctcatgggctgtctcttcttccaaaagtactgtttaggatagcatgcatgttcacagcaagaggacaggaaggaaaaggagagaggttgtgcatccctttccagaccatagtggcctcagaaaaacttggtggaggtatttgttggctctcccacctctttttctgtcattcagtctgtttcagtctgactgaaaaggctctggtttcggagaaatgtcatgtgtttgggactagc

SEQ ID NO: 165250 - DNA, 601 bp, Human
tgacacctgatgtgttatctcatgttaaaaaattgtaagtggccatgctaaggagccaaaaatgatgaaacctaggaatgcagaagcagaacttagtgttgtaataaaaaatatgatttacaacaatcttgtttggtatacatacaatgacatgtacagtcattactgtgctacattgttattagacacaaaatggtatgtgctgtactttggtgactattatttccatcagttttatacatggtcttccttatggtttaattattcttactcaaaacacaaaaggcatctcttttctctytcttatgcaccaagcagagtatatagctgatgtcttgtgagtgtggagaacagccagggtactccaagacttgtcttcctctttcttgcctttcttccagtgtggccaaatgaactccctgtttcctgtctcaggtgatttccatttgaccctgatgttccctttttactatgtgcttattccgtgcccccagccaatgtttccctgagcagcccttctcttttcctactcttcgtcggctggaccagttctagatcaatgtgatgccaatcagtgccaggctccttggggtcagtaggc

SEQ ID NO: 165251 - DNA, 601 bp, Human; identical to SEQ ID NO: 38589

SEQ ID NO: 165252 - DNA, 601 bp, Human; identical to SEQ ID NO: 38590

SEQ ID NO: 165253 - DNA, 601 bp, Human; identical to SEQ ID NO: 38591

SEQ ID NO: 165254 - DNA, 601 bp, Human; identical to SEQ ID NO: 121667

SEQ ID NO: 165255 - DNA, 601 bp, Human; identical to SEQ ID NO: 121666

SEQ ID NO: 165256 - DNA, 601 bp, Human; identical to SEQ ID NO: 121665

SEQ ID NO: 165257 - DNA, 601 bp, Human; identical to SEQ ID NO: 121664

SEQ ID NO: 165258 - DNA, 601 bp, Human; identical to SEQ ID NO: 121663

SEQ ID NO: 165259 - DNA, 601 bp, Human; identical to SEQ ID NO: 121662

SEQ ID NO: 165260 - DNA, 601 bp, Human; identical to SEQ ID NO: 121661

SEQ ID NO: 165261 - DNA, 601 bp, Human; identical to SEQ ID NO: 121660

SEQ ID NO: 165262 - DNA, 601 bp, Human; identical to SEQ ID NO: 121659

SEQ ID NO: 165263 - DNA, 601 bp, Human; identical to SEQ ID NO: 121658

SEQ ID NO: 165264 - DNA, 601 bp, Human; identical to SEQ ID NO: 121657

SEQ ID NO: 165265 - DNA, 601 bp, Human; identical to SEQ ID NO: 121656

SEQ ID NO: 165266 - DNA, 601 bp, Human; identical to SEQ ID NO: 121655

SEQ ID NO: 165267 - DNA, 601 bp, Human; identical to SEQ ID NO: 121654

SEQ ID NO: 165268 - DNA, 601 bp, Human; identical to SEQ ID NO: 121653

SEQ ID NO: 165269 - DNA, 601 bp, Human; identical to SEQ ID NO: 121652

SEQ ID NO: 165270 - DNA, 601 bp, Human; identical to SEQ ID NO: 121651

SEQ ID NO: 165271 - DNA, 601 bp, Human; identical to SEQ ID NO: 121650

SEQ ID NO: 165272 - DNA, 601 bp, Human; identical to SEQ ID NO: 121649

SEQ ID NO: 165273 - DNA, 601 bp, Human; identical to SEQ ID NO: 38592

SEQ ID NO: 165274 - DNA, 601 bp, Human; identical to SEQ ID NO: 34325

SEQ ID NO: 165275 - DNA, 601 bp, Human
catggcttttccctcccaaccccaaacccatcccacatctggcttttgttgtgtgaatcataaactgccctttcttcaccacagtgattcatacacagaagcggaggtaccctgagccgtcccaccttggaacactagttcgttcccctccagcctggaaaatcagcatcacctctgacaggctggtttctccaccaggctccatcccgcccacctccccgctccctgctccggggcttggaacccagaccccctccccccgtggcgccatcacctccaccaccagctccccaattccagrccaagctgtgatcgccctgccccgctggcactcgcttgggtctgacagccacagccaaaccacttacgtttttgccagagcatggcctgtgacaggatgttgccttttctctttgaagccgacagtttggcttctttaatgtgagaccggggtgtgttttcctccagtggagccaccgcttgagctgaggctgtttcctgggctttttaaaggcctgggttcccgctgcgtgggccgcgtcatcacatcctcccacctcaggcaccggtgcaacgtttctgcagccaggccgcctgtcac

SEQ ID NO: 165276 - DNA, 601 bp, Human
aaacctaaggattgagaaaaaggaaagtggcttgctcatagaaggtaggagctgaggcaaaactccttccaggggctcacacaaaaatcaaatgattcagccctgagtgaaagggcacacagatgcttaggggcccccagtaaaaagatgaatgcccacctgctctcatccacagagcactcacaacagggtcagctgccattgtcccagaaaggataggctgccgctgctccatcgcctgttgggaagagtggcgtgccaacaattcttgaatattcctagttatcttggaaggagtccrtaactctcaaacccaaattaaagctcatttctctttatttttttaaaaaattgaccttttgatatcaaacaatggtgggtcttcacaacctgagaaattttgaaatcactcttctgtgttactggttaatcagcttaattccagagaaatttacataagacataaagcaaacaataaattggtgatgacagtgtcacattttaatcaatgaagttatattttccgaactttagtggatccaatcaagtatctttccataaaataaaaacattccctaatatatcttcttctgtaaatcta

SEQ ID NO: 165277 - DNA, 601 bp, Human
agggaagcaactcatatctcagaggctgatgcagacagagcaatgaacatgacttcggtggcacctcacttactaaggatagatcctcagtgtggatatgatttttacccccacttaacatacaaaaaacctaaggattgagaaaaaggaaagtggcttgctcatagaaggtaggagctgaggcaaaactccttccaggggctcacacaaaaatcaaatgattcagccctgagtgaaagggcacacagatgcttaggggcccccagtaaaaagatgaatgcccacctgctctcatccacasagcactcacaacagggtcagctgccattgtcccagaaaggataggctgccgctgctccatcgcctgttgggaagagtggcgtgccaacaattcttgaatattcctagttatcttggaaggagtccgtaactctcaaacccaaattaaagctcatttctctttatttttttaaaaaattgaccttttgatatcaaacaatggtgggtcttcacaacctgagaaattttgaaatcactcttctgtgttactggttaatcagcttaattccagagaaatttacataagacataaagcaaacaa

SEQ ID NO: 165278 - DNA, 601 bp, Human
tcacttgagtccaggagttcgagaccaggctgaacaacatagtaaaacaccatctctactaaaaatacaaaaaaaaaaaacagctgggtgtggtggcgggcacctgtagtcccagctactagggagggtgaggcgagagaatcacttgaacccaggaggcagaggttgcagtgagccgagatcgcgccactgcactccagcctgggcaacagagcaacactctgtctcaaaaaacaaacaaacaaacaaaaaaagtctgttcatctcttagaaggaattagaaatgaaaaaatgtactacrgaaccaagaggggagaatatggcagatggtgaatgcagggaagcaactcatatctcagaggctgatgcagacagagcaatgaacatgacttcggtggcacctcacttactaaggatagatcctcagtgtggatatgatttttacccccacttaacatacaaaaaacctaaggattgagaaaaaggaaagtggcttgctcatagaaggtaggagctgaggcaaaactccttccaggggctcacacaaaaatcaaatgattcagccctgagtgaaagggcacacagatgcttaggggccccc

SEQ ID NO: 165279 - DNA, 601 bp, Human
actactcaactctgcaaaagcagccctagacaatattcaaatgatagacatagctgtgttccaataaaactttatttacaaatggagtggcaggcctgatttggcacagaggccatagtttgcagaccactattttagacccttggaaaattttgcaatatcctatcacccaagaatatttagactgtggctttttaactattctaatcaaagtgtggaaaagaatatatgaatttaacataacactgatcattcaagatgggcccacaggaggtttccaggacggaaggtactaactcayccctaccactacttatcaggaaacttgctatcattttacctacattctctactttaattctcacaaaaaccttgggaggcagacattagaatccccacttcccagataaggaaatgaatggaaatttccttctcacaaagaaagaactaagttgcacaggcaactttcagacctgtctccctccaaggttcctgctatttccactacactgttactagctggggagggatggtaattcttcacatgtgcacctgaccagcaggtccaagtccagaacccagggagagaatctacagatgg

SEQ ID NO: 165280 - DNA, 601 bp, Human
gctttgtatgctgcacagtctctgtcacaactactcaactctgcaaaagcagccctagacaatattcaaatgatagacatagctgtgttccaataaaactttatttacaaatggagtggcaggcctgatttggcacagaggccatagtttgcagaccactattttagacccttggaaaattttgcaatatcctatcacccaagaatatttagactgtggctttttaactattctaatcaaagtgtggaaaagaatatatgaatttaacataacactgatcattcaagatgggcccacaggwggtttccaggacggaaggtactaactcacccctaccactacttatcaggaaacttgctatcattttacctacattctctactttaattctcacaaaaaccttgggaggcagacattagaatccccacttcccagataaggaaatgaatggaaatttccttctcacaaagaaagaactaagttgcacaggcaactttcagacctgtctccctccaaggttcctgctatttccactacactgttactagctggggagggatggtaattcttcacatgtgcacctgaccagcaggtccaagtc

SEQ ID NO: 165281 - DNA, 601 bp, Human
acaacaataaaaagcaactgtccaatttgttcactttctaacaaatggagttcagtttattatacacagttctatcacttttaaggaagaaattcaatcaaatcagtttggggcattgtacaaattatttaatgaattggctgcaagttttatttcccattggtgttggcaatgtacaaccccaggatactgagtatctttttttttttttttttttttttttttgaggcggagtctcgctctgtaccccaggctggagtgcagtggcacgatctcggctcactgtaagctccgcctcccrggttcatgccattctcctgcctcagcctcccgagtagctgggactacaggggcctgccaccacaaccccagctaatttttttgtatttttagtagagacggggtttcaccatgttagccaggatggtctcgatctcctgacctcgtgatctgcccgccttggcctcccaaagtgctgggattacaggcgcccgccaccgcacccggcctgatactgagtatcttaaggaaatgaatgcctgaagaaccaagcaaatcatctcagaccagaggttggcaatgtttttctattataagccag

SEQ ID NO: 165282 - DNA, 601 bp, Human
ccccatcccaggtaggctcacttagttgtcaagcagttctacaaaaatgagaaaactagagtgttattaagcatttcataaaggtgagaattatgttaatattcataatcaattagccaactttggtttggttggctcagaataagaaataggtggacatcttcattaagtgggaagataaactactttagaaagatgtcaaagggggaaaaaacactttgtagtgggaaagttaaaagcaaatatttataagacttctttatgaattaaatgtccacatatttaatgaacagctgtaggmaaacttgattttttttttttttttttttttttggttcctcatgaaagaacagaatcccaagtgtgaattgggagagagctttcaaaacttctgagtcagtaactttggggacaaatctggcattttctttagtaaataaatataaggggcaggaagtaaaatatccatcaagaacatcatctgctcttttaccaattaaatctgtgtatttggttgatgtttgtcctttatttcacctccagacggtgcacgtgaatttgtgtctctcttttggattctacttgcccttaacagcaagaa

SEQ ID NO: 165283 - DNA, 601 bp, Human
aaacccctggctcctgcctacaagtgctttgtccccagtatcacacaagcgggacaagagggtttcagagaaggcctccccatcccaggtaggctcacttagttgtcaagcagttctacaaaaatgagaaaactagagtgttattaagcatttcataaaggtgagaattatgttaatattcataatcaattagccaactttggtttggttggctcagaataagaaataggtggacatcttcattaagtgggaagataaactactttagaaagatgtcaaagggggaaaaaacactttgtartgggaaagttaaaagcaaatatttataagacttctttatgaattaaatgtccacatatttaatgaacagctgtaggaaaacttgattttttttttttttttttttttttggttcctcatgaaagaacagaatcccaagtgtgaattgggagagagctttcaaaacttctgagtcagtaactttggggacaaatctggcattttctttagtaaataaatataaggggcaggaagtaaaatatccatcaagaacatcatctgctcttttaccaattaaatctgtgtatttggttgatgtttg

SEQ ID NO: 165284 - DNA, 601 bp, Human
aatctccaggaaaattagccaggaaaaggcaagttccattccagcactagaacatttgagacccaaagtggttaggtggcttgcttaaggtctctcatctaattatctgtagaatggaaagtaaaacccctggctcctgcctacaagtgctttgtccccagtatcacacaagcgggacaagagggtttcagagaaggcctccccatcccaggtaggctcacttagttgtcaagcagttctacaaaaatgagaaaactagagtgttattaagcatttcataaaggtgagaattatgttaatrttcataatcaattagccaactttggtttggttggctcagaataagaaataggtggacatcttcattaagtgggaagataaactactttagaaagatgtcaaagggggaaaaaacactttgtagtgggaaagttaaaagcaaatatttataagacttctttatgaattaaatgtccacatatttaatgaacagctgtaggaaaacttgattttttttttttttttttttttttggttcctcatgaaagaacagaatcccaagtgtgaattgggagagagctttcaaaacttctgagtcagt

SEQ ID NO: 165285 - DNA, 601 bp, Human
cccaagttccaaggctcatggtggcctggggtgtagccttcgcaagtgagagtagccctaacaatggattcatgagaaacatcacagctggtcaagaggagctttctggataatgttcagctttgctaaccaatggccctcatgatgcaagggattcctttatgaaagacattggagaaggggagtggttgttagtatcaagcctgagaaagaagtcacttggtcagttttttaggaatttaccccctctttattcacaagagacccacaaagaccgaacacatagtcttcacagcttcaragcttgatgaagaccaatgcaatatgtttcacagccactcactgccactctctgtgaccagctagcagggatcttgctaaaaagaggggtagattggccaggtcagggggatccagctgtgacctgaagaaccctggaatatagttatggtgcctgcaggtgccaacagagtgagaatggcagggaaatgtgggggaacatgagcaatcagagctccagatagccccccaaaaccgcacgatttttattcttatactgaagttctacagtagatttggtttgaataagggagtttgtagc

SEQ ID NO: 165286 - DNA, 601 bp, Human
atgggagttttatcaccttgtagagcaaagcagattcctggattacatatttggcattgcctcaaatttgctgagagtggggcatcaggaaagagaaagggcctaaacagagctccagacctaccgtcccagaccagaaggtgaatgaggagagtccacctaccccagtggccaccccaattctatagcaaggcagtaccatagtgagggatggagcagaggaaagggctgtctctttccttattagatcaaggcttgaatctagaattgcccatctgagctaggatgggaataacctgtrgttaggcagctggaggaggcagatggatatccgattttttgttccttgattcaagcaatatctaattttggcttttcaagactaaagagctttattgaaaaaacttaacttttcctgagaccatcatgtaaggaccactttcttggagaatggactcttcagatcccagcattagttttgtatttggggtcagacccaactgcccaagttccaaggctcatggtggcctggggtgtagccttcgcaagtgagagtagccctaacaatggattcatgagaaacatcacagctggtcaagag

SEQ ID NO: 165287 - DNA, 601 bp, Human
gtcccagacactctaagtggcaggtcctgagtgaatcctaagggtgtgtcactagctggtcctatcctatcttggctgatcggcccaccaagagaagaggagtccagggaactcagattctaagatggaaatcagtaggtttcagagcttccatactgagtctcgagcgtgacttgctaagatccaaatctgcagaggcttttgtgccaggctagagctacccttgatgaagtcataacctgcctccatctaagcgagggccctcttcaattgggagaggaagaagcacccagtgcaacaytaaaatccttgtcattgagaagcagtgtggtacagtttgggactagacctagtttagaaagcctgttatgttgcttatcacctgtgtgactcttggcaaatcacttaaccattgtgtgcctcagtttccccatctgcaaaatgaaagtaataatatccatctcaaagggtaatcatgagaactgtatgagattaacacaatgaaacacctggtgcataatgagctcccaacaaatagccctttctccttgatctcagccaacaatccatggcccatctgtcatcggagaagtagccttgg

SEQ ID NO: 165288 - DNA, 601 bp, Human
tattcacatctttaactggaacactaatgtgggtgcttttcttacagttacggtctgagtcaaagttttcaaatttgttctttccattcatggacaatggctgattttttttccaaacaggaagaaagaagttgggttttggccaaaggttggacttgacacactacagaaaggctttcccgctcatttacactatattttagttgacctttgttgttggtgtttaatgtaggccaacaaagaaatcccatatgcatgtaaacgcagactttccattcactaacatttgaactgagaggaycctgcagccaggaattataaacacatcactcatatatcctgcaatctggatgatacccaggacagaggagaaaaagacagcagggggagaaaactgacgttaaaggtggttggaagacatgagagaaaggggaaccatgattgatgtacaatttgatgttgcctgcaaggctgctggacagctgaagaataagttgtaatatcttgcttggtaggctgggatgtctgtatcagatcacaaagatggtggctgacctcacgttctctggtctgggtggagaagataaagggacagtgacat

SEQ ID NO: 165289 - DNA, 601 bp, Human
ggacttctcattccttcagctatttctaaatgacatggttttagtctccccaccttccttctgggtgagtcactcttgcacaagttccatttgccactttccctactgctgggtggtgcccagcgatgaccacaggccccaggtacaatctgacgtgtcagcgaacagggcacctgccctgccacactcaactcactctttctcagggtcaccccatggccacgtcagcatttttggttttaatctttatgagtacatagtcagtgtatatatttatggggtacacaagatatttggataygggcatgcaatgcacactcatcacatcagggtaaataaagcacccatcccctcaagcatttgtcacctctttgtgttataaacaatccaattatacttttagttatttttaagtgtaccataaattattgttgactatagtcaccctgttgtgctgtcaaatactggatcatattcattctatctaactatatttttgtacccataagtcatccccactcccactccccctgctgcccttcccagcttctggtagccatcattctactctctatctccatgaattcaattgtgtgaattt

SEQ ID NO: 165290 - DNA, 601 bp, Human
gatgaatgtgtcacaacttgtgaaattcaggctgctataggagtgtctagcaggggaaccagcctggttctgtgccccggggccacctgtgcgcctccacctttgctctgaacaccaatgacagtagacttgagaaccacacatacctgtattcaaatctgggctgtcacttactggtggaaagttcttagatttatttaatgtctctgggcttcaatttcctcatttgtaaaacgggaataataattcttctctcacacagtggttgtgaggattaaccaaaataatacatggggagctycaaaggccatgtctggcatagggtagatgctcaatacatgtggttttaattatcttccttctggccatttccaccttcctttcggggggatattatcatgtcagacagctcttcctcctactgaggctaacttatggtaacacatgccatatttccctccattaccttctaatgaaactcacatttcttagtccatttacagctgtctcatctataaagtgaagatcataatggtatgtatgttgtagggtaatttaagatttgcatgtgaagtgcttggaatagagtttggcacagagc

SEQ ID NO: 165291 - DNA, 601 bp, Human
gcactccagcctggcaacagagagagactctgtctcaaaaaaaaaaaaaaaaaatctgtccagtatttctgaaaatatactgggattacaactgctgataatccattcctaatttaacataagaatctcccgataacatcccaataggagattcattatccttattttaacttcccctgtctgaacaagagatctctactggtattcattcattttttcaaatatttctagtgcctaggagtacagcactgcacaggacccatggagcccccgcccacgtggatcttgcagtctaacggggaagacaagcaacaaaagttaccagcagatgaatgtgtcacaacttgtgaaattcaggctgctataggagtgtctagcaggggaaccagcctggttctgtgccccggggccacctgtgcgcctccacctttgctctgaacaccaatgacagtagacttgagaaccacacatacctgtattcaaatctgggctgtcacttactggtggaaagttcttagatttatttaatgtctctgggcttcaatttcctcatttgtaaaacgggaataataattcttctctcacacagtggttgtgagga

SEQ ID NO: 165292 - DNA, 601 bp, Human
cacacacacactctctcacacacatacattctcacacactgacacatacacattctctctcacactatcacacactcacacacgccatcacacacaaacacatacacactcacatgcatacactcacacactcacactccctcacacacacatacactctcacacactgacgcagatacacattctctctcacactatcacactctcacacactctatcacacacaaacacatacacacacgcatacacatactcacacacacatacactctcacactatccctgacacacacattctctytcacacacacacactcacactctcacacacacaaactctcaccgccgtaggtgcaggtgctgccccactgctggcgtggcctcgcttcctcctcagcagttccttcactggctccttcacacggacgccctggtatggccgggccggggctggggcttgctccggagctgtggctgtgaaaagcaatgtccctggagcccatggtccttctcagacgagcccccaccccaaagtgctcatttcctcatggatctgcctgctcccctaagtcgtgcttgaacacggagaaccacgtgacac

SEQ ID NO: 165293 - DNA, 601 bp, Human
cacatactctctcacacacacgctcacactctcacactcactctcacacacacacactctctcacacacatacattctcacacactgacacatacacattctctctcacactatcacacactcacacacgccatcacacacaaacacatacacactcacatgcatacactcacacactcacactccctcacacacacatacactctcacacactgacgcagatacacattctctctcacactatcacactctcacacactctatcacacacaaacacatacacacacgcatacacatactcacacacacatacactctcacactatccctgacacacacattctctttcacacacacacactcacactctcacacacacaaactctcaccgccgtaggtgcaggtgctgccccactgctggcgtggcctcgcttcctcctcagcagttccttcactggctccttcacacggacgccctggtatggccgggccggggctggggcttgctccggagctgtggctgtgaaaagcaatgtccctggagcccatggtccttctcagacgagcccccaccccaaagtgctcatttcctcatggatct

SEQ ID NO: 165294 - DNA, 601 bp, Human
cgtactctctcacacactctcacactctcacactcacactctcacacactcacacactctctcacacacactccctcacacacatactctctcacacacacgctcacactctcacactcactctcacacacacacactctctcacacacatacattctcacacactgacacatacacattctctctcacactatcacacactcacacacgccatcacacacaaacacatacacactcacatgcatacactcacacactcacactccctcacacacacatacactctcacacactgacgcasatacacattctctctcacactatcacactctcacacactctatcacacacaaacacatacacacacgcatacacatactcacacacacatacactctcacactatccctgacacacacattctctttcacacacacacactcacactctcacacacacaaactctcaccgccgtaggtgcaggtgctgccccactgctggcgtggcctcgcttcctcctcagcagttccttcactggctccttcacacggacgccctggtatggccgggccggggctggggcttgctccggagctgtggc

SEQ ID NO: 165295 - DNA, 601 bp, Human
cacacgtactctctcacacactctcacactctcacactcacactctcacacactcacacactctctcacacacactccctcacacacatactctctcacacacacgctcacactctcacactcactctcacacacacacactctctcacacacatacattctcacacactgacacatacacattctctctcacactatcacacactcacacacgccatcacacacaaacacatacacactcacatgcatacactcacacactcacactccctcacacacacatacactctcacacactgaygcagatacacattctctctcacactatcacactctcacacactctatcacacacaaacacatacacacacgcatacacatactcacacacacatacactctcacactatccctgacacacacattctctttcacacacacacactcacactctcacacacacaaactctcaccgccgtaggtgcaggtgctgccccactgctggcgtggcctcgcttcctcctcagcagttccttcactggctccttcacacggacgccctggtatggccgggccggggctggggcttgctccggagctg

SEQ ID NO: 165296 - DNA, 601 bp, Human
taaaccccattattaagtgaacaatcactccctaagttatctgaatagaaatgaaaggctagttccaacacaagaccccatgtagatctcgcctggtgccacattcactaaaaacttcaactcagaaccaagactcactgcttgcagggaagctggggagatttagaacagggaatcagagaagacctccccagtcctgaggagcagaaagtatgacgagagaggctgcgagacatctttgtggaagttatctcaggaaatgagaatcagagcaggcctccatggagaccaaggcgagctytgatgacctgattatcttgagaatcaatagcaaggaagatcaggatcgagaagtcagctctggttataaaagggtgcactcagcatgggcgggtgcagtcctgcctttgtgtgacataccgtgacattggtgatgagtggcggagaggcataggtcaacactgaggagggccccaccaccgtgtagctggggcacacgggctgcacatacatgtcagctgagtaggggcagctgacagcttcatggggcacatactcggtgtaaggtgtccatggggccaggggctgcagggtggccggg

SEQ ID NO: 165297 - DNA, 601 bp, Human
tctcctttgacttaagccagtggtccccatcccagtgtcctgaaaccagacagaatccgggaaagcctcatgattcccagcttttcaaaaatccagatggaaattctacatttcccagtcataaacctgtaactataggtttctttgctcgggaatacaattacttccactcagcacacagcaggtcttatctctgctgatcaggagtgtggacttacagctctagccagctttgatgacttaatttacaaaatggcaaaacaaataaatcaattcttaatgaatactgtttgtttgatawacagaacctttcaaagcagaaggtgggaatgatgaaaggggataaataatgaaaggaatccttggtaatgaaatgggtgggagccatgagtcctccacccaccaccctcaccccaggcctctgacatggaaatgagttgcctgggagaggtgttggattaactccttcttatctatcatcatccaggctccaaaattggtttgctgggtaggcaggtggacctgggagggaagggcttctgcaggcctttcatagaaggtgcttggaggcaggggcaggtgcatcaggatgacactggac

SEQ ID NO: 165298 - DNA, 601 bp, Human
ccgacaaagatgtaaatgcatcttctcaaatgctgtcttgaacttttaaatctaaaaaatatctgaataaaaacaattcaagatttgtgtactgggatttaaggcaggcacagagaaatctgggtcaaaattaatcttaagcagaaaaagaaaatccaaaacagacaactttctccagagtttttatttaaagtgggcaaagaaaatatgtcaaagaaactgtcatttcccagaaaagtcatttcccagaaaagtccatgacttctacatggattctaccaactgaaatgtctgcttaatrgtgacgatggtgctattagcaggtgggtgagccagttcccaaggtacacgttcactatcaagagctaagcacacctgctaacaactcagtctcctacaaacctgatgtttctccagcaaaacaaattaaaattaaacctaatggtacttctggctgaggctccagaggtccccaggagggagggtgtttgcgtggagggggccttggttccacagaatggtggcttatggacgcttttaagacactaaagaaacccacatggtaaaaggctgggtgcggtggctcacgcctgtgatccca

SEQ ID NO: 165299 - DNA, 601 bp, Human
aagggaccggaagagaaatgaaggaaagacaatacaacacctaggaagtaagataattttaaaaagagagcactttggcagtggtgaagcaggtgaaacggttgaatacaacacctgtggtttcaaagaaaagttcccacagagcggatacactactcgtccagattaatcggccatcccacccccgctttctacccaacaagccgagccagttccaagccgagatgaagggatccaggggcacttcaaagggcttctgggcatcctgcgcccctcagccgctccagccccgtctcggcckggcaccgcgcttctcctgctccctcgcccaagagacgcggccacctcacggcccggatggggcgcccaggcgggaagcgggttccccgacaaccgcccgggaagggcaaggctccgggcggacgcctcagggggtccgaagcaaggttactagagaggtacccgggagggtcggggcgtgtcaccacagcccctcgcggagcattccccgcctccccttcaagtttctgctacgagtccgactcattcagtacctcggccacccccaccgcgacgcaggccttcccccttctctaccacg

SEQ ID NO: 165300 - DNA, 601 bp, Human
gagttgagtgcaaagtgcctacagtacttattctctcaatgactaacattatgactatctgcccataaaaagatctgcataaaaaatgctgcagtgtgtctatcaccaaacaatgtatcatttatactgcaaaagttgtagaaggagggtaggcagcttataaatactcaccagcagacagtgggcaaagtcaggacctcccactaggccagtgaaatttcccagctgctcagcaagagctaatagtacctcatcttcatcataaattgtatctggaagtgacaacaacaggactcatcaacatggatagctctcccacagctggacactgacacaaaactaggaacagattcactatgcgaccaggaaggtgacccagtcaaaatcctaacagcattttctttcttctcaaccgtcttcctgtatctgctttgcacaacgaattagaaattcatactcccgtatcaattactttcaatagctaaatggttgatgtttgaatatatctagccacaactaacaatatactctgttctgtttcttttgcacaaaaaacacctggctcattttaatgtgggtaataaactctaaaaaagtcagt

SEQ ID NO: 165301 - DNA, 601 bp, Human
aaggagttgagtgcaaagtgcctacagtacttattctctcaatgactaacattatgactatctgcccataaaaagatctgcataaaaaatgctgcagtgtgtctatcaccaaacaatgtatcatttatactgcaaaagttgtagaaggagggtaggcagcttataaatactcaccagcagacagtgggcaaagtcaggacctcccactaggccagtgaaatttcccagctgctcagcaagagctaatagtacctcatcttcatcataaattgtatctggaagtgacaacaacaggactcaycaacatggatagctctcccacagctggacactgacacaaaactaggaacagattcactatgcgaccaggaaggtgacccagtcaaaatcctaacagcattttctttcttctcaaccgtcttcctgtatctgctttgcacaacgaattagaaattcatactcccgtatcaattactttcaatagctaaatggttgatgtttgaatatatctagccacaactaacaatatactctgttctgtttcttttgcacaaaaaacacctggctcattttaatgtgggtaataaactctaaaaaagtc

SEQ ID NO: 165302 - DNA, 601 bp, Human
aggacaccttgcttacagctttagaaataaaagaagccaaatggggtggatggtctggattaagagcagtaactgaatatggcatggcctagtaaaaagtgtaaacaggctggctctctgaacctctgccttactgagtttgcatgtagtccaggtagattctacacatgccatgagctacagattttaaagcataaaacccacatatagaactaaccaagagtgaaacagaagcataatgagttaaagaaaagaagtgtgtctaataatatattttaaaaattgtttgatacacacaggyagacagtattcagctttcctagaaggtatttcagaaactcattgaaaagatactgtttctcacttgccaatgcatttcatgatctgtcccctgcctactgtaaccccctctcgtgcagtaccactggataatagctatcattactacaggatgaggccatgctcctgagaattgcttatgagtggtctcttgatttgaactctgcctggcccttgatgaccactctgcctacccagcctcaacacttcacactccagcagttcttttttttttttttttttaagagacagggtcttgctc

SEQ ID NO: 165303 - DNA, 601 bp, Human
tatttcccatcaaataacactgaataaacctgccccccatacacacagacagacttttagaggttttatcttacaataatcagtgactaagcttctacttatagaagtaacaaaaataaaacatattcaactggataataaaaaatgacatcataggccaggcatggtgcctcacacctgtaatcaaagcactttgggaggcccaggtaggaggactgcttgaggccaggaattgaaagcagactgggcaacatagcaagaccctatctatatgccaaaaatatttttgttgttgtttgtsgggggctcaagtgaactcccacctcagccttctgagtagctagaaatacaggcgggtcccaccatgcccagctaatttttttctttttagtagagacaaggtctcactatgttgctcaagctggtcttgaactcctgagttcaagcaatcctcccacctcagcctctcaaagtgctgggattacaagcatgagccactgcatccagccagaaattttttttaaaaattagccaggcgcagtagtgtatgtcggtagtcctagctacttggaggctgaggctggaggatcacttaagcaca

SEQ ID NO: 165304 - DNA, 601 bp, Human
agggaatccatggagggattctgggatagtggctgtcaaagtgatgtctcctatcataggtgatcgttaacaagttggtattaccttctaatagttcattaagttatacattcattttgtacatttattattagaataaaaattctaataatttttaaaattattttcaaagtaggatttagatctttagatttaggatctgaaaatgagactcattaatatgtgtcctggggcttgtggtcctgtacacatgaagcgatcttagggcaggcaacatgcaaattaaaagcccaaaaggackattctagagtccaggaactctgggagctgatcctattaagcaccattacagagaagcgggacagcctagctgtgaagggcacaaattctggagccaaaccacctagattcaaattctgactccactactgctaactatgcaaacttcagcaagttacttaaactttctgtgcctttgttttctaatgtgtaaaatgggctatctcatggggctgttgtaaggactgaattacttaatacacataactacttaaaggcagagaaaaattaagtacttcatttggatgtttgctagttttat

SEQ ID NO: 165305 - DNA, 601 bp, Human
ggacagaataactttgaggaagctgtggctagaaaaacacagaaattagaaaagtatgggattaatgaactcaactttccaaatgtaaacagccaatgtcaacgtgacacctacgtcctttgaacaagtggaaaatatacaagacaaatcagtgaggggccaggcacagtggctcatgcctgtaatcccagcactttgggaggccgaggcaggcggatcacctgaggtcaagagttcaacaccagcctggccaacatggtgaaaccccatctctactaacaatacaaaaattagccaggcrtggtggcacgtgcctgtaatcccagctactcaggtggctgaggcagcagaattgcttgaacccaggaggcagaggctgcagtgagccgagatcgcgccactgcactccagcctgggtgacagagcaaaactccaactcaaaaaaaaaaaaacaccgaaaaaaaagaaacatcaatgagaaattagaaattgagactgtagatttgtgtattatacatatataaggtagaatcttaatacatgtaaacattagcacccaggagaaataggtaaaaaattttaagtgtgtacaataacagtt

SEQ ID NO: 165306 - DNA, 601 bp, Human
tcttcaatgggcaagttctcaccaagttctaaaagataaatagaaaaaaagaatgctttcacagggccatttacaaagagccaaatgaggacatttaaccaggtttatcaataatttcaattaaattatatgtttaagcaaataaggaaaacagctcttgttctaaataaactttttcgtgaactctctatgccattgcatatcacaccaatccaacctgaaaggcatttttttttttacaaaaacaagacaaaatgatttcttggttttaaatataaagagactatctttaagtgacaaygtaacatttccacacactaaaaacatccctatgtattttaaaaacatattctagaacaaaaaacatgcaaaattgactaacaaaaaaatgcaccaaaatgaatgacacatgttccaacataaattgaactccttaaccttttactttgtgggcagcagctgcccggacttcagcttcacagtctttaagtaggttctgaaaggcggggatgaggtcatttagggtgattttaggacccatggctttctggagctataaaagaatttgaacgggttttaatgtatactaacaaaagaatta

SEQ ID NO: 165307 - DNA, 601 bp, Human
tgcatgccaccaggctcaactaatttttgtattttttgtagcaatggggtctcactatgttgcccaggctggtctcaaactcctgggctcaagaaatcctcccacctcagcgtcccaaagtgcttggattacaggcatgtaccaccatgcctgaccccaaggaatttaaagacagcactatttcaatactgattagttgataatgtttcctcagactacttgttaggtaacataaacctatgcaccaaagagcagtttacaattacaatgggctaataagtgatgaataacaatgttgcayattaacacatcttccccattcattccctgtcaacctttaaactcaaagagctttaaggtaaacaaacaaacaaaaataatgagattaaggtttaccttcatataaaagagagtgaaacaaaataaagtcaggtttacctttatataaggcagaatttgattcataattatggtctctctatcttcaatgggcaagttctcaccaagttctaaaagataaatagaaaaaaagaatgctttcacagggccatttacaaagagccaaatgaggacatttaaccaggtttatcaataatttcaa

SEQ ID NO: 165308 - DNA, 601 bp, Human
aattggccgggtgcggtggctcacacctgtaatcccagcactttgggaggccgagacgggcagatcacgaggtcaggagatcgagaccacagtgaaaccccgtctctactaaaaatacaaaaaattagctgggtgctgtggcaggcgcctgtagtcccagctactcaggaggctgaggcaagagaatggcatcaactcaggaggcggagcttgcagtgagcagagattgcgccactgcactccagcctgggcgacagagcaagactccgtctcaaaaaacaaaacaaacaaacaaacaaaaaaaaagggataataataagacctacctcacaggattgttgtgagaattgcatgtaaaaatacatgcaaagcactaaggctcatgcttgccatgtagtaattactcagtaaatattaggtatcattataatttttgatactatatttaaacttaaataaatgaaactttttaaacaaagacacattagctttaaagaaaccagggagtataaagcaaaaatcaggtaaagatgataaacagatatttctaggtttactctaatgggtacttttgcccactttctgaggaacctataacccc

SEQ ID NO: 165309 - DNA, 601 bp, Human
aacataagcatacaggctactaggcctcctacttgccatggtaaattgtcactatctgacactaccctgcagttcatggagcaacacatactcaccagctggcctgccagcagcggcatatactcaatgatggccaggcggaccctccatttggcatcttctgccagctccactatggcaggaaggagagactgagagagctgacggattccaatcacttcatttacacaatccaaattggagatgatattcaaacgaacgtcaggacactgcaagtacacaagccccaaaagaccacatwtaaaaatcaagtactctgcccaacagtctcctgtcagggtaagataaaaggtgaggtaagactcaggtgaaaaaaaaatggataatcttgaagaaataatagtgaatacataaataactcaaggaacataaatgatcttaatcagaaatttcaattaaaagtccgtaatactaaagactacaagaaaagtccgtaagatggtaaagagcataatctctggaactaaatcagatgcactcaaatttcagatctgtcattgttgaaagaccttgctcaagttactttaaccctctatgcctc

SEQ ID NO: 165310 - DNA, 601 bp, Human
ctaaaagagatcacccatctctccaactagactgtaacagacaattacaatactctgtaataagtgctaccaacagagatgaaggtacatcaaacttagaactgtctaggccacctactcaaaaaaaggaaaggatgtggctataaaacccagctttgaaattttaactaacatggtattagttagggtaacactgatcacgaaactcaaacagtaacagataatgtgataatgtggactttgaccaaaatactaacattacaagcttcagtttttgtttttgttttgtttttttttttttgacacaaagttttactctgttgcccaggctgcagtgcagtagtgcaatcttggctcactgcagccttcgcctcctgggttcaagcgattctcctgcctcagcctcccgagtagctggtattacaggtgtgcacctccgtgcccagctaatttttgtatttttagtagagatggggtttcaccatgttggccaggctggtctggaactcctagcctcaagtgattcgcctgcctctggctcccaaagtgctgggtttacaggtgtcagccactgtgcccggcctttcaatacttcttttct

SEQ ID NO: 165311 - DNA, 601 bp, Human
tagagatggggtttcaccatgttggtcaggctgggctcaaactcctgacctcaggtgatccacccacctaggcctcccaaagtgctgggattacaagcgtgagccactacgcctggcctattttccggtttttgtagtttaactttacacttacttaacatcgtccacaagccaggtcatacataaagtcttgagagaattttataaaatgactatctgatataaaaatatttagatatgaagagaaattaaggagaatatatatactaacaagaagttaaaattgtaaagcaaaatgttyatgactgaggcatgtcacccctgccagacaggtgtaagtcagccaaagacaccatctgccttgctttcacactgctctctatagagctagcaaccctgggaaactttccaggtctagaaggagcagaggttaaaagaaatggtactaaaatgcaccctcccttccagatagttttggtcttcagcaaatcagttaatcactgctcctctccactctgaaaagtagatccatgacaatcaccagtgaagagaagatgacccatagcacttgggagtgacagacaaaaaggatgacaaaata

SEQ ID NO: 165312 - DNA, 601 bp, Human
gccacaataagataactttagagaagaaaaagagaaagaagtctacaatccagtttgaaaacactggaaatacccacatatataagcccttatacattttcacatattttttcacatccttcctcttcacactcttaaccatatgatcctccatatgatgcaaacatgcctttaacaaaaccacccacacgtataagcagacacaaatatcctcattcctcccaaatttccaggcataagcacccatagatgaacaaagagatacactaaatacatatatcaagtatataaaagatactgyggaactgactcaggttatctattatatccaccaaaacatggaaacaaagctcaaggacaatgtcacatgaccccataggggcactcacactcatcgaaacaggtctaagacaacactgaagctgtcaagtctggacctgggatctggcagagacggtacatctgtcacccactgctgcctggcacacaaggggatacacacatatacctctacctgaagcctcaccaggaagtcacttgctcattcctgctgtcctatctgacctgccctgagctcaccctctcctagcactgtagcagc

SEQ ID NO: 165313 - DNA, 601 bp, Human
atcacacactgaggcctatcagggggtgaggggcgaggggagggagagcattagaacaaatacctaatgcatgtggggcttaaaacctagacgacaggttgatagatgcggcaaaccaccatggcacatgtatatctatgtaacataacaaacttgcatgttctatgcatgtatcctagaacttaaagtaaaataaaatttaaaaaagcacagaatgatttgctaggatgcaccattcccagtaacgtcaaatatttatcagatataacataaacattttttttaaaagtggtatttcttycctatgatttgccaaattttaattttatttaaaaagaaataaataggccacaataagataactttagagaagaaaaagagaaagaagtctacaatccagtttgaaaacactggaaatacccacatatataagcccttatacattttcacatattttttcacatccttcctcttcacactcttaaccatatgatcctccatatgatgcaaacatgcctttaacaaaaccacccacacgtataagcagacacaaatatcctcattcctcccaaatttccaggcataagcacccatagatgaa

SEQ ID NO: 165314 - DNA, 601 bp, Human
tctattcatagatccttctgggcaatgatgttgagaacaagcaagacagcatagacaagtgacccatacaactgattatcaacacttaaactgacagtctacaggagaagcaacctttcggtaagactcagatgcactaaggagcaaactcaagtcaactgttttactgtaatacagattccttcccttcatatccatagtctttgtctttggcccaaacccttccctgtcctccccactaaagaggagctagctagagtatttgtgtcttctcctctaatttttttttttttttttttttgagacagagcctcactctgtctctcaggctggagtgcagtggcgagatctcggctcactgcaacctccgcctcctgggttcaagcaactctcctgcctcagcctcctgagtagctgggattacaggcgcccgccaacacatccagctaatttttgtgtttttagtagagacagggtttcaccatgttggccaggctggtctcgaactcctaacttcaagtcatccacccgcctcagcctcccaaagtgctgggattacaggcatgagccaccatgctcagcaaattactattttttttaa

SEQ ID NO: 165315 - DNA, 601 bp, Human
tggtgccagctgccaacaggtacagaatgtgggctcagcaactgttagcttaaacaaagcattgtttactcaacagaggggaaggaggaggacatgaaaaggcaggtctatttctaaacatcatttaaatttcttttaggggtggtaagcaacttgaccttgaaaactgattcaaagagagaattctttgaattcttttaacatcctgagaatatagaaacaagttgtaattttctgtctgcagaagcgctacatgtttattttagaacatttaaaaaggaaaaactaaaaattctttagkttctaccacctgaagaggactgctatcgatactctgaggtagccacatcatttcaggctcatcaagaggggtgtttcttaacaatatgggtgtgttggctgcctcctgctttagacagtaatcagacaccttggaccttggttatttgctctttggaacaagcatcgaattgaatccctttgagagttctgtaaagttcagctctgaggtggaagctgagcctcttagctgaaaacatggctgtacctaaggctggacatctgctctccttctcttgcccaaatacggtttctgaataga

SEQ ID NO: 165316 - DNA, 601 bp, Human
cgtatttttattttttatagagatgaggggctcgctatgttgcccaagctggtctcaaactcctggcctcaagcgatcctcccaccttggcctcccaaagttctgggattacaggcatgagccactgtgcctagccaacgtggagaatatttattcagaaatgcttatggtgcccctactttgtggcagatgtgggactaggactcagaattaatgagatgctcttcctgtcttcagcaggctcacagctttcctacaaatgaagactgtaatcaagtggccctttgtgtgctttccactyggagaaaattacctcagttgctctcatctttcctcctaaaacctgtttttctatcatgactattatttattgacagataaaggacattttaaaaagaaaatcacactatacagtcgcaacattggaaacaccaactatttgccattttttaattttagaccttactcatatgtataatgatttttaaataagagtaataagagcataaataatagttttgtagctttccttgtaccccacttagtataggaaaataggaaacaagttattcactctgatcttatgctttatctcttctct

SEQ ID NO: 165317 - DNA, 601 bp, Human
agcgatcctcccaccttggcctcccaaagttctgggattacaggcatgagccactgtgcctagccaacgtggagaatatttattcagaaatgcttatggtgcccctactttgtggcagatgtgggactaggactcagaattaatgagatgctcttcctgtcttcagcaggctcacagctttcctacaaatgaagactgtaatcaagtggccctttgtgtgctttccactcggagaaaattacctcagttgctctcatctttcctcctaaaacctgtttttctatcatgactattatttatagacagataaaggacattttaaaaagaaaatcacactatacagtcgcaacattggaaacaccaactatttgccattttttaattttagaccttactcatatgtataatgatttttaaataagagtaataagagcataaataatagttttgtagctttccttgtaccccacttagtataggaaaataggaaacaagttattcactctgatcttatgctttatctcttctctatgctaatgagataatgtaatgtttatattacatttcatatcattaaaattatttactctagtggttatga

SEQ ID NO: 165318 - DNA, 601 bp, Human
atcacactatacagtcgcaacattggaaacaccaactatttgccattttttaattttagaccttactcatatgtataatgatttttaaataagagtaataagagcataaataatagttttgtagctttccttgtaccccacttagtataggaaaataggaaacaagttattcactctgatcttatgctttatctcttctctatgctaatgagataatgtaatgtttatattacatttcatatcattaaaattatttactctagtggttatgagtgttttaattttcttcttaatttatttytatttttattttttttgagacagagtctcaatctgttgcccaggctggagagcagtggcgcgatcttggctcactaccacctccgtcgtaggtttaagcggttcccctgcctcagcctcctgagtagctgggattacaggcgctcgccaccacgcctgactaattttttgtatttttggtagagacagggtttcactgtgttggccaggctggtctcgaactcctgacctcatgatctgcccgcctcggcctcccaaagtgctgggattacgggcgtgagccaccgcgcccagctttctt

SEQ ID NO: 165319 - DNA, 601 bp, Human
cttctttttctgggcattatattcttttgcaattcatccgtattgttgcatcagtagttttgttcctccattcctttttattgttcattagtattccattgtattgtactctgatctttttggcatgtatcttcttcattattaatgtaataacaatatttcatcaattgtgatatggcacctatttctatctattcatttttgtcattccttcctatatcctctctgtttcctttgcctgctatcacaatgggccctcttgggacagaattccctgtcttcccagaatggataatggccyattatactctgaaattcaatcaatatggatatttatcatgctaacagggaacacatttcttgatctctttcttggagaaaaagagtcattaagaatgctaactgataaacggaaccacccttgccaattcctctatcgattcaccttgttatatattaatcctaatccatagtagtgtcccacagcaacgcagtttgcttaaaagttgaatgcagtgtttgagtgccatccaaaaatttttcaatacggaatttccaaaagaaccttgtgaaacattcaactcagaaagctgtctcatgc

SEQ ID NO: 165320 - DNA, 601 bp, Human
gtcaccaatttgcgtattactactgatatataatagaagaaaagaagtaaagtgcctctgttagtttcttgaggctgccaaaataaagtatttgcaaaagtaattgcaccaacctaatagcacaaactggatggcttagaatagtagaaatgtattgcctcacagttctggaggccagaaatccaaagcaaggtgtcagcagagccatgctccctttgacacctgtgcagaagccttctgggcctcttcctagcttctgggggtttgctggcaatcctagctattccttggcttgctgctscataacttccatctctgcctttgtcatacggtgctcaccccttgtatgtctctgtcttctcatatccacatcttcttataaggacaccagtcgtattggattaggggcccaccctacaccagtatcacctcatcttaactgattaatctgcagtggccctatttccaaataaggtcacattctgaggtgctggaggttaggacttcaacatgtcttttttgaggggggagatacaattcatccaataacggggcccaaggaagtcgatgtcatacatgtctaccttcctctgtcagacat

SEQ ID NO: 165321 - DNA, 601 bp, Human
tgcataacttccatctctgcctttgtcatacggtgctcaccccttgtatgtctctgtcttctcatatccacatcttcttataaggacaccagtcgtattggattaggggcccaccctacaccagtatcacctcatcttaactgattaatctgcagtggccctatttccaaataaggtcacattctgaggtgctggaggttaggacttcaacatgtcttttttgaggggggagatacaattcatccaataacggggcccaaggaagtcgatgtcatacatgtctaccttcctctgtcagacwtatagagggtgatgaccaagtgccaaatgcttaccatatccagaacatgaaagcctggtcttgcagcagagaaggcccgtgccctgggtacctgaggacttggatgggcttgatgtgggccactatgggcctgagaggtccaggccagggtggtctagtgcagtaagctcaagtcaggctcaccagagaactgtgctaagggtataaaaatcctccattcctttagatggcccatattacattcttggatccaattagattatcagaaaactttagctctattccacactgtttatgcca

SEQ ID NO: 165322 - DNA, 601 bp, Human
aaaagaatctcattattttatttattatggaggtacagctgaagttctctttgatgatgatgatgatgatgatgatgatgtttctgagtttttgttttagtgtttacttttttctgggttttgtgctaagtgcattcctgtattatcctgtttctgtgagttattattcgcaacatacaagtgagaaaaatgaaacgtccccaggtcacacagctagaaagaggtaaagataagattcataccccactccagtgcttatgctccttcccactaagcttcttagaccaagcgccaactactmcctccttcctcagcctctggacagtgctcgatcctggatttcctatgagctcaaggaccaccccttctcagccatcctttctgggctctccccttttggacctgtactgttggagagacccaggcttatcctaagtccctgttccctattttcactttctttccaggtcatttcatcaagtaccacccaaatgctgatgcatcccgactttattatactggatgtgacctctagacttataccgtataaccaattgtctttttgacaattccacttggatatttaatggacatcccaaac

SEQ ID NO: 165323 - DNA, 601 bp, Human
acctcttttaaaaatgaaatatcaccataatgccattcttatacctaaaaatgttaaaaccaagtcgttagtgtcatcaaatgtcaagtcaatgttcaaatttccatcgtctcataaatgtcttttgctttttactgtttaatttaggatccaaattatggtactacaggttcacattatgatcattgatgttccttttcatatcttttaaactgtagttcccttccatctctctctctttaaattctccttgcaatttatttgtcgaagaaactagatcgttttttaagtgctgtgtctsagagtctggattttgctgactgcaaccctttggtgtggtttaacattctcctttctcctgtttactggaaatttgtttttggctctagaggcttgactggattcaggtttgatatttttcccttttggggagaacagggttccacgttggtgtagtttgtcttccccccactccttgcccaccaacttgagccacactggcctctgtcctgctttccctacaaactagttccggcctcaggacctttgcaggagctgtttcctctgcctgtaacccttgcctccatctttgcatgagcag

SEQ ID NO: 165324 - DNA, 601 bp, Human
tccaaattatggtactacaggttcacattatgatcattgatgttccttttcatatcttttaaactgtagttcccttccatctctctctctttaaattctccttgcaatttatttgtcgaagaaactagatcgttttttaagtgctgtgtctgagagtctggattttgctgactgcaaccctttggtgtggtttaacattctcctttctcctgtttactggaaatttgtttttggctctagaggcttgactggattcaggtttgatatttttcccttttggggagaacagggttccacgttrgtgtagtttgtcttccccccactccttgcccaccaacttgagccacactggcctctgtcctgctttccctacaaactagttccggcctcaggacctttgcaggagctgtttcctctgcctgtaacccttgcctccatctttgcatgagcagctgcttcatttcattcagctcttaacctcaatgtcactcctcagaatgggtcctgcaggacctctctatctgcttcacagcaatgctcacccctaggcactttatggaattgtgaattgttggcttgtttactgtctgcctcccatgag

SEQ ID NO: 165325 - DNA, 601 bp, Human
ttggggagaacagggttccacgttggtgtagtttgtcttccccccactccttgcccaccaacttgagccacactggcctctgtcctgctttccctacaaactagttccggcctcaggacctttgcaggagctgtttcctctgcctgtaacccttgcctccatctttgcatgagcagctgcttcatttcattcagctcttaacctcaatgtcactcctcagaatgggtcctgcaggacctctctatctgcttcacagcaatgctcacccctaggcactttatggaattgtgaattgttggcytgtttactgtctgcctcccatgagctagagcatcagtcccggggagcaagagcttaatttttcatggtcactactgtacccctagcacctagaataccatctaggctatggtcagtgctcaacaaatgtttgccgaatgagatgcctccgtgttggtgagaggctgcctctcagtaacatcactctcttgtgtgctcaggcaaccaaaggaggtactgtcaaagctgcttcaggattcaatgccatggaagatgcccagaccctgaggaaggccatgaaagggctcggtatgtgtcctgc

SEQ ID NO: 165326 - DNA, 601 bp, Human
tgcaggagctgtttcctctgcctgtaacccttgcctccatctttgcatgagcagctgcttcatttcattcagctcttaacctcaatgtcactcctcagaatgggtcctgcaggacctctctatctgcttcacagcaatgctcacccctaggcactttatggaattgtgaattgttggcttgtttactgtctgcctcccatgagctagagcatcagtcccggggagcaagagcttaatttttcatggtcactactgtacccctagcacctagaataccatctaggctatggtcagtgctcarcaaatgtttgccgaatgagatgcctccgtgttggtgagaggctgcctctcagtaacatcactctcttgtgtgctcaggcaaccaaaggaggtactgtcaaagctgcttcaggattcaatgccatggaagatgcccagaccctgaggaaggccatgaaagggctcggtatgtgtcctgctggaagtgaatcctcctgcgtgcattgcacatcacagggtcacacaggagggtgccatgtctgctggccatcacgtgggtcttcctttaataaaacacaagggaggctgggtgtggggctca

SEQ ID NO: 165327 - DNA, 601 bp, Human
tcttaacctcaatgtcactcctcagaatgggtcctgcaggacctctctatctgcttcacagcaatgctcacccctaggcactttatggaattgtgaattgttggcttgtttactgtctgcctcccatgagctagagcatcagtcccggggagcaagagcttaatttttcatggtcactactgtacccctagcacctagaataccatctaggctatggtcagtgctcaacaaatgtttgccgaatgagatgcctccgtgttggtgagaggctgcctctcagtaacatcactctcttgtgtgytcaggcaaccaaaggaggtactgtcaaagctgcttcaggattcaatgccatggaagatgcccagaccctgaggaaggccatgaaagggctcggtatgtgtcctgctggaagtgaatcctcctgcgtgcattgcacatcacagggtcacacaggagggtgccatgtctgctggccatcacgtgggtcttcctttaataaaacacaagggaggctgggtgtggggctcatgcctgtcatctcagcactttgggaggctgaggtgggcagatcacttgaggccacaagttcgagacaagcctg

SEQ ID NO: 165328 - DNA, 601 bp, Human
gcgtggtggcacacacctgtaatcccagctacttgggaggctgaggcaggagaatcacttgaacccaggaggtggaggttgcagtgagctgagatctcaccatggcactccagcctgggagacagagtgagactccatctcaaaaaagaaagaaagaggctgggcacggtggctcacgcctgtaatcccagcactttgggaggctgaggcgggtggatcacgaggtcaggagatcgagaccatcctggctaacacggtgaaaccccgtctctactaaaaatacaaaaaaattagctgggcrtggtggcgggcgcctgtagtcccagctactcaggaggctgaggcaggagaatggcgtgaacccgggaggtggagcttgcagtgagctgagattgcaccactgcactccaggctgggcgacagagcgagactccatctcaaaaaaaaaaaaaaaaagaaagagggaaagaagggaagaaggaaggaaagaaggaggagagggagggagggagggaaagaaaacacatggaacaagttgagataagttgggacaaactggatggggaggggcattagttcttcactttaataaagaatgata

SEQ ID NO: 165329 - DNA, 601 bp, Human
gcacacacctgtaatcccagctacttgggaggctgaggcaggagaatcacttgaacccaggaggtggaggttgcagtgagctgagatctcaccatggcactccagcctgggagacagagtgagactccatctcaaaaaagaaagaaagaggctgggcacggtggctcacgcctgtaatcccagcactttgggaggctgaggcgggtggatcacgaggtcaggagatcgagaccatcctggctaacacggtgaaaccccgtctctactaaaaatacaaaaaaattagctgggcgtggtggcrggcgcctgtagtcccagctactcaggaggctgaggcaggagaatggcgtgaacccgggaggtggagcttgcagtgagctgagattgcaccactgcactccaggctgggcgacagagcgagactccatctcaaaaaaaaaaaaaaaaagaaagagggaaagaagggaagaaggaaggaaagaaggaggagagggagggagggagggaaagaaaacacatggaacaagttgagataagttgggacaaactggatggggaggggcattagttcttcactttaataaagaatgataaatttaat

SEQ ID NO: 165330 - DNA, 601 bp, Human
tccatcacagagaggggtcccgagcgggttgccaagtggtagtaaaattgtcagggtttttataaatgggctactgaggagggggctcatgagcagaggaggtcttatcctcctagggtccagtggtttggttgggaccaggtgtgccttctatatagagcagagtttttttaaatcagctcttatcccattctctgaccacatagatggactcttattctgtgtttctttgtcttgcttatctgggagggagagtttctgtgtctgttcccacacatcttcttgcagctgcagacatccrcccaagtctgtttttagctcctcaatcttactgcgcctaaagggaaggaatatgcttattaagacccactgttttactggggcccactgtgtaaatgtgaagtttggtgattacccaggagacttccccctccctttctgtgctcaagccatcttctctgtgttttacagcctgaactttcaggctgcttgttgttagaagagaagtgctttttttttgaactgcatgaggttagaaagggagctatttttgagctgctttttgttaaaaggaaagttttctgctggggactcactttac

SEQ ID NO: 165331 - DNA, 601 bp, Human
ggggctcatgagcagaggaggtcttatcctcctagggtccagtggtttggttgggaccaggtgtgccttctatatagagcagagtttttttaaatcagctcttatcccattctctgaccacatagatggactcttattctgtgtttctttgtcttgcttatctgggagggagagtttctgtgtctgttcccacacatcttcttgcagctgcagacatccgcccaagtctgtttttagctcctcaatcttactgcgcctaaagggaaggaatatgcttattaagacccactgttttactggkgcccactgtgtaaatgtgaagtttggtgattacccaggagacttccccctccctttctgtgctcaagccatcttctctgtgttttacagcctgaactttcaggctgcttgttgttagaagagaagtgctttttttttgaactgcatgaggttagaaagggagctatttttgagctgctttttgttaaaaggaaagttttctgctggggactcactttaccctaaatgtctacctaaatcatttctttctgcctcctataacatatttcccccctcaggaatgaaatccataactgctgct

SEQ ID NO: 165332 - DNA, 601 bp, Human
acccaggagacttccccctccctttctgtgctcaagccatcttctctgtgttttacagcctgaactttcaggctgcttgttgttagaagagaagtgctttttttttgaactgcatgaggttagaaagggagctatttttgagctgctttttgttaaaaggaaagttttctgctggggactcactttaccctaaatgtctacctaaatcatttctttctgcctcctataacatatttcccccctcaggaatgaaatccataactgctgctaggggaaactgggtgacgatttcttctggctrcttcctgctggagagtggcgttgtgtggggaacagcagctagggctcctcctggggttgatttaagggtccctcgtaggagggcagtttcattttcggctccattttcagcaccatctgaagcttgatggtttctaagcgagaagagataaacttcacaaggaggtttagaatataggttctaaatatgagtattaagattactattattaatgggggcactataggccgtaaccatgacaacagagtttgtttgatacctgtgagccattcagatgggttgtgctgctgtaagtgggta

SEQ ID NO: 165333 - DNA, 601 bp, Human
acatatttcccccctcaggaatgaaatccataactgctgctaggggaaactgggtgacgatttcttctggctacttcctgctggagagtggcgttgtgtggggaacagcagctagggctcctcctggggttgatttaagggtccctcgtaggagggcagtttcattttcggctccattttcagcaccatctgaagcttgatggtttctaagcgagaagagataaacttcacaaggaggtttagaatataggttctaaatatgagtattaagattactattattaatgggggcactataggycgtaaccatgacaacagagtttgtttgatacctgtgagccattcagatgggttgtgctgctgtaagtgggtatatggggcttggctttgtttagcttccttggtcttactttcccaaaaaagggagaaaccctggggttctagtttacctggcaggatttgtaggataattgcccagaactagaacatgtttccagatttttctattaccgatgcctttctgttttctctgagctgcagccagagattcctggttggttgacaggagtaagcagggttagtttaaaatgtaggcaagaac

SEQ ID NO: 165334 - DNA, 601 bp, Human
ctcttagattggctttgatggaaccttgttccatgaggaattttagataggactttttaaagccaagcccagccataggtttgtacttttaaatacctgtgagttggataaatttttttccttcttgaggttccagaagcatggggttcctaggcctgttagaaagtgacattctttactcactgcaggtcaggaaccctgtatggagactgtgtagacagatatgaggccagttttccccaggggcttttattggctcagcaagttaagcttgattccttaaagggaaatatacccttcyagtcaaagccttggtaaaacaaccagtttttccaattgtgttttgttgcaagagaaaatggattcttgctgcactgattcaaacaactatattgttgtaatttaagaatatttataactagtttccaaattctacaggaattaggcagagagacataaacatgctccaaactttgcctatagtagtacactttgcttagttatcaaaggctgtagctagcttaagacaagtttttttgactctaaaaaataaaataaggattagccgtgttctaagaataagtgaagaatattgctttag

SEQ ID NO: 165335 - DNA, 601 bp, Human
gaggaattttagataggactttttaaagccaagcccagccataggtttgtacttttaaatacctgtgagttggataaatttttttccttcttgaggttccagaagcatggggttcctaggcctgttagaaagtgacattctttactcactgcaggtcaggaaccctgtatggagactgtgtagacagatatgaggccagttttccccaggggcttttattggctcagcaagttaagcttgattccttaaagggaaatatacccttctagtcaaagccttggtaaaacaaccagtttttccrattgtgttttgttgcaagagaaaatggattcttgctgcactgattcaaacaactatattgttgtaatttaagaatatttataactagtttccaaattctacaggaattaggcagagagacataaacatgctccaaactttgcctatagtagtacactttgcttagttatcaaaggctgtagctagcttaagacaagtttttttgactctaaaaaataaaataaggattagccgtgttctaagaataagtgaagaatattgctttagttttctattagttcagttcattccattaactttt

SEQ ID NO: 165336 - DNA, 601 bp, Human
ttactcactgcaggtcaggaaccctgtatggagactgtgtagacagatatgaggccagttttccccaggggcttttattggctcagcaagttaagcttgattccttaaagggaaatatacccttctagtcaaagccttggtaaaacaaccagtttttccaattgtgttttgttgcaagagaaaatggattcttgctgcactgattcaaacaactatattgttgtaatttaagaatatttataactagtttccaaattctacaggaattaggcagagagacataaacatgctccaaactttrcctatagtagtacactttgcttagttatcaaaggctgtagctagcttaagacaagtttttttgactctaaaaaataaaataaggattagccgtgttctaagaataagtgaagaatattgctttagttttctattagttcagttcattccattaacttttgttttgatatttataaacattttagccttttatgagtcccatacattttttggtcatgacaaacctgcattggagagaacttgttaaagtcccatggcttgattatgaaccatcttttgaagagaattaaaacaaaacaac

SEQ ID NO: 165337 - DNA, 601 bp, Human
tatgagtcccatacattttttggtcatgacaaacctgcattggagagaacttgttaaagtcccatggcttgattatgaaccatcttttgaagagaattaaaacaaaacaacaattgtctgtaaatgacaaaatgtccagtttggatacagtcagaaatacaattgacaaagaaatttggttatttttgtgtttttcaaaaacccagcataacaaccttaattgtaatagcacatattcagacactagaaccatagacatcccatacagttttggaacacatgttaatattattccctaaartataacctgaagagtattagacatcattttggcaattttatgtacctcaacatgttaaataatactgtttacctctcttctagatgcttcaggggtcctctgcagcacccaaaagccaggggttaggaaagacagacttgagactaaagtttgactttgggaagcctgttaagtatatttaaaatttaaaacacttgatattatgaaatagaattttagattaccaaaagtttttgtttttgccaaaatgttgagccagaaatttgaaaaagcaaaaaccattcattagccttttctatt

SEQ ID NO: 165338 - DNA, 601 bp, Human
agacatttgtattttaccaataattcctaagactctttttatttttaaagattaaagtcacatgaactgaaaggtaccacagcttttacttttcccttaaaaatgtttgatttaagcgcttatttttcttaggccaattaattagagctcctttttttaataggcattacacaagtaacacatatataaccacacaaacagaagaagatccagcagttataagattttgcatttgccaatgtcccaattggattattggcctctgagtgaggttctttcagaacagagctaggaatacagyttccagggcctaataagcaagcatagccagaagacaaagacgattttgagaggtatttattcacctttaattccaggggctccgaggaaaacagatttttcctaaaatgggatttgtggtgcattttctgtttccccaaggagtcccaggccaccggaagccattctaggtgcaccaagagtggcaagacacagtaaaaaaaaaaagcaattcagtcaactgagaaaaaaaacgtttccagatttatgaagatttatttaagaagatttatgaagagaaaaacataaaggccttttaaat

SEQ ID NO: 165339 - DNA, 601 bp, Human
tgccaatgtcccaattggattattggcctctgagtgaggttctttcagaacagagctaggaatacagcttccagggcctaataagcaagcatagccagaagacaaagacgattttgagaggtatttattcacctttaattccaggggctccgaggaaaacagatttttcctaaaatgggatttgtggtgcattttctgtttccccaaggagtcccaggccaccggaagccattctaggtgcaccaagagtggcaagacacagtaaaaaaaaaaagcaattcagtcaactgagaaaaaaaacgtttccagatttatgaagatttatttaagaagatttatgaagagaaaaacataaaggccttttaaatatacccattgattggatatccacttttaattaagctgaatgctctttaagaaaatcctttttcattaattaaaactttacaaagaatgcaaacagtaattcttattatttcttttacccagtttgctccacttacctgttcacaatcatgtttaggttctccagttttctctgggagaaagtggctgggctcaggcaagggcaggttttcagctggactgcagatccctttag

SEQ ID NO: 165340 - DNA, 601 bp, Human
ctctgccttccgagttcacgccattctcttgcctcagcctcccgagtagctgggactacaggtgcctgccaccatgcccagctaattttttttgcatttttagtagagacggggtttcaccgtgttagccaggaaggcttggtttagctggttaaaggctttttgagccttaggttcccaaaagagagaggggtgagttttaactgtttgagtttcttttatgaggtggtataaagggtgagccatttccctgtgcccaggtactcacagtttacaaaatccagtaatgcccaagaatttycctaactatcaaaggaaatgggcctaatcctttcctcacctggtgctctggtcccttctgataagaccagaactaggtactttactgaagtctgacagagctgagctttggattttgagactctatactccctttcagctaagaaattaaggagagtcttagcatcttcctgagccttccttgattggggcatagaggaaagtgttatctacatactgcaagaccctgacctgaggacgggaaaacttagaggggtcctttgacagtgcttgtccaaatgagtgagggctgttttgaaat

SEQ ID NO: 165341 - DNA, 601 bp, Human
agaactaggtactttactgaagtctgacagagctgagctttggattttgagactctatactccctttcagctaagaaattaaggagagtcttagcatcttcctgagccttccttgattggggcatagaggaaagtgttatctacatactgcaagaccctgacctgaggacgggaaaacttagaggggtcctttgacagtgcttgtccaaatgagtgagggctgttttgaaatccctgaggcagcaccatccatgttaactgtgtggtctggccggagggatccttacaggcaaacaggtaytgagagtcaggatgtaacggtatgcagaaaaaggcatcctttaaatctaggactataaaccatttagttccttcaggtatttgagtcagcaaggactcaaacggatgaattgggactatggcccattaatgaggcagatgtcctgaactagtctccattccccattgggtttttatgctcctagtatcggggtgttgcaaggactgttacagggtctgaggaggccctgcatttttaggttattaataatagcttctagccctttcctggcctctggctttagaggatattgtctctggt

SEQ ID NO: 165342 - DNA, 601 bp, Human
ccccattgggtttttatgctcctagtatcggggtgttgcaaggactgttacagggtctgaggaggccctgcatttttaggttattaataatagcttctagccctttcctggcctctggctttagaggatattgtctctggttaggaaaagaagtgggatttttaaggcggatctgaactggcctagcagttttagcttgacctattcttccttgagttgtccacacttctggattaatgttggctttcactaagggaagacaaagagtttgtcctggggccatgaggatgctggcccccaygtgggctaaaatatctctacctagtaaaggagtggggggactttcaggcatatttaagaaggcatgtgtaaataataagttccccccaactacagtgagagaaatattgggttagagtctttcctgagacacccaccatggttgtgctatgggaagaggggaggccttgattggacaggagaacagagagactggctccagtatccaggaggaagcccaccctccttccttcaatttccagaatcacccggggctcctgaacagtgatggcagtctgagccactggagccaggggtctga

SEQ ID NO: 165343 - DNA, 601 bp, Human
caatgtgactcagggaggaggggacacagtaggagagtcctcctggctgttctccctccttggtccccgggtcccagcaccatagttgcagccccatggttgcaggtgtgacccccaagcgtaataccagaggacctaatcaatgggctagtcatgtttacccatatgacctcagtcctctgcctaataattgggtaattactctctgacctcctagacctgtgtgacctgtgtggcttcttgataaatggatctccggagagataatgtaacacttgcatttaagcaaggccccttaatrgagggagtgtactggaatgagctttatactctgctattatggactggactagaggatttattcttaggtggtggttccggttaacttccagacataaaatcccctttctatttagatgccattctagttgtaggcagaatgggtgtcttcagagaacgtaagggtcaaatggtggccttcctgctaacagagagagtactgagactaaaatttggttttggaggacatgttcctccttgctgctgaaagcagagttctcccacttgcagagggggcataaggtttggtctctattagagg

SEQ ID NO: 165344 - DNA, 601 bp, Human
tacccatatgacctcagtcctctgcctaataattgggtaattactctctgacctcctagacctgtgtgacctgtgtggcttcttgataaatggatctccggagagataatgtaacacttgcatttaagcaaggccccttaatagagggagtgtactggaatgagctttatactctgctattatggactggactagaggatttattcttaggtggtggttccggttaacttccagacataaaatcccctttctatttagatgccattctagttgtaggcagaatgggtgtcttcagagaacktaagggtcaaatggtggccttcctgctaacagagagagtactgagactaaaatttggttttggaggacatgttcctccttgctgctgaaagcagagttctcccacttgcagagggggcataaggtttggtctctattagagggatgtaaaagggaggagaactgaaaagccagagacttttagcaaagggcagacaagattcctcatggagaggattcccattttactaggtggtgctagtggaataccaggcagtaactttgcctccatatgctctttaaacaaaggatggagagagaa

SEQ ID NO: 165345 - DNA, 601 bp, Human
tgagactaaaatttggttttggaggacatgttcctccttgctgctgaaagcagagttctcccacttgcagagggggcataaggtttggtctctattagagggatgtaaaagggaggagaactgaaaagccagagacttttagcaaagggcagacaagattcctcatggagaggattcccattttactaggtggtgctagtggaataccaggcagtaactttgcctccatatgctctttaaacaaaggatggagagagaagtctgacctgtggcatgctgtccccacagcatacctcctaamaggagaaagttagtttgcctcatagaggggctatccggtccgactggacagtgctggttcctcacatgggaaaagaaacagcctaagtggacagaggggcatttactggggggaaaataacctcccacccaaccccaggaagtattatcattaggagttaaatagtctttgagatctggatcatggaattcccctgtctgtaaaaagtcagaaaaacagcaatcccttaacctgcattcctggttactacggtggttgctaaacctgcctaattgaattatttcctgggctataaaaatt

SEQ ID NO: 165346 - DNA, 601 bp, Human
cctcctaacaggagaaagttagtttgcctcatagaggggctatccggtccgactggacagtgctggttcctcacatgggaaaagaaacagcctaagtggacagaggggcatttactggggggaaaataacctcccacccaaccccaggaagtattatcattaggagttaaatagtctttgagatctggatcatggaattcccctgtctgtaaaaagtcagaaaaacagcaatcccttaacctgcattcctggttactacggtggttgctaaacctgcctaattgaattatttcctgggctrtaaaaattcctgcagcattgcatacagagaggagatgggagacatggtgactgcagaaaggaaaggaggaaaataagatttgcaataggaaaacttggagatcctatggctgacacccagtcaggcaatcagaggctggggtcagtccaggagccttttgaataacaccagggtgtggccctggccagaaattctcagttgctccaggacctattccagccccatacaacaaccaggctttctgtgaaaagaaactagtttggacacagccaacattcccggcaccctgagggcaggtcc

SEQ ID NO: 165347 - DNA, 601 bp, Human
cccacccaaccccaggaagtattatcattaggagttaaatagtctttgagatctggatcatggaattcccctgtctgtaaaaagtcagaaaaacagcaatcccttaacctgcattcctggttactacggtggttgctaaacctgcctaattgaattatttcctgggctataaaaattcctgcagcattgcatacagagaggagatgggagacatggtgactgcagaaaggaaaggaggaaaataagatttgcaataggaaaacttggagatcctatggctgacacccagtcaggcaatcakaggctggggtcagtccaggagccttttgaataacaccagggtgtggccctggccagaaattctcagttgctccaggacctattccagccccatacaacaaccaggctttctgtgaaaagaaactagtttggacacagccaacattcccggcaccctgagggcaggtcctccccagcaagcctcacatctgagtcttcaagactggtggccagcccttgtggctccttaatcagctgtcagatgcccggtgtttttgatagttatttgagagaataaaaacggaggacaagaagcctcgga

SEQ ID NO: 165348 - DNA, 601 bp, Human
aaccaggctttctgtgaaaagaaactagtttggacacagccaacattcccggcaccctgagggcaggtcctccccagcaagcctcacatctgagtcttcaagactggtggccagcccttgtggctccttaatcagctgtcagatgcccggtgtttttgatagttatttgagagaataaaaacggaggacaagaagcctcggaagtgaaagtagagtccgctcctttactcaccattctgatgaagtcaccttcaaatcccagacgagccctcaaaatgaagcagccttgttgtctggggtraatactgaggttcttggtcacacgaccagatattgaggtcaaggacatgcacacacacatcgagtgagtttggagcaggagtttaataggcaaaagaacagaacagctcacagtcacagagaggggtcccgagcaggttgctaagcagtagtaaaaatgtcagggtttttataaatggtctagggaggaggggcctcatgaggaggggatgtcttatcctcttagggcctgatggtttagctgcgaccaagtgtgctatctatatagagcagaattttttttatcagcttttatcccatt

SEQ ID NO: 165349 - DNA, 601 bp, Human
tttagaatctccttgagatttgggtaaaaacacttgaccatgagaccatctttctatccaaaaagaattcattttactcagcctcaatgttgctaacagtaacaacaaccgtagcaataatagaaaatgtttattaagctctactatgtgtcagacatagagatagatgctttccatgggttatctgttttaatcctgacagaagcttgtcttactgttgagaaggtaaagtatagtgagtgaggctggctgacttgcccacggtctcagaactattaagtggtatattcaggattctagrtaattcctagaacactttcctttcatctttgcatgatcagctgcctcaagtctgattccagagctggagttcaagccactgttctatgctgctgcccatctctgaagagaacattgtcctgaatctatgtatcttcttcttttccctttttcataaaaagagaaaggcataggacccaccttttttttcagtttatcctaattctttggttacaaggacaccataattcaaaatgtagcccatgttacattcagaattatcagcataaagggtgaggagacatttggcacaaccaacccc

SEQ ID NO: 165350 - DNA, 601 bp, Human
tcttactgttgagaaggtaaagtatagtgagtgaggctggctgacttgcccacggtctcagaactattaagtggtatattcaggattctagataattcctagaacactttcctttcatctttgcatgatcagctgcctcaagtctgattccagagctggagttcaagccactgttctatgctgctgcccatctctgaagagaacattgtcctgaatctatgtatcttcttcttttccctttttcataaaaagagaaaggcataggacccaccttttttttcagtttatcctaattctttgtttacaaggacaccataattcaaaatgtagcccatgttacattcagaattatcagcataaagggtgaggagacatttggcacaaccaaccccttttcagtgcctgttatgtgtgggccaatgcaaggcagactgttggagaagacaaggattataatccctagttcttgtgttcaaatagtctatgaatactagcacagctaaggcatgcacaaaaataactatgattaattcataatataacagtgacaggaggggcacaaataagatcccactggggttcaaagagaagagatcacatt

SEQ ID NO: 165351 - DNA, 601 bp, Human
catttggcacaaccaaccccttttcagtgcctgttatgtgtgggccaatgcaaggcagactgttggagaagacaaggattataatccctagttcttgtgttcaaatagtctatgaatactagcacagctaaggcatgcacaaaaataactatgattaattcataatataacagtgacaggaggggcacaaataagatcccactggggttcaaagagaagagatcacatttcacttgggggcatcgggcaaagcttcttggaggatgtagatgttaaaatggaccttgggagatgattgagyttctgtaaacagaattaagggacaaggtgtttcaggtgaatggaatggcatgtgcggaggtctaggggagtcatggtaaatccacagaaaagtgtcttgcagcagtgaagtggcctcgtctggggtgacacccatggtttgttgtctcacggccacagatatcaaggacgtagacacacaaagagtgaggttaagagtggaagtttaatagggaaaagaaagagactagctctctgctacagagagggattccagaaaaatgggttaccaattcacggtgaaatgcagaggggtttatag

SEQ ID NO: 165352 - DNA, 601 bp, Human
ttggctcactgcaacctccacctcccgggttcaagtgattctcatgcctcagcctcctgagtagctggaattacaggcccccaccaccatacctggctaacttttatattttaatagagacaaggttttaccatgttggccaggctggtcttgaactcctgacctcaagtgatccacccaccccagcctcccaaagtgctaggattacaggcatgagctaccacacccgacctgccctcactatctgcttaaacaatttctttctatctcctgtatcagcaggaggtacttgcaaagcagragtaggctggttgggagctttctgagaaagcaggtaccagaaggaggttttaggggtgctactgagaaagcgcccataagaatcacagacatgcgggaatgacccacaggcactggctgggaaacaacatatgacagaatcatgatgctaaatggagggggttaagaggacatataaaccaatagactggtaatgaagggggtcaggagcctggagtgcagcacagttgggtaaagcacaatatttcaagagctgagtccatgaatttggctgcctagtgtccttttatgtggctattta

SEQ ID NO: 165353 - DNA, 601 bp, Human
acaggcccccaccaccatacctggctaacttttatattttaatagagacaaggttttaccatgttggccaggctggtcttgaactcctgacctcaagtgatccacccaccccagcctcccaaagtgctaggattacaggcatgagctaccacacccgacctgccctcactatctgcttaaacaatttctttctatctcctgtatcagcaggaggtacttgcaaagcaggagtaggctggttgggagctttctgagaaagcaggtaccagaaggaggttttaggggtgctactgagaaagcrcccataagaatcacagacatgcgggaatgacccacaggcactggctgggaaacaacatatgacagaatcatgatgctaaatggagggggttaagaggacatataaaccaatagactggtaatgaagggggtcaggagcctggagtgcagcacagttgggtaaagcacaatatttcaagagctgagtccatgaatttggctgcctagtgtccttttatgtggctatttacaatagtgaatgggatactgtagagagtctcaaatgtcaggctgcagtgcctaaagtaaatccagcagatga

SEQ ID NO: 165354 - DNA, 601 bp, Human
acaggcactggctgggaaacaacatatgacagaatcatgatgctaaatggagggggttaagaggacatataaaccaatagactggtaatgaagggggtcaggagcctggagtgcagcacagttgggtaaagcacaatatttcaagagctgagtccatgaatttggctgcctagtgtccttttatgtggctatttacaatagtgaatgggatactgtagagagtctcaaatgtcaggctgcagtgcctaaagtaaatccagcagatgatggggagccattgtgtatttctgagcaggggagrgacattgtgagagtttttctttttacaaaaatgaatctggcaagactctgggaagaccaaccaggagttaagaatactagttagcagacatctgcacttgtctaagaagaaaccctgaaatcttgaattggaatggttgtgataggaaataaaaagagtgaaagaatgcaaaagaggctgtaaagcaacattttgcatgaccgtggacttgaatgaagaggaaaggagagggtaaaaaaatcaaagctattgggctgggtgcagtggctcacgcctgtaatcccagcactttgggaggcc

SEQ ID NO: 165355 - DNA, 601 bp, Human
ttctttttacaaaaatgaatctggcaagactctgggaagaccaaccaggagttaagaatactagttagcagacatctgcacttgtctaagaagaaaccctgaaatcttgaattggaatggttgtgataggaaataaaaagagtgaaagaatgcaaaagaggctgtaaagcaacattttgcatgaccgtggacttgaatgaagaggaaaggagagggtaaaaaaatcaaagctattgggctgggtgcagtggctcacgcctgtaatcccagcactttgggaggcctaggtgggcagagcacraggtcaaaagatcgagaccattctggccaacaaggtgaaaccccgtctctactaaaaacacaaaaattagctgggcgtggtggcgtgcacctgtagtcccagctactggggaggctgaggcaggagaatcgcttgaacccgggaggcagaggttgcagtgagccgagatggcaccactgcactacagactggccacagagcaagactctgtctcaaaaaaaaaaaaaaaaattgaatctattttgaggatttcagcttggcttgactggggggaagagtgatccctttcacagaaacagg

SEQ ID NO: 165356 - DNA, 601 bp, Human
aaatacaaaaaaaaattagccaggcatggtggcaggcacctgtaatcccagctactagggaggctgaggcaggagaattgcttgaacctgggagggagagggagtgagctggactgcactccagcccgggtgacagagcgaaactccatctcaaaaaaagaaaaaaaaaaaaggaacagaaagtaggtccccaaggtatgtaaacttaaagttctatagcttcctctccacacctcacatctttttgcatctctaaccttgccaaggataactaaagtttggctgtattttttcatttctscctgaaatattttcaatagaatcatttctgaaacccattccaaccccccatacagcacaaacaacgaggaaacagaagattcaccaaacatttatgaacagccagctgttataaagacaagggaccaatctgaaaaatcagaataaagtctccttgttaaagctgctgcaagaaacaggcaagcaaaacttagaacatttttaatttgtaatttttgcttaaagttttggtaagatgttgtatcatggtaatttgtcagcagttctaaaagggaaccatttgtgttcaggaaagatagct

SEQ ID NO: 165357 - DNA, 601 bp, Human
aatcagaataaagtctccttgttaaagctgctgcaagaaacaggcaagcaaaacttagaacatttttaatttgtaatttttgcttaaagttttggtaagatgttgtatcatggtaatttgtcagcagttctaaaagggaaccatttgtgttcaggaaagatagcttagaagtgcaaaacatagttccagattttaaaacacagtgaatgcagtaacagccaatttaaactctgcaaaatgccaaattggtgaattaacagacaagtttgaattgtttcaaaactcagaggagatgataaaragataaaaacaaaaaaaaaggcaagaatatggaagagagagagaggagattcaaaagacatgaaaagaattctagaggagatggctgggcgtggtgtctcacacgtgtaaccccagcactttgggaggccgaggagggcagatcatttgaggtcaggagctcaagaccagcctggtcaacatagtgaaaccctgtctctactaaaaacacaaaaattcgctgggggtggtggcacagccctgtaatcccagctactcaggaggctgaggcaggagaatcgcttgaacccaggaggcggag

SEQ ID NO: 165358 - DNA, 601 bp, Human
cgaacctagcatctgtttcccaaaaagtagacaaaccctctgaataagggcctcttttcttagaaagccctctgcatgtgtttgggtaactccaatgtccacagaggaacctgctttctcattcctctctcaaatcacacttacctgctgtctcccttcttcccccaggcaccgatgaagacgccattattagcgtccttgcctaccgcaacaccgcccagcgccaggagatcaggacagcctacaagagcaccatcggcagggtaggccacagtctttcctgctctgtctggctgacttsgcagcaacaggaagcagggcctcttcctgatctaggttcccgaagtgaccttgtgttttaaaagatcgatcctttgtcttgtttaaagatgttcttgaggccaggtgtggtgggtcacacctgtaatcccagcactttgggagaccgaggtgggtggatcacttgaggccaggagtttgagaccaacctggccaacatggtgaaaccccatctctccttaaaaaatacaaaaattagccgggcatggtgctgagcacctgtaatcctagctactttgtaggttgaggcaggagaattgct

SEQ ID NO: 165359 - DNA, 601 bp, Human
ctgctgtctcccttcttcccccaggcaccgatgaagacgccattattagcgtccttgcctaccgcaacaccgcccagcgccaggagatcaggacagcctacaagagcaccatcggcagggtaggccacagtctttcctgctctgtctggctgacttcgcagcaacaggaagcagggcctcttcctgatctaggttcccgaagtgaccttgtgttttaaaagatcgatcctttgtcttgtttaaagatgttcttgaggccaggtgtggtgggtcacacctgtaatcccagcactttgggagrccgaggtgggtggatcacttgaggccaggagtttgagaccaacctggccaacatggtgaaaccccatctctccttaaaaaatacaaaaattagccgggcatggtgctgagcacctgtaatcctagctactttgtaggttgaggcaggagaattgcttgaaccaggaggtggaggttgcagtgagccaagatcatgccacttcactccagcctgggcaacagagacagactccatctcaaaaaaaaaaaaaaaaaaaaaaaaaagaatagcgattcagctccttcttcgtcaattgatctt

SEQ ID NO: 165360 - DNA, 601 bp, Human
taaaaaatacaaaaattagccgggcatggtgctgagcacctgtaatcctagctactttgtaggttgaggcaggagaattgcttgaaccaggaggtggaggttgcagtgagccaagatcatgccacttcactccagcctgggcaacagagacagactccatctcaaaaaaaaaaaaaaaaaaaaaaaaaagaatagcgattcagctccttcttcgtcaattgatcttaaacaagttcttaaactctctgacccattccaggaggaaatgtgaataaacatctttagaatttggtccattttycaaataattatatttggaaactatatctcaggaattgagccttaagaaatagtcatgaatgatcacaaagatacaactaaatgccttatgtatataacagtagaaaaatagaaacaggtgactagttaaagaaattaggctgggtgtggtggctcacacctgtaatcctagcactttgggaggccgaggcgagtggatcacttgaggtcaggagttcgagaccagcctgaccaacatggtgaaaccccgtctctactaaaaatacaaaaaaattagctgggcatggtggtgggcacctgt

SEQ ID NO: 165361 - DNA, 601 bp, Human
ttatgtatataacagtagaaaaatagaaacaggtgactagttaaagaaattaggctgggtgtggtggctcacacctgtaatcctagcactttgggaggccgaggcgagtggatcacttgaggtcaggagttcgagaccagcctgaccaacatggtgaaaccccgtctctactaaaaatacaaaaaaattagctgggcatggtggtgggcacctgtaatcccagctacttgggagactgaggcaggagaatcgcttgaatccaggaggcggagtctgcagtgagtcaagatcgtgccactgygctccagcctaggcaacagagcaagactccatctaaaaaaaaaaaaaaaagaaattatgttgcacctatctatagaaatctccacagctgctaaaaaggttatcagtgaatattgacttggaagtatattcaagacatattgttaagtaggcaaatacatttacatcggtgtctacaaacatattcacctcaaagttcctttacctcttaaattttttaggacttttggttttgtgggttatatcttttgatatttgccctattagaaactaaaactgagggcatttaaaaatagatatt

SEQ ID NO: 165362 - DNA, 601 bp, Human
taggctgggtgtggtggctcacacctgtaatcctagcactttgggaggccgaggcgagtggatcacttgaggtcaggagttcgagaccagcctgaccaacatggtgaaaccccgtctctactaaaaatacaaaaaaattagctgggcatggtggtgggcacctgtaatcccagctacttgggagactgaggcaggagaatcgcttgaatccaggaggcggagtctgcagtgagtcaagatcgtgccactgcgctccagcctaggcaacagagcaagactccatctaaaaaaaaaaaaaaaagaaattatgttgcacctatctatagaaatctccacagctgctaaaaaggttatcagtgaatattgacttggaagtatattcaagacatattgttaagtaggcaaatacatttacatcggtgtctacaaacatattcacctcaaagttcctttacctcttaaattttttaggacttttggttttgtgggttatatcttttgatatttgccctattagaaactaaaactgagggcatttaaaaatagatatttgttaacttagtaaaaataataagtatattgtatgttactgtaaataaca

SEQ ID NO: 165363 - DNA, 601 bp, Human
ctctactaaaaatacaaaaaaattagctgggcatggtggtgggcacctgtaatcccagctacttgggagactgaggcaggagaatcgcttgaatccaggaggcggagtctgcagtgagtcaagatcgtgccactgcgctccagcctaggcaacagagcaagactccatctaaaaaaaaaaaaaaaagaaattatgttgcacctatctatagaaatctccacagctgctaaaaaggttatcagtgaatattgacttggaagtatattcaagacatattgttaagtaggcaaatacatttacrtcggtgtctacaaacatattcacctcaaagttcctttacctcttaaattttttaggacttttggttttgtgggttatatcttttgatatttgccctattagaaactaaaactgagggcatttaaaaatagatatttgttaacttagtaaaaataataagtatattgtatgttactgtaaataacattttaatgaaaaatagctatatatcccaaaacgaaaaaacatttagtgagaagattggcattgttttacattttgcagatctctttaatgtctggcttaatggaagacagatggc

SEQ ID NO: 165364 - DNA, 601 bp, Human
cccttgaaagggtcttggagaccccagacatccctggaccacacctggagagtagctggtctaatttgctatagcagttaagcggagctactttcttgcattgcaggacttgatagacgacctgaagtcagaactgagtggcaacttcgagcaggtgattgtggggatgatgacgcccacggtgctgtatgacgtgcaagagctgcgaagggccatgaaggtctgtgctcttcctctcgtgctcttggtgctgttggtgcaaacgctgatgtgctttcttaagaaactgtcacccaataasaaagacatggaagcaacctaaacgcccatcaatggtagactggataaagaaaatgtggtacatgtacaccatggaatagctgtaaaaaggaacaagatcatgtcctctggaggaacatggatggagctggaggtcattgtccttagcaaactaaggcaggaacagaaaatcaaataccatatgttttcacttacaagtgggagctaaatgatgaaaacacatggacacatagaggggaacaacacacactggggcctgttggaggatggagggtgggaggagggagaggatcaggaaaaa

SEQ ID NO: 165365 - DNA, 601 bp, Human
caaggccttctgagagtagcaggtgtaaagtataggagattttccttcatttacgacaacttgaaaacatcattactttacattataccaattataatttaaaagttcttttccaaaaagttagggaatcatttgctccttcctgtggctcaatggggagtgattataattgtcgcttttagtacagctctagagacttttagctatctctagacagctaactacttttgagatatgtaactttatgactgacactttaggggcctccaggtctactataggcttacttctggcaaaagasttcctggcttccctagatgacgtacccactgtgccctagcctggtctgccaaattttaatgaccaagtatgtaatgcaaatataaatggtccccaccttaggatggttctacttaaaaattttcagtgtattgtactcctcatcataagtcgaggagtacaattatcctcctcaaccatgtcaataaatactcagacttgtggaaggttctgggccaggctctgggaaagcaaagaggtgacaaagtctttgccagaaaattctgcccttcagaggaagagagcagaagaggtcaaggaa

SEQ ID NO: 165366 - DNA, 601 bp, Human
ctgttcctttatcttatttctccttcagagactctggctaatcctgcctgcccattttttctactttaatttgatatttacaagtacctaacacctgccaggtccccctgtcactcagtgcattgagagttatgaagatgattcagaggcagttcctgggccttaagagtatatattgtcataagggaatacatcaggtacacagttgctagaaggcatgaaaagattacatgccaaaggagaggcgcataggaaaaagaagattcaaggagaaaatttggttgtagaaacaaagaaaagscttcatgacagagatgctggttcagagaggacttggaggattactagaatttcaagaggcagagacgtgggtgggtgtattgcagacaggaagaacagcaagaataaggcagggaacatggggttcagggaacaactgggtgaacagttgggctggtgattctggaaacagggtgggaggataaactggaattctatgttgggagcagtttacacttatttatttgggagcagtagatgacgtgatgatgacaacgatgatgggagtgatgtgactggagctgcactttcagaagagtaa

SEQ ID NO: 165367 - DNA, 601 bp, Human
ttccactttgctcttgtctccaatatttacttagtaacgcctgcctgtgtctcatatttctttcccactttctcttttcctcccatatttaccactctgatgagccatgcctagaccatggaacatcgagacagtataacaataaaaatagcctaaaaactagaggaaagtagcccattttatcatttgttagcattcttcagaggcttccaccctgccttcttgtgagctggtgttggtgaggggtagggggacatttttatgggatcctcaagtcccaccataggtctcatattctctygactctcctctgttcccaacctccccaccttttttttttttttttttaagattcaaggtcttgctatgtttcccaggccagctcttcacaggtgccatcttagctcactgccttgaactcctggcctcaagacatcctcccacctcagcctcgagtagctggaactacatgcacatcccgacccccttttggcagaggttgatcaatgtagatttgccagttaggaaggcatgagtcagctgggaagacacaggagagtggggtggtgggggaggccaggagatagtggagggagctgtc

SEQ ID NO: 165368 - DNA, 601 bp, Human
cctgcctgtgtctcatatttctttcccactttctcttttcctcccatatttaccactctgatgagccatgcctagaccatggaacatcgagacagtataacaataaaaatagcctaaaaactagaggaaagtagcccattttatcatttgttagcattcttcagaggcttccaccctgccttcttgtgagctggtgttggtgaggggtagggggacatttttatgggatcctcaagtcccaccataggtctcatattctctcgactctcctctgttcccaacctccccacctttttttttkttttttttaagattcaaggtcttgctatgtttcccaggccagctcttcacaggtgccatcttagctcactgccttgaactcctggcctcaagacatcctcccacctcagcctcgagtagctggaactacatgcacatcccgacccccttttggcagaggttgatcaatgtagatttgccagttaggaaggcatgagtcagctgggaagacacaggagagtggggtggtgggggaggccaggagatagtggagggagctgtccttgggaagcttctcctgctattggcagaggcactcatg

SEQ ID NO: 165369 - DNA, 601 bp, Human
gagtagctggaactacatgcacatcccgacccccttttggcagaggttgatcaatgtagatttgccagttaggaaggcatgagtcagctgggaagacacaggagagtggggtggtgggggaggccaggagatagtggagggagctgtccttgggaagcttctcctgctattggcagaggcactcatgcaacgttaggggccacactgaggctcagccctctaggcacacatcagagccattgtaataatgcgagcgcatttagaggacgtctgtcctccctccctgggtctgaagctccamttcttgtggtattttgtctcattactctagacctgctatcttaatggtgtccccagatcttcatgtatactctcgaattattttttatttgtttttctcatcctcagggtgggagggatgaaggaaattatctggacgatgctctcgtgagacaggatgcccaggttggtagaactgcagcttctttcttccagctttcttctctttcgccaatgagacaggccttagtgggtggatagcaacttatattacagtgtatattagccaggcttggatatgttctttaaaaatattcccaca

SEQ ID NO: 165370 - DNA, 601 bp, Human
tagaactgcagcttctttcttccagctttcttctctttcgccaatgagacaggccttagtgggtggatagcaacttatattacagtgtatattagccaggcttggatatgttctttaaaaatattcccacagatagcctttaataacaggtttcttgcagaggtacctggggctggacatcattatataagcactcctgggttccaagtttctcaacattaggaccattgtgtggcaatcccagagaaccactgtcttccgaatcccgtggaggtgaaagggactgttcactgtgcacttytacttcatcaaagaggacatttgataggacctatataaaatagcttgacacagtgtataccctgctgggtaaaattaatagcaaaccccaagaggcatttgcctctctgtttcccagcccagtgatggttgtcctggaaccaacccatggtctaatcagctgtggccagataacactaacgataatagctaataaaaagtgggtcattaccaggtaccaaacactgttctaaaattttttttttttttttgagatggagtttcactcttgttgcccaggctggagtgcaatggcatgatc

SEQ ID NO: 165371 - DNA, 601 bp, Human
ccaggctggtcttaaactcctgacctctggtgatccgcctgccttggcctcccaaagtgctgggattacaggcatgagccatcgcgcgtggcccactgttctaaattctatattaagtatgtcattgaatctttgcaataacttcataaggtaagtattgctatccccattttacaaacaaggaaactgaggctcagagaggtcaagtaccttgctcaagctcagaaagataataaagggcagagctaggatttgaaccaattggcatctagacccagtattctctctctctctctctctytttttttttttttttttttgagacagggtctcactgtcgtccagactggagtgtggtggtgtgatctcagctcaccgcaacctccccctcccaggttcaagcaattctcccacctcagcctcctgagtatctgggattacaggatgcaccaccaccacccggctagtttttgtatttttaatagagatagggtttcaacatgttggccaggctggtcttgaactcctgacctcaaatgatccacctgccatggcctcccaaagtgccgggattacaggcatgagccaccgcgcctgacca

SEQ ID NO: 165372 - DNA, 601 bp, Human
aagtatgtcattgaatctttgcaataacttcataaggtaagtattgctatccccattttacaaacaaggaaactgaggctcagagaggtcaagtaccttgctcaagctcagaaagataataaagggcagagctaggatttgaaccaattggcatctagacccagtattctctctctctctctctctctttttttttttttttttttgagacagggtctcactgtcgtccagactggagtgtggtggtgtgatctcagctcaccgcaacctccccctcccaggttcaagcaattctcccacytcagcctcctgagtatctgggattacaggatgcaccaccaccacccggctagtttttgtatttttaatagagatagggtttcaacatgttggccaggctggtcttgaactcctgacctcaaatgatccacctgccatggcctcccaaagtgccgggattacaggcatgagccaccgcgcctgaccatagacccagtattcttaaccaatacataaccataatgagggattggttccattcagtttgtgaggtatgaacaactttgttttatgcaaaaaaaaagaacctgttgctttcatt

SEQ ID NO: 165373 - DNA, 601 bp, Human
tcataaggtaagtattgctatccccattttacaaacaaggaaactgaggctcagagaggtcaagtaccttgctcaagctcagaaagataataaagggcagagctaggatttgaaccaattggcatctagacccagtattctctctctctctctctctctttttttttttttttttttgagacagggtctcactgtcgtccagactggagtgtggtggtgtgatctcagctcaccgcaacctccccctcccaggttcaagcaattctcccacctcagcctcctgagtatctgggattacagratgcaccaccaccacccggctagtttttgtatttttaatagagatagggtttcaacatgttggccaggctggtcttgaactcctgacctcaaatgatccacctgccatggcctcccaaagtgccgggattacaggcatgagccaccgcgcctgaccatagacccagtattcttaaccaatacataaccataatgagggattggttccattcagtttgtgaggtatgaacaactttgttttatgcaaaaaaaaagaacctgttgctttcattagaggggatagaggtatgtgtgtggcttg

SEQ ID NO: 165374 - DNA, 601 bp, Human
ctagcctcagagatcagtgtcacttccactaacctgtattttattctttttttttttttttttttttgagatagggtcttgctctgtctcccaggctgttgtgcagtggcatgatctcggcccactgcaaccttcacctcccaggctcaagtgatcctcccacctcagcctcctgagtagctggactacaggcgtgtgccatcatgcctggctaagttttaaatatttttttggtagaggtggggttttgccatattgcccaggctggtctcaaactcctgggctcaagcaacctatctgycttggccttccaaagtgctatgattacaggcatgagccaccgtgcccagcccacaactatgctttattaattaaagcaatgtattagtcagaattcttaagaggaacagaaccaatagagagagagagcgagagagacacagaggggtgtgtgtgtgtgtgtgtgtgtgtgtgtgtgtgtgtgtgtgtgtgtgtaagaaagagagaggatggagttgggcaagtaccaggatcttcagagggaatcagcaagctggagatgcaggccagcctatggttttgttccagtctgagtccaaag

SEQ ID NO: 165375 - DNA, 601 bp, Human
ttttttttttttgagatagggtcttgctctgtctcccaggctgttgtgcagtggcatgatctcggcccactgcaaccttcacctcccaggctcaagtgatcctcccacctcagcctcctgagtagctggactacaggcgtgtgccatcatgcctggctaagttttaaatatttttttggtagaggtggggttttgccatattgcccaggctggtctcaaactcctgggctcaagcaacctatctgccttggccttccaaagtgctatgattacaggcatgagccaccgtgcccagcccacwactatgctttattaattaaagcaatgtattagtcagaattcttaagaggaacagaaccaatagagagagagagcgagagagacacagaggggtgtgtgtgtgtgtgtgtgtgtgtgtgtgtgtgtgtgtgtgtgtgtgtaagaaagagagaggatggagttgggcaagtaccaggatcttcagagggaatcagcaagctggagatgcaggccagcctatggttttgttccagtctgagtccaaaggcctgagaactaggagcagttcccatctgaaggccagcaggctggaaacccatga

SEQ ID NO: 165376 - DNA, 601 bp, Human
accttcacctcccaggctcaagtgatcctcccacctcagcctcctgagtagctggactacaggcgtgtgccatcatgcctggctaagttttaaatatttttttggtagaggtggggttttgccatattgcccaggctggtctcaaactcctgggctcaagcaacctatctgccttggccttccaaagtgctatgattacaggcatgagccaccgtgcccagcccacaactatgctttattaattaaagcaatgtattagtcagaattcttaagaggaacagaaccaatagagagagagagmgagagagacacagaggggtgtgtgtgtgtgtgtgtgtgtgtgtgtgtgtgtgtgtgtgtgtgtgtaagaaagagagaggatggagttgggcaagtaccaggatcttcagagggaatcagcaagctggagatgcaggccagcctatggttttgttccagtctgagtccaaaggcctgagaactaggagcagttcccatctgaaggccagcaggctggaaacccatgaagagctgatgttccagttcaagtccaaaggcaggaaaaaaactgatgtcctagctcaaggcagtcaggcaggag

SEQ ID NO: 165377 - DNA, 601 bp, Human
ggcgtgtgccatcatgcctggctaagttttaaatatttttttggtagaggtggggttttgccatattgcccaggctggtctcaaactcctgggctcaagcaacctatctgccttggccttccaaagtgctatgattacaggcatgagccaccgtgcccagcccacaactatgctttattaattaaagcaatgtattagtcagaattcttaagaggaacagaaccaatagagagagagagcgagagagacacagaggggtgtgtgtgtgtgtgtgtgtgtgtgtgtgtgtgtgtgtgtgtgwgtgtaagaaagagagaggatggagttgggcaagtaccaggatcttcagagggaatcagcaagctggagatgcaggccagcctatggttttgttccagtctgagtccaaaggcctgagaactaggagcagttcccatctgaaggccagcaggctggaaacccatgaagagctgatgttccagttcaagtccaaaggcaggaaaaaaactgatgtcctagctcaaggcagtcaggcaggaggagtccctctcactcttgggaaggtcagccctcttcttgaaaacaaaagctttcagctgat

SEQ ID NO: 165378 - DNA, 601 bp, Human
gttttgccatattgcccaggctggtctcaaactcctgggctcaagcaacctatctgccttggccttccaaagtgctatgattacaggcatgagccaccgtgcccagcccacaactatgctttattaattaaagcaatgtattagtcagaattcttaagaggaacagaaccaatagagagagagagcgagagagacacagaggggtgtgtgtgtgtgtgtgtgtgtgtgtgtgtgtgtgtgtgtgtgtgtgtaagaaagagagaggatggagttgggcaagtaccaggatcttcagagggartcagcaagctggagatgcaggccagcctatggttttgttccagtctgagtccaaaggcctgagaactaggagcagttcccatctgaaggccagcaggctggaaacccatgaagagctgatgttccagttcaagtccaaaggcaggaaaaaaactgatgtcctagctcaaggcagtcaggcaggaggagtccctctcactcttgggaaggtcagccctcttcttgaaaacaaaagctttcagctgattgtatgagggcccctcctccatattggatcatccaaaaaccctcacagaaacac

SEQ ID NO: 165379 - DNA, 601 bp, Human
ttcccggaaccgaaatcacctgttgcatggtaaggcacttacttcatttcccaaagaaaaggagtgaaagatagcaaaaactatattgcccataagtagttgataaccttcctccttcagttggtacaaagaactgattgtacccaagtgtcttagattctcaccctggaaatgtattagtccaatgatgtatatgaaagctaatttctgaaagattaattatgaataattagaaaaagtgcatgtagtcatagaagtttggcattcttgtttctaggaaactgaccttcacagtcagtcmtttttctaaagtagccccagtattttcattctaatgtagttacatatgaaagtaatctgtagtagatcaggtagcaataaaatagcaatgttggttgatatttattcctgtgtaatatccaagctgtaaagctaatacaagtgatttctttaggggttatgttgtataagatgaatagtggataatttcaaatttgatatgtttctaatttgtttctgataaatataaactttgtaatgtgattttaacttatttgggggaaagatactagacaattttagaatatttgctgtcaggttc

SEQ ID NO: 165380 - DNA, 601 bp, Human
tagtccaatgatgtatatgaaagctaatttctgaaagattaattatgaataattagaaaaagtgcatgtagtcatagaagtttggcattcttgtttctaggaaactgaccttcacagtcagtcctttttctaaagtagccccagtattttcattctaatgtagttacatatgaaagtaatctgtagtagatcaggtagcaataaaatagcaatgttggttgatatttattcctgtgtaatatccaagctgtaaagctaatacaagtgatttctttaggggttatgttgtataagatgaatwgtggataatttcaaatttgatatgtttctaatttgtttctgataaatataaactttgtaatgtgattttaacttatttgggggaaagatactagacaattttagaatatttgctgtcaggttcatattcttttaaacaagcaagtaaggatataataagatatttcatcttttatacgagttctttagatctttaagtacattataattttataaacccacccaccatacccttttaatcacacacactgatttgcaaagcttgtgggaaatttgagaatgagtttgctaaattgaaaac

SEQ ID NO: 165381 - DNA, 601 bp, Human
aaagatactagacaattttagaatatttgctgtcaggttcatattcttttaaacaagcaagtaaggatataataagatatttcatcttttatacgagttctttagatctttaagtacattataattttataaacccacccaccatacccttttaatcacacacactgatttgcaaagcttgtgggaaatttgagaatgagtttgctaaattgaaaacataaagcaattgagaagtacaacacattctgaagttgtaattatttcaggtttttcacagtgacaaaaaaacaggtgattactsctgttaatcaatatcccgggctaccatcaggtacacaaacttctgactcagcttctttcttcacttccttcccttgcctggttacaaataacaggaatctccccctggtggtgttttccaagaactgcaggtcctcagaagccgatttagtgcataaatgcatttgcaagaattttcacttctgggtacaagtcaatagttaggcagttatgaaatatctgtttgtaagccactgggagaaaatattttaagcactgtttggactaggaaaacttcataattgtcttaccaaccaacaat

SEQ ID NO: 165382 - DNA, 601 bp, Human
agaacagaaatcaaggcagttctgggggtctcagtagaagggaataatggattttatttctaaagcagagtttctgaagttcgttttctattaaaaatgctaaatattgaccccctacttcagactggctgaattagaatctctgagtgtgacacccaggaagtttaataggtttctctgagggtaaagatgatgcagtgcttttggccatccccgtgagctgctcaattaaaaagttcccaggagagagtctaacgggtcctgactgggtcaactgctcacgtgtttgacagaggttgtrgtgtatgttgttgggtatggtgtcccttgattgacagccctgttaaaatcacattgatggaagtgaggcagcaccccaaagaaggcgatggtgagaagataaaatagatacctgctctaagaagtttccagaaggagacagcaagagaggggaacatattcaccacattcaaaaatacttggcaaaaaacaacaacaaatgtaattatgtttaagtattttaaaagatgcaaccagctgttattaactgtgactcagttctgaagcagttgaattgttctagttttgatgagccaaaagg

SEQ ID NO: 165383 - DNA, 601 bp, Human
tattgaacagagtattaaatctgaaacatctggtagctttgaagatgctctgctggctataggtaagctggtagggggagtagagaaacaaatgtttatagattttccttctcattatcagtttgcaatatggggatatagaattatttttagagataaaagttgtttatcatgaatcactcatgttacattccagatttttaaacaagaaatattatatacaacctgattgctattgtgccatgtggtttatatattttatatcttctgtgcctttgtatgtcctatgtgaaaggtaatratgtgcagatatacaggctgcagcttgcaagtctgtgaatggttagaactagtaactgtctcatatggcagatacagtaatccttattttgaaatgaaataccaccctttgctttgatagactttatcaattacttctccaggaacttgatgataaattgagggtactttctatctgtgaaaatacatagagcatcgcctatgttcatgaaacattgcttggctaaaatttccctggcaaagcaaatattgataccttgtagaaacagaggaaacaactgtcacttttcttttttcatgg

SEQ ID NO: 165384 - DNA, 601 bp, Human
ttccagatttttaaacaagaaatattatatacaacctgattgctattgtgccatgtggtttatatattttatatcttctgtgcctttgtatgtcctatgtgaaaggtaataatgtgcagatatacaggctgcagcttgcaagtctgtgaatggttagaactagtaactgtctcatatggcagatacagtaatccttattttgaaatgaaataccaccctttgctttgatagactttatcaattacttctccaggaacttgatgataaattgagggtactttctatctgtgaaaatacatasagcatcgcctatgttcatgaaacattgcttggctaaaatttccctggcaaagcaaatattgataccttgtagaaacagaggaaacaactgtcacttttcttttttcatgggtcttatctgtaatcttttcatttcttctttttttttctttgacagtaaagtgcatgaggaacaaatctgcatattttgctgaaaagctctataaatcgatgaaggtaaatggccttattttcagcatctaaatgaatttgagttatcttgtgtccaccttcttaagcttacttatatcccctatccaaa

SEQ ID NO: 165385 - DNA, 601 bp, Human
tttttaaacaagaaatattatatacaacctgattgctattgtgccatgtggtttatatattttatatcttctgtgcctttgtatgtcctatgtgaaaggtaataatgtgcagatatacaggctgcagcttgcaagtctgtgaatggttagaactagtaactgtctcatatggcagatacagtaatccttattttgaaatgaaataccaccctttgctttgatagactttatcaattacttctccaggaacttgatgataaattgagggtactttctatctgtgaaaatacatagagcatcrcctatgttcatgaaacattgcttggctaaaatttccctggcaaagcaaatattgataccttgtagaaacagaggaaacaactgtcacttttcttttttcatgggtcttatctgtaatcttttcatttcttctttttttttctttgacagtaaagtgcatgaggaacaaatctgcatattttgctgaaaagctctataaatcgatgaaggtaaatggccttattttcagcatctaaatgaatttgagttatcttgtgtccaccttcttaagcttacttatatcccctatccaaactttgct

SEQ ID NO: 165386 - DNA, 601 bp, Human
ttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttccaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaagaacgtggaaaaataattttaatttaaaaatggtgtttttaggccgggggcgggggctcacgccagtaatcccaacactttgggaggccaaggcgggtggatcacctaaggtc

SEQ ID NO: 165387 - DNA, 601 bp, Human; identical to SEQ ID NO: 20170

SEQ ID NO: 165388 - DNA, 601 bp, Human; identical to SEQ ID NO: 20171

SEQ ID NO: 165389 - DNA, 601 bp, Human; identical to SEQ ID NO: 20172

SEQ ID NO: 165390 - DNA, 601 bp, Human; identical to SEQ ID NO: 20173

SEQ ID NO: 165391 - DNA, 601 bp, Human; identical to SEQ ID NO: 20174

SEQ ID NO: 165392 - DNA, 601 bp, Human; identical to SEQ ID NO: 20175

SEQ ID NO: 165393 - DNA, 601 bp, Human; identical to SEQ ID NO: 20176

SEQ ID NO: 165394 - DNA, 601 bp, Human; identical to SEQ ID NO: 20177

SEQ ID NO: 165395 - DNA, 601 bp, Human; identical to SEQ ID NO: 20178

SEQ ID NO: 165396 - DNA, 601 bp, Human; identical to SEQ ID NO: 20179

SEQ ID NO: 165397 - DNA, 601 bp, Human; identical to SEQ ID NO: 20180

SEQ ID NO: 165398 - DNA, 601 bp, Human; identical to SEQ ID NO: 20181

SEQ ID NO: 165399 - DNA, 601 bp, Human
tccaagacccacctctggagttgactcccacctcctacctcagttgcacagtattgtaattaaacaaaataccattaaagtgtacactttaaattgggtgatatatggtatatgaatttcatctcaatatttaaaatgtcataattttctgaattaatctatagatttaatgcaatcttaaaattcctatgggcttgtttgcagaaattgacaagtttattcttaaatttttgttgcgactgaatgaacacaaaaaagcccaaatagtcttgaaaaaagctttgaggactcatactttttkatttgaaaacttgacacaaaactacagtaattaagacttcaaaatgaggtactactgacataaggacagacagaccaatggagtagaattgagagcccacaaacaaatcctcacatttatactcaactggtttttaatgaggttgtcaagacaattcaataggaaaaaatatactttttcaataaatagttcaatgaaaacaggattcactctcacaggttacctgataaacatcaacctccaactcctttgtgcaaattcattttaggttacactaaattaaaccttctctcttccatc

SEQ ID NO: 165400 - DNA, 601 bp, Human
aggaatgattgaaagctgctttcatcctggccctgttttagctagccatcaatctggtcccatgtccaagacccacctctggagttgactcccacctcctacctcagttgcacagtattgtaattaaacaaaataccattaaagtgtacactttaaattgggtgatatatggtatatgaatttcatctcaatatttaaaatgtcataattttctgaattaatctatagatttaatgcaatcttaaaattcctatgggcttgtttgcagaaattgacaagtttattcttaaatttttgttgygactgaatgaacacaaaaaagcccaaatagtcttgaaaaaagctttgaggactcatactttttgatttgaaaacttgacacaaaactacagtaattaagacttcaaaatgaggtactactgacataaggacagacagaccaatggagtagaattgagagcccacaaacaaatcctcacatttatactcaactggtttttaatgaggttgtcaagacaattcaataggaaaaaatatactttttcaataaatagttcaatgaaaacaggattcactctcacaggttacctgataaacatca

SEQ ID NO: 165401 - DNA, 601 bp, Human
ggtcatttttatacccacttttaattgcatgcatattaagggacagtttgtgcaaggaaggggtcctatcttttggatcattgggtgccatggaaaggggaggtaactcctgggtgttgccatgggaatagtaaattgacacggcatactggtgggcaggaatgattgaaagctgctttcatcctggccctgttttagctagccatcaatctggtcccatgtccaagacccacctctggagttgactcccacctcctacctcagttgcacagtattgtaattaaacaaaataccattaaaktgtacactttaaattgggtgatatatggtatatgaatttcatctcaatatttaaaatgtcataattttctgaattaatctatagatttaatgcaatcttaaaattcctatgggcttgtttgcagaaattgacaagtttattcttaaatttttgttgcgactgaatgaacacaaaaaagcccaaatagtcttgaaaaaagctttgaggactcatactttttgatttgaaaacttgacacaaaactacagtaattaagacttcaaaatgaggtactactgacataaggacagacagaccaat

SEQ ID NO: 165402 - DNA, 601 bp, Human
gaaatccaaacataaacctaatcatctatgcccggttcattttcaacaaatgtaccaagatcatttaatctaaaggaagagtttcaaaaaaaaataaataaataaaggaagcgtttcttcaacaaacagtgctgggacaactgggtagccacatacaaaagaatgaagttgaacccctatctcactcttatgcaaaatataactgaaagtgaacgaaaaacttaaatgtgaactaaaactatacaattcttagaataaaacatcggttaaatattaatgccttcagaattggaagtggatrcatagatttgacaccaaaacaactaaaataagagagataaactgggcctcaccaaattaaaatgtttgttcatcaaaggacaaaattaaaaatgtgaaatgacaacctgtagaatgggagaaaatatttgtatttcatacgtatttagtaagggtttaatgcccagaatccataaacaattacctacagttcaacaacaaatgacaagcaacccagtatagaaataagcaaagggccaggtgtggtgcctcacaactgcaatcccagtgctttgggagggccaacatgggtggactgctt

SEQ ID NO: 165403 - DNA, 601 bp, Human
aagaaataaagaccagtggaataaaattgaaatccaaacataaacctaatcatctatgcccggttcattttcaacaaatgtaccaagatcatttaatctaaaggaagagtttcaaaaaaaaataaataaataaaggaagcgtttcttcaacaaacagtgctgggacaactgggtagccacatacaaaagaatgaagttgaacccctatctcactcttatgcaaaatataactgaaagtgaacgaaaaacttaaatgtgaactaaaactatacaattcttagaataaaacatcggttaaatmttaatgccttcagaattggaagtggatgcatagatttgacaccaaaacaactaaaataagagagataaactgggcctcaccaaattaaaatgtttgttcatcaaaggacaaaattaaaaatgtgaaatgacaacctgtagaatgggagaaaatatttgtatttcatacgtatttagtaagggtttaatgcccagaatccataaacaattacctacagttcaacaacaaatgacaagcaacccagtatagaaataagcaaagggccaggtgtggtgcctcacaactgcaatcccagtgctt

SEQ ID NO: 165404 - DNA, 601 bp, Human
aagtaatctaaagattgaatgtaatcactgtcacaattccaatgtcctttttaaaatttttatttgtgcaaaaatggaaaagccaatcctgaatttatatgcaactacagggagaggactcaatttccaaatttccagacttcaaaacaaaactatagtagtcaaaacagcatggtactggcaaaaggaaagaaataaagaccagtggaataaaattgaaatccaaacataaacctaatcatctatgcccggttcattttcaacaaatgtaccaagatcatttaatctaaaggaagagttkcaaaaaaaaataaataaataaaggaagcgtttcttcaacaaacagtgctgggacaactgggtagccacatacaaaagaatgaagttgaacccctatctcactcttatgcaaaatataactgaaagtgaacgaaaaacttaaatgtgaactaaaactatacaattcttagaataaaacatcggttaaatattaatgccttcagaattggaagtggatgcatagatttgacaccaaaacaactaaaataagagagataaactgggcctcaccaaattaaaatgtttgttcatcaaaggacaa

SEQ ID NO: 165405 - DNA, 601 bp, Human
gactgaaaactatgaaatgttgcttagaaaaataaggagtatctaaataaatggcaaaccatgtcattttaaaggattgaaatggcacacgtatacatatgtaacaaatgtgcacattgtgcacatgtaccctaaaacttaaagtataataataataataatgaaagacttaaaattgttaagatggcaatgcttccaaaagtaatctaaagattgaatgtaatcactgtcacaattccaatgtcctttttaaaatttttatttgtgcaaaaatggaaaagccaatcctgaatttatatgyaactacagggagaggactcaatttccaaatttccagacttcaaaacaaaactatagtagtcaaaacagcatggtactggcaaaaggaaagaaataaagaccagtggaataaaattgaaatccaaacataaacctaatcatctatgcccggttcattttcaacaaatgtaccaagatcatttaatctaaaggaagagtttcaaaaaaaaataaataaataaaggaagcgtttcttcaacaaacagtgctgggacaactgggtagccacatacaaaagaatgaagttgaacccctatctcac

SEQ ID NO: 165406 - DNA, 601 bp, Human
atgtatttataaaaattccaaaggtattttatatcaaattgtgaaaatctaaaagcttataccccaaaatcagggggaaaagatccaagtatatccaatttcactactgctattcagcatagcacttaaggtcctagccaaaacaattagacaagaaagagaaataaaaggcatttaggtaagaaaggaagacgtaaaactatttctattttaagataacacaattatatataaagaaaagtccatataacccacaaaaaacaactagagctgataaatgttttcagcttaattttaggaygtaagattggtccagatatcagttgtgtctgtttatatcagcaatgagcaatatgaaaataaaatcaaggaaatagttacatttgcaatagcatcaaaagggccaaaagccctgagaacctataatcaagaagataaaagactgaaaactatgaaatgttgcttagaaaaataaggagtatctaaataaatggcaaaccatgtcattttaaaggattgaaatggcacacgtatacatatgtaacaaatgtgcacattgtgcacatgtaccctaaaacttaaagtataataataataataa

SEQ ID NO: 165407 - DNA, 601 bp, Human
atacctatgtaacaaacctgcacattctgcacatgtatcccagaacctaaagtataatataaaaaatcactcaaaaatatgaatagaagggaaaattccttatcataataaaatgtatttataaaaattccaaagatgttttatatcaaattgtgaaaatctaaaagcttatgccctaaaatcagggggtaaaaaaacccaagtatatctacttttactactgctattcagcatcgttcttaaggtcccagccaaaacaattagacaagaaagagaaataatgtagcaacttgtatattayggatttttttaaaaaaaattaaggattatgtgccataactaaatgggatctatatgaggagtgcaagagtgcttcaataagaaaatcaatcaatgtaatacaccaccatattagaaagaaaggaaaaatctaacaagatagaccatctgaatagaagctgagaaagcataagacaaaattcaatacttttcctgataaaatcactcaaagatatgaatagaagggaaatttcttatgagaaaatgtatttataaaaattccaaaggtattttatatcaaattgtgaaaatctaaaagctt

SEQ ID NO: 165408 - DNA, 601 bp, Human
gcaaactaacacaggaacagaaaaccaaacactgcatgttctcactcaaaagtgggagttgaacaatgagaacacatggacacagggagggaaacatgacacaccagggcctgttggggggtggggagcaaggggagggagagcactgggacaaatacttaattcatgcggggcttaaaacctagatgacaggttgatgggtgcagcaaaccaccatggcacatgtatacctatgtaacaaacctgcacattctgcacatgtatcccagaacctaaagtataatataaaaaatcactcaaraatatgaatagaagggaaaattccttatcataataaaatgtatttataaaaattccaaagatgttttatatcaaattgtgaaaatctaaaagcttatgccctaaaatcagggggtaaaaaaacccaagtatatctacttttactactgctattcagcatcgttcttaaggtcccagccaaaacaattagacaagaaagagaaataatgtagcaacttgtatattatggatttttttaaaaaaaattaaggattatgtgccataactaaatgggatctatatgaggagtgcaagagtgctt

SEQ ID NO: 165409 - DNA, 601 bp, Human
acaccccttcatggtaaaagccctaaaaaaaacagggtatagaaggaacatacctcaccatagtaaaagctatctacaaaagaccaacagctagtaacatactaaatagggaaaaactaaaagcctttcctctaaggtctggaaaacaacaaggatgcttactttcaccactgttattcaacattgtactggaatacctagctagagcaatcagagaaagatacaaaggggatcccaattagaatggaagaagtcaaattatactcatttgcagagaatataatcttatatttaaaaaaacataaagactccactaaaaaactatgagaaataataaacaaattccgtaaagttgcaagatacaaaataatatacaaaaatcggtagtatttctatattcctacagcgaacaatttaaaaaataattttaaaaagtaatcccatttacaatatccacacataaaattaacaatgagataccatctcacaccagttagaatggtgatcattaaaaagtcaggaaacaacagatgctggcgatgatgcagagaaatagaaacacttttacactgttggtgggagtgtaaattacttcagtcat

SEQ ID NO: 165410 - DNA, 601 bp, Human
attggaaaacttagaagtaatgaacaaattcctagatacatacaacctactgaaattgaaccatgaagaaatccaaaacctgaacaaaattatagcaaataatcagattgaactcaagagaaagcatcctagtagagaaaagctcaagacccaatgacttcaatgatgaattctagcaaatatttaaagaactaataccaatcctactcaaactattccacaaaatagtgaaggagggaatacttccaaattaattctataaggccagtattactctgataacaaaaccaaagacacattaaaaaaaaaagttataggccaatgtctctgaggaatattcatgcaaaaatcctcaagaaaatagctgcaaaccaaattaatgaatacattaaagagctcactcatcacaaccaagtgggatttatccctgtatgcaagggtgctttaacatatgccaattaattgatgtggtacatcatatcaacagaataaagaacgaaagcatatggtcacttcaattgatactgaaaaattattcgataaaattcaacaccccttcatggtaaaagccctaaaaaaaacagggtatagaaggaacata

SEQ ID NO: 165411 - DNA, 601 bp, Human
acaactatataccaataaattggaaaacttagaagtaatgaacaaattcctagatacatacaacctactgaaattgaaccatgaagaaatccaaaacctgaacaaaattatagcaaataatcagattgaactcaagagaaagcatcctagtagagaaaagctcaagacccaatgacttcaatgatgaattctagcaaatatttaaagaactaataccaatcctactcaaactattccacaaaatagtgaaggagggaatacttccaaattaattctataaggccagtattactctgataayaaaaccaaagacacattaaaaaaaaaagttataggccaatgtctctgaggaatattcatgcaaaaatcctcaagaaaatagctgcaaaccaaattaatgaatacattaaagagctcactcatcacaaccaagtgggatttatccctgtatgcaagggtgctttaacatatgccaattaattgatgtggtacatcatatcaacagaataaagaacgaaagcatatggtcacttcaattgatactgaaaaattattcgataaaattcaacaccccttcatggtaaaagccctaaaaaaaaca

SEQ ID NO: 165412 - DNA, 601 bp, Human
tacaagaagctgatagaacaccaagcagattaaacccaatgaagactacttccaggaatttaataataaaactcccaaagatgtcctgaattgtattgcccagattttctgctagggtttttatagttttggagcttacatttaagtcattaatccagcttaagtcaattttgtataagttcaaatacatgaaaattaaacaatatgcttctgagtgaacagtgggacaatgaagaaattaagaagaaaattgaaaaatttcttgaaacaaatgatgagaaaacacagcatatcaaaacckatgggattcagcaaaagtggtactaagaataaagttaatagctgtaagtgtcaactatcaaaatagaagaaaaacatcaaataaacaacctaacaatatactttaaaaaactacgaaagctggagcaaaccaaacccaaaattagtaggagaaaagaaataataaactcagagcagaaataaattgaaataaagaaaacaatacaaaatattaacaaagcaaaaagttgttctttagaagcattaaagaaagctgacaaacctttagccagactaaggaaaaatgtgacatgatccaaat

SEQ ID NO: 165413 - DNA, 601 bp, Human
ggaggtagagaaagagaagggagtagaaaatttatttaagggaaaataacagagaactttccaaaactagagaaaggtatcactatctaagtacaagaagctgatagaacaccaagcagattaaacccaatgaagactacttccaggaatttaataataaaactcccaaagatgtcctgaattgtattgcccagattttctgctagggtttttatagttttggagcttacatttaagtcattaatccagcttaagtcaattttgtataagttcaaatacatgaaaattaaacaatatgctyctgagtgaacagtgggacaatgaagaaattaagaagaaaattgaaaaatttcttgaaacaaatgatgagaaaacacagcatatcaaaacctatgggattcagcaaaagtggtactaagaataaagttaatagctgtaagtgtcaactatcaaaatagaagaaaaacatcaaataaacaacctaacaatatactttaaaaaactacgaaagctggagcaaaccaaacccaaaattagtaggagaaaagaaataataaactcagagcagaaataaattgaaataaagaaaacaatacaaaat

SEQ ID NO: 165414 - DNA, 601 bp, Human
agcagagattgtggagctgaaacatgcaattggcatactgaagaatgcattggagtctttagtagaataatagaatagaattgatccagcagaagaaagaattagtgagctttaacacaagctatttgaaaatactgttagaagagacaaaagaaaaaagaataaaaaacaatgaagcacacctacaggatctagaaaatagtctcaaaatgcaaatctaagagttattggccttaaagaggaggtagagaaagagaagggagtagaaaatttatttaagggaaaataacagagaactttycaaaactagagaaaggtatcactatctaagtacaagaagctgatagaacaccaagcagattaaacccaatgaagactacttccaggaatttaataataaaactcccaaagatgtcctgaattgtattgcccagattttctgctagggtttttatagttttggagcttacatttaagtcattaatccagcttaagtcaattttgtataagttcaaatacatgaaaattaaacaatatgcttctgagtgaacagtgggacaatgaagaaattaagaagaaaattgaaaaatttcttgaaaca

SEQ ID NO: 165415 - DNA, 601 bp, Human
actctagaatgcccagcccccgatgaatatctacaagtataaagaaaatccaggaaaacatgacctcaccacacgaactaaataaggcaccagggaccaatcctggagaaacagagatgtgtgatctttcagccagagaatataagatagttgttttgaggaaacctaaagatattcaaaataacacagagaagaaattcacaattctatcagataaacataacgaagagactgaaataatttacaagagtcaagcagagattgtggagctgaaacatgcaattggcatactgaagaatgyattggagtctttagtagaataatagaatagaattgatccagcagaagaaagaattagtgagctttaacacaagctatttgaaaatactgttagaagagacaaaagaaaaaagaataaaaaacaatgaagcacacctacaggatctagaaaatagtctcaaaatgcaaatctaagagttattggccttaaagaggaggtagagaaagagaagggagtagaaaatttatttaagggaaaataacagagaactttccaaaactagagaaaggtatcactatctaagtacaagaagctgataga

SEQ ID NO: 165416 - DNA, 601 bp, Human
aattgactcagaacagagagagagactttgtttatttgggagaaattaagggaagggaacaagagtttctggtaatccagagaattctcttggatcttgtccaagaccatcaaggcagtacctctacaagtcttcaagaaccactgcattattgggcttggagtgcccctaaagcagatacagcttagatcacaacacttaactcatttcccatttattaaaaaaagtgcagttcactgccggtgcagtattctaggggcaaatcgaaaataggttaagtcctttttaatatctggaaagyctaacaagaaggatgtgtacaaaaaaaaccccagactacaaagacaacaaaaatacctaactctagaatgcccagcccccgatgaatatctacaagtataaagaaaatccaggaaaacatgacctcaccacacgaactaaataaggcaccagggaccaatcctggagaaacagagatgtgtgatctttcagccagagaatataagatagttgttttgaggaaacctaaagatattcaaaataacacagagaagaaattcacaattctatcagataaacataacgaagagactgaaataat

SEQ ID NO: 165417 - DNA, 601 bp, Human
gtttttgactctagtccctggcttctgggtggtacctctggacatgcctgggtactggaagaatttgcttcactgaagggaaggacacaggcctggctggattcaccaccaactgattgtagggccccagatccttggaaacataggcagtagccagggaatggttgcagcaagctttgggcaagacccagtgctctgcttgttttaagtctcacccagtgcagtcacagtggtggtggatacatgagtgcttgtgtcattccatccccagtttcaattgactcagaacagagagagagamtttgtttatttgggagaaattaagggaagggaacaagagtttctggtaatccagagaattctcttggatcttgtccaagaccatcaaggcagtacctctacaagtcttcaagaaccactgcattattgggcttggagtgcccctaaagcagatacagcttagatcacaacacttaactcatttcccatttattaaaaaaagtgcagttcactgccggtgcagtattctaggggcaaatcgaaaataggttaagtcctttttaatatctggaaagcctaacaagaaggatgtgtacaaaaa

SEQ ID NO: 165418 - DNA, 601 bp, Human
ccttgatttaaatatatatcactgaaagaggaaatgaagagatagaaaaaatactattgaattactgacatcctctcttcccctggcagcagtggcatggttcagagagtatttctgagtactgagggagggagagcacagcaattatagagcataaaattagtgcagttctgttaaggcagaaaggaaaacaggcccaaaatcagctgatgcccactcacagagggagcatttaaaccagccctggccagaggtgaatctctgataccagtggttggaaccgagtttctacaagcctcawcactgtggactatagggctctgggatggtaaataaacctgaaaggcagtgttggctacaagtactgtaacttttatgtgagtcctggtgctgaactgggcccagagacagtagactggggtgggaggtgcaacctactgagacagcagctggggatgggtaagggagtgctgacatcccccctctcctaatcccaagctgcacagttttcacttccaaaagaaactgctttcttctgcttgaggagtggggggcttgaatagctagcagcaatacccaggtactatgttgagggctttgg

SEQ ID NO: 165419 - DNA, 601 bp, Human
aggatttatgactcaatgtttaaaagcaatttcaacaaaaacagttgacaatgggacctaattaaactaaagagcttctgcacagtaaaagaaatgacaagcagagtaaacatacaacctacagaatgggagaaaatatttgcaaaatataccttcaacaaaggactattttccagagtctacaagaaactcaaaacagcaagaaaaaaatccgaataatcccattagaaagtgggcaaacaacatgaacagaaatttctcaaaagaagatatacaaatgggagagtggagcaagatgacrgaattgaatgcttcattgattattccccaagcaaagacatcagtttaacagctatctacacaaaatgtaccttcataagaaccaaaatcagatgagcatgcaccttgatttaaatatatatcactgaaagaggaaatgaagagatagaaaaaatactattgaattactgacatcctctcttcccctggcagcagtggcatggttcagagagtatttctgagtactgagggagggagagcacagcaattatagagcataaaattagtgcagttctgttaaggcagaaaggaaaacaggccc

SEQ ID NO: 165420 - DNA, 601 bp, Human
ggactaaagacttaaatatgagacttgaaatcataaaaattctagaaaaaacctataaaaaactcttctgagcattggtgtaggctaaggatttatgactcaatgtttaaaagcaatttcaacaaaaacagttgacaatgggacctaattaaactaaagagcttctgcacagtaaaagaaatgacaagcagagtaaacatacaacctacagaatgggagaaaatatttgcaaaatataccttcaacaaaggactattttccagagtctacaagaaactcaaaacagcaagaaaaaaatccraataatcccattagaaagtgggcaaacaacatgaacagaaatttctcaaaagaagatatacaaatgggagagtggagcaagatgacagaattgaatgcttcattgattattccccaagcaaagacatcagtttaacagctatctacacaaaatgtaccttcataagaaccaaaatcagatgagcatgcaccttgatttaaatatatatcactgaaagaggaaatgaagagatagaaaaaatactattgaattactgacatcctctcttcccctggcagcagtggcatggttcagagagta

SEQ ID NO: 165421 - DNA, 601 bp, Human
gtgggtatggtgttagctgagatacgataaaagttttctccttcccaaatgctatgttattttgccagcagatgttgtaataggctgtgcctattggcttccagctaggaggtggttcttgcaggaaagagccacctacgctggtagctgcgggatttgtgcttggctgatattacccaggggaacatgtagaagaatgaaatatgattcttatatctcaccacatacaaaaattaactcaagatggactaaagacttaaatatgagacttgaaatcataaaaattctagaaaaaacctayaaaaaactcttctgagcattggtgtaggctaaggatttatgactcaatgtttaaaagcaatttcaacaaaaacagttgacaatgggacctaattaaactaaagagcttctgcacagtaaaagaaatgacaagcagagtaaacatacaacctacagaatgggagaaaatatttgcaaaatataccttcaacaaaggactattttccagagtctacaagaaactcaaaacagcaagaaaaaaatccgaataatcccattagaaagtgggcaaacaacatgaacagaaatttctcaaaagaag

SEQ ID NO: 165422 - DNA, 601 bp, Human
cactcaagaccttccgattagctggggtgatgtgggtatggtgttagctgagatacgataaaagttttctccttcccaaatgctatgttattttgccagcagatgttgtaataggctgtgcctattggcttccagctaggaggtggttcttgcaggaaagagccacctacgctggtagctgcgggatttgtgcttggctgatattacccaggggaacatgtagaagaatgaaatatgattcttatatctcaccacatacaaaaattaactcaagatggactaaagacttaaatatgagacytgaaatcataaaaattctagaaaaaacctataaaaaactcttctgagcattggtgtaggctaaggatttatgactcaatgtttaaaagcaatttcaacaaaaacagttgacaatgggacctaattaaactaaagagcttctgcacagtaaaagaaatgacaagcagagtaaacatacaacctacagaatgggagaaaatatttgcaaaatataccttcaacaaaggactattttccagagtctacaagaaactcaaaacagcaagaaaaaaatccgaataatcccattagaaagtgggca

SEQ ID NO: 165423 - DNA, 601 bp, Human
tgatcgaggtggcaagagagtgacatagactttgtaagatttacttggttataaataggtttagtgtggtaattttctcaaatgccagctgtactagcaatgtattgggtttgtgaacacactcaagaccttccgattagctggggtgatgtgggtatggtgttagctgagatacgataaaagttttctccttcccaaatgctatgttattttgccagcagatgttgtaataggctgtgcctattggcttccagctaggaggtggttcttgcaggaaagagccacctacgctggtagctgygggatttgtgcttggctgatattacccaggggaacatgtagaagaatgaaatatgattcttatatctcaccacatacaaaaattaactcaagatggactaaagacttaaatatgagacttgaaatcataaaaattctagaaaaaacctataaaaaactcttctgagcattggtgtaggctaaggatttatgactcaatgtttaaaagcaatttcaacaaaaacagttgacaatgggacctaattaaactaaagagcttctgcacagtaaaagaaatgacaagcagagtaaacatacaacc

SEQ ID NO: 165424 - DNA, 601 bp, Human
gagggcaatgttgaatggggcttaactgggcctaactgtcctctggtctcctagcagcaggtgcaagcaccacctctgatcgaggtggcaagagagtgacatagactttgtaagatttacttggttataaataggtttagtgtggtaattttctcaaatgccagctgtactagcaatgtattgggtttgtgaacacactcaagaccttccgattagctggggtgatgtgggtatggtgttagctgagatacgataaaagttttctccttcccaaatgctatgttattttgccagcagatgttgtaataggctgtgcctattggcttccagctaggaggtggttcttgcaggaaagagccacctacgctggtagctgcgggatttgtgcttggctgatattacccaggggaacatgtagaagaatgaaatatgattcttatatctcaccacatacaaaaattaactcaagatggactaaagacttaaatatgagacttgaaatcataaaaattctagaaaaaacctataaaaaactcttctgagcattggtgtaggctaaggatttatgactcaatgtttaaaagcaatttcaacaaaaaca

SEQ ID NO: 165425 - DNA, 601 bp, Human
atttataacaagctatcaagaactaccccactcttgcaataacaacatgagtatatttatgaggtcagaacactgatgacctagtcatgttttgttaggctgcacccacaaacactgttgcattgggcattcacttttagcacatgaactgtagaggacacattcaaaccagaacatgaatcttcttctcttttctcctcattactcaaaacacaaatgtgaagggggaggtaggattgacatcatcttgggacatgagcatttgatcatagtaatgaagacttctatactaaatatggtaaaaaaaaaaaaaaaaaaaagaaggcacttgactctctcatgcttcagggctaccatattatttctagtctagcccactataagacttcttgtatttgagatatataagccaactatttgattaagctcttgatatagtttggataataaatatttatctctcccaaatcttttgttgaaacttaatccccattgttataggtggaatctggtgagaggtgattgggtcatgggggtagatttctcatgagcattatttcccttgatgttatcctgataataagtgagttcacataagatc

SEQ ID NO: 165426 - DNA, 601 bp, Human
tcctgacagacctacaagttccattcatgaaatcattcgctgcttaggttagtcacacagaatatttctttccccagaaataaaagcagaagtatactgatgccctgtcttacttcaatttgtgttataaaacagaatactatagacttggtaatttataaagaaaagaaatttatttctgatgattctgaaggctgggaagtccaagagcatggcactggcttctggcaatggccttcatcctatttcattgcatggcaaaaagtagaagggcaagaaagggtaagagtgagagcaattggggggggcacactcacatttataacaagctatcaagaactaccccactcttgcaataacaacatgagtatatttatgaggtcagaacactgatgacctagtcatgttttgttaggctgcacccacaaacactgttgcattgggcattcacttttagcacatgaactgtagaggacacattcaaaccagaacatgaatcttcttctcttttctcctcattactcaaaacacaaatgtgaagggggaggtaggattgacatcatcttgggacatgagcatttgatcatagtaatgaagactt

SEQ ID NO: 165427 - DNA, 601 bp, Human
ctgacaaattatgtgccagtatatctaaatacactaaattttaaaaaacatactattttttaaagttagccaaaagagatactggacagtacagtattagaaaaagcaactgtgtggtatggcagaaactgcagatcagttgactcaaactttatttcctgacagacctacaagttccattcatgaaatcattcgctgcttaggttagtcacacagaatatttctttccccagaaataaaagcagaagtatactgatgccctgtcttacttcaatttgtgttataaaacagaatactatasacttggtaatttataaagaaaagaaatttatttctgatgattctgaaggctgggaagtccaagagcatggcactggcttctggcaatggccttcatcctatttcattgcatggcaaaaagtagaagggcaagaaagggtaagagtgagagcaattggggggggcacactcacatttataacaagctatcaagaactaccccactcttgcaataacaacatgagtatatttatgaggtcagaacactgatgacctagtcatgttttgttaggctgcacccacaaacactgttgcattgggc

SEQ ID NO: 165428 - DNA, 601 bp, Human; identical to SEQ ID NO: 20182

SEQ ID NO: 165429 - DNA, 601 bp, Human; identical to SEQ ID NO: 20183

SEQ ID NO: 165430 - DNA, 601 bp, Human; identical to SEQ ID NO: 20184

SEQ ID NO: 165431 - DNA, 601 bp, Human; identical to SEQ ID NO: 20185

SEQ ID NO: 165432 - DNA, 601 bp, Human; identical to SEQ ID NO: 20186

SEQ ID NO: 165433 - DNA, 601 bp, Human; identical to SEQ ID NO: 20187

SEQ ID NO: 165434 - DNA, 601 bp, Human; identical to SEQ ID NO: 20188

SEQ ID NO: 165435 - DNA, 601 bp, Human; identical to SEQ ID NO: 20189

SEQ ID NO: 165436 - DNA, 601 bp, Human; identical to SEQ ID NO: 20190

SEQ ID NO: 165437 - DNA, 601 bp, Human; identical to SEQ ID NO: 20191

SEQ ID NO: 165438 - DNA, 601 bp, Human; identical to SEQ ID NO: 20192

SEQ ID NO: 165439 - DNA, 601 bp, Human; identical to SEQ ID NO: 20193

SEQ ID NO: 165440 - DNA, 601 bp, Human; identical to SEQ ID NO: 20194

SEQ ID NO: 165441 - DNA, 601 bp, Human; identical to SEQ ID NO: 20195

SEQ ID NO: 165442 - DNA, 601 bp, Human; identical to SEQ ID NO: 20196

SEQ ID NO: 165443 - DNA, 601 bp, Human; identical to SEQ ID NO: 20197

SEQ ID NO: 165444 - DNA, 601 bp, Human; identical to SEQ ID NO: 20170

SEQ ID NO: 165445 - DNA, 601 bp, Human; identical to SEQ ID NO: 20171

SEQ ID NO: 165446 - DNA, 601 bp, Human; identical to SEQ ID NO: 20172

SEQ ID NO: 165447 - DNA, 601 bp, Human; identical to SEQ ID NO: 20173

SEQ ID NO: 165448 - DNA, 601 bp, Human; identical to SEQ ID NO: 20174

SEQ ID NO: 165449 - DNA, 601 bp, Human; identical to SEQ ID NO: 20175

SEQ ID NO: 165450 - DNA, 601 bp, Human; identical to SEQ ID NO: 20176

SEQ ID NO: 165451 - DNA, 601 bp, Human; identical to SEQ ID NO: 20177

SEQ ID NO: 165452 - DNA, 601 bp, Human; identical to SEQ ID NO: 20178

SEQ ID NO: 165453 - DNA, 601 bp, Human; identical to SEQ ID NO: 20179

SEQ ID NO: 165454 - DNA, 601 bp, Human; identical to SEQ ID NO: 20180

SEQ ID NO: 165455 - DNA, 601 bp, Human; identical to SEQ ID NO: 20181

SEQ ID NO: 165456 - DNA, 601 bp, Human; identical to SEQ ID NO: 165399

SEQ ID NO: 165457 - DNA, 601 bp, Human; identical to SEQ ID NO: 165400

SEQ ID NO: 165458 - DNA, 601 bp, Human; identical to SEQ ID NO: 165401

SEQ ID NO: 165459 - DNA, 601 bp, Human; identical to SEQ ID NO: 165402

SEQ ID NO: 165460 - DNA, 601 bp, Human; identical to SEQ ID NO: 165403

SEQ ID NO: 165461 - DNA, 601 bp, Human; identical to SEQ ID NO: 165404

SEQ ID NO: 165462 - DNA, 601 bp, Human; identical to SEQ ID NO: 165405

SEQ ID NO: 165463 - DNA, 601 bp, Human; identical to SEQ ID NO: 165406

SEQ ID NO: 165464 - DNA, 601 bp, Human; identical to SEQ ID NO: 165407

SEQ ID NO: 165465 - DNA, 601 bp, Human; identical to SEQ ID NO: 165408

SEQ ID NO: 165466 - DNA, 601 bp, Human; identical to SEQ ID NO: 165409

SEQ ID NO: 165467 - DNA, 601 bp, Human; identical to SEQ ID NO: 165410

SEQ ID NO: 165468 - DNA, 601 bp, Human; identical to SEQ ID NO: 165411

SEQ ID NO: 165469 - DNA, 601 bp, Human; identical to SEQ ID NO: 165412

SEQ ID NO: 165470 - DNA, 601 bp, Human; identical to SEQ ID NO: 165413

SEQ ID NO: 165471 - DNA, 601 bp, Human; identical to SEQ ID NO: 165414

SEQ ID NO: 165472 - DNA, 601 bp, Human; identical to SEQ ID NO: 165415

SEQ ID NO: 165473 - DNA, 601 bp, Human; identical to SEQ ID NO: 165416

SEQ ID NO: 165474 - DNA, 601 bp, Human; identical to SEQ ID NO: 165417

SEQ ID NO: 165475 - DNA, 601 bp, Human; identical to SEQ ID NO: 165418

SEQ ID NO: 165476 - DNA, 601 bp, Human; identical to SEQ ID NO: 165419

SEQ ID NO: 165477 - DNA, 601 bp, Human; identical to SEQ ID NO: 165420

SEQ ID NO: 165478 - DNA, 601 bp, Human; identical to SEQ ID NO: 165421

SEQ ID NO: 165479 - DNA, 601 bp, Human; identical to SEQ ID NO: 165422

SEQ ID NO: 165480 - DNA, 601 bp, Human; identical to SEQ ID NO: 165423

SEQ ID NO: 165481 - DNA, 601 bp, Human; identical to SEQ ID NO: 165424

SEQ ID NO: 165482 - DNA, 601 bp, Human; identical to SEQ ID NO: 165425

SEQ ID NO: 165483 - DNA, 601 bp, Human; identical to SEQ ID NO: 165426

SEQ ID NO: 165484 - DNA, 601 bp, Human; identical to SEQ ID NO: 165427

SEQ ID NO: 165485 - DNA, 601 bp, Human; identical to SEQ ID NO: 20182

SEQ ID NO: 165486 - DNA, 601 bp, Human; identical to SEQ ID NO: 20183

SEQ ID NO: 165487 - DNA, 601 bp, Human; identical to SEQ ID NO: 20184

SEQ ID NO: 165488 - DNA, 601 bp, Human; identical to SEQ ID NO: 20185

SEQ ID NO: 165489 - DNA, 601 bp, Human; identical to SEQ ID NO: 20186

SEQ ID NO: 165490 - DNA, 601 bp, Human; identical to SEQ ID NO: 20187

SEQ ID NO: 165491 - DNA, 601 bp, Human; identical to SEQ ID NO: 20188

SEQ ID NO: 165492 - DNA, 601 bp, Human; identical to SEQ ID NO: 20189

SEQ ID NO: 165493 - DNA, 601 bp, Human; identical to SEQ ID NO: 20190

SEQ ID NO: 165494 - DNA, 601 bp, Human; identical to SEQ ID NO: 20191

SEQ ID NO: 165495 - DNA, 601 bp, Human; identical to SEQ ID NO: 20192

SEQ ID NO: 165496 - DNA, 601 bp, Human; identical to SEQ ID NO: 20193

SEQ ID NO: 165497 - DNA, 601 bp, Human; identical to SEQ ID NO: 20194

SEQ ID NO: 165498 - DNA, 601 bp, Human; identical to SEQ ID NO: 20195

SEQ ID NO: 165499 - DNA, 601 bp, Human; identical to SEQ ID NO: 20196

SEQ ID NO: 165500 - DNA, 601 bp, Human; identical to SEQ ID NO: 20197

SEQ ID NO: 165501 - DNA, 601 bp, Human; identical to SEQ ID NO: 20198

SEQ ID NO: 165502 - DNA, 601 bp, Human; identical to SEQ ID NO: 20199

SEQ ID NO: 165503 - DNA, 601 bp, Human; identical to SEQ ID NO: 20200

SEQ ID NO: 165504 - DNA, 601 bp, Human; identical to SEQ ID NO: 20201

SEQ ID NO: 165505 - DNA, 601 bp, Human; identical to SEQ ID NO: 20202

SEQ ID NO: 165506 - DNA, 601 bp, Human; identical to SEQ ID NO: 20203

SEQ ID NO: 165507 - DNA, 601 bp, Human; identical to SEQ ID NO: 20204

SEQ ID NO: 165508 - DNA, 601 bp, Human; identical to SEQ ID NO: 20205

SEQ ID NO: 165509 - DNA, 601 bp, Human; identical to SEQ ID NO: 20206

SEQ ID NO: 165510 - DNA, 601 bp, Human; identical to SEQ ID NO: 20207

SEQ ID NO: 165511 - DNA, 601 bp, Human; identical to SEQ ID NO: 20208

SEQ ID NO: 165512 - DNA, 601 bp, Human; identical to SEQ ID NO: 20209

SEQ ID NO: 165513 - DNA, 601 bp, Human
aatggccactgcccaaagtaatttatagattcaattctatccccatcaagctatcattgcctttcttcacagaactagaaaaatctactttacattttatatggaacgaaagaagagcccacatagccaagaaaatctaagcaaaaagaacaaaaagttcataatcactgggacattggagaaatgcaaatcaaagtcccaatgaggtaccatctcatgccagttagaatggtgatcattaaaaagtcaggaaacaacagatgctggagaagatgtggagaaataggaatgcttttacacygttagtgggagtgtaaattagttcaaccattatggaagacagtgtgctgattcctcaaggatctggaacaagaaataccatttgacccagtaatcctgttactgggtatatacccaaaggattataaatcattctactataaagacacatgtgcacgtatgtttattgcagtactattcacaatagcaaagacttgggaccaacccaaatgctgatgaatgacagtctggataaagaaaatgtggcacatatacaccatggaatacagtgctgccataaaaaaggatgagttcatgtcct

SEQ ID NO: 165514 - DNA, 601 bp, Human
tgtactccattgatctatatgtctgtcgtaatccctatagtacaccatcttaattactgtagtattgtattaatatcaagttattatatcaaatcaaggagtgtgagtctttgttgttctttttcaatacgttttcactattctgggtcccttgaatcttcatatgaaatttagaatacacttgtcaattttctcaaaggagccaatggggattttgacacgattgcattaaatcagtagatcagggaattatgccatttttaaaattgaagtgaaattcacacaatatacaattaaccaytttaaagtgtagacttgagtggtatttagtgtattcacaatgttgtacaaccaccagctttctctggtttcaaaatgtttttattacttcacaaaaacatatcatattcattaaataatcactccattcctccaacccatcatgtaattacctctaatcttctttctgtttctatggatttgcctgttatggatatataaaggactcacagcatatgtaacctgttatgtctgagtcctttcacttataatgttttggaggctcatctaagttgcaacatgtatcagtacttcattcttt

SEQ ID NO: 165515 - DNA, 601 bp, Human
tttttaaaattgaagtgaaattcacacaatatacaattaaccattttaaagtgtagacttgagtggtatttagtgtattcacaatgttgtacaaccaccagctttctctggtttcaaaatgtttttattacttcacaaaaacatatcatattcattaaataatcactccattcctccaacccatcatgtaattacctctaatcttctttctgtttctatggatttgcctgttatggatatataaaggactcacagcatatgtaacctgttatgtctgagtcctttcacttataatgttttrgaggctcatctaagttgcaacatgtatcagtacttcattcttttttgtcgctgaaatatattttatttttccatgcacatatatcacaatttgttattcatctgtttatggacatttgcattgtttccaacctttggctcttatagataatcttgctttgatcatttgtgtatgtttctttatgggcatattttcatcattcttgggtatattctcaggagttgaattgctgggtcaaatggtaattttatgcttatcttcttgtatataagagccaatcttttctacagtgaatgtggc

SEQ ID NO: 165516 - DNA, 601 bp, Human
tatcatattcattaaataatcactccattcctccaacccatcatgtaattacctctaatcttctttctgtttctatggatttgcctgttatggatatataaaggactcacagcatatgtaacctgttatgtctgagtcctttcacttataatgttttggaggctcatctaagttgcaacatgtatcagtacttcattcttttttgtcgctgaaatatattttatttttccatgcacatatatcacaatttgttattcatctgtttatggacatttgcattgtttccaacctttggctcttatagataatcttgctttgatcatttgtgtatgtttctttatgggcatattttcatcattcttgggtatattctcaggagttgaattgctgggtcaaatggtaattttatgcttatcttcttgtatataagagccaatcttttctacagtgaatgtggcattttatattccttccagcaatgtagaaggatttctattttccacatagttgctaatacttgtaactttctgtatttattgaagccatcctagtgaatatagagtgttatctcattgtggttttatttatttattcatttatt

SEQ ID NO: 165517 - DNA, 601 bp, Human
ggtctttgatgatggtgacatacagatgggattttggtgtggatgtcctttctgtttgttagctttccttctaacagtcaggaccctcagctgcagtctgttggagtttgccagaggtccactgcagaccttgtttgcctgggtatcagcagcggaggctgcagaacagcggatattggtgaacagcaaatgttgctgcctgatcgttcctctggaagttttgtctcagaagagtacccagccttgtgaggtgtcagtctgcccctaatggggggtgcctcccagttaggctacaaggggrtcagggacccacttgaggaggcagtctgtccattctcaggtctcaagctttgtgctgggagaaccactattctctccaaagctgtcagactgggacaattaagtctgcagaattttctgctgccttttgtttggctataccctgaccccagaggtggagtctacagaggcaggcaggcctccttgagctgcggtgggctccacccggttcgagcttcccagccgctttgtttacctactcaagctttggcaatggggggcacccctcacccagcctcgctgctgccttgctgtttgatct

SEQ ID NO: 165518 - DNA, 601 bp, Human
ctcagaagagtacccagccttgtgaggtgtcagtctgcccctaatggggggtgcctcccagttaggctacaagggggtcagggacccacttgaggaggcagtctgtccattctcaggtctcaagctttgtgctgggagaaccactattctctccaaagctgtcagactgggacaattaagtctgcagaattttctgctgccttttgtttggctataccctgaccccagaggtggagtctacagaggcaggcaggcctccttgagctgcggtgggctccacccggttcgagcttcccagccrctttgtttacctactcaagctttggcaatggggggcacccctcacccagcctcgctgctgccttgctgtttgatctcagactgctgtgttaggaatgagtgagcctcagtgggcataagaccctctgagccaggcacgggatataatctcctggtttgccatttgctaagaccatcagaaaagcacagtattagggtggaagtgaccttattttccagatgccttctgtccttggctaagaaagggaattctctgaccccttgcacttcccaggtgaggtgattcctcaccctgcttcag

SEQ ID NO: 165519 - DNA, 601 bp, Human
caagctttgtgctgggagaaccactattctctccaaagctgtcagactgggacaattaagtctgcagaattttctgctgccttttgtttggctataccctgaccccagaggtggagtctacagaggcaggcaggcctccttgagctgcggtgggctccacccggttcgagcttcccagccgctttgtttacctactcaagctttggcaatggggggcacccctcacccagcctcgctgctgccttgctgtttgatctcagactgctgtgttaggaatgagtgagcctcagtgggcataagrccctctgagccaggcacgggatataatctcctggtttgccatttgctaagaccatcagaaaagcacagtattagggtggaagtgaccttattttccagatgccttctgtccttggctaagaaagggaattctctgaccccttgcacttcccaggtgaggtgattcctcaccctgcttcagctcaggctccatgcactgcacccactgtcctgtacccactgtctcacaatccccagtgagatgaacccagtacctcagttggaaatgcaaaaatcattcatcttctgcatcgctcatgct

SEQ ID NO: 165520 - DNA, 601 bp, Human
tagtaattccttgtgtattttttccatctttgtgtcccacttttatatgagaacatgtggtatttggatttctgttgctgcattaattccctcaagataatggcttccagctacatctatgttgctgcaaagacatgattttttttaatggctgcatagcatttcatggtgtatatacaccacattttgtttatgtgacacatgattggttggttctatgtctttactattgtgaatagtgcaggaatggacatactagcacgtgtcgttttggtagaacaatttgttttcctctgggtamatactcagtagtggaattgctgcatcgaatggtagttctgcttttagttctttgagaaatctcaaaactggtttccatagtggctgaactaacttacattcccaccagtagtatataagtgttctcttttctctgcagtctcaccaacatctgttattttttggctttttaatcatatccattttgattggcatgagatgatatctcattgtggttttgatttgcatttctctgatgattagtgatgttgagtgttttctcatatgcttgttggccatgtgtgtgtcttctttggaagga

SEQ ID NO: 165521 - DNA, 601 bp, Human
agatcagatggctataggtgtgtggctttatttctggcttctctacttctgttcaatttgtgttttgtaccagttacatgctctcttggttactgtagcttacagtatagtttgaagtcaatgtgaagcttcccactgttctttttgtttaggattgctttggatttgggctcttctttggttccatatgaattttagaataaaataatattggtagtttgataggaatagcattgaatctgtagatagctttgggcagtctagccattttaatgatattgattgtttcaatccataagcmtgaactgtttttccatttgtttgtgtcatctatgattttgttcatcagtattttgtagctctccttgtagagacctttttgccccctttgttagttgtattcctaggttttttcttgtggctattgtaaatgggattgagttcttgattggctttcaggatgaacatttttggtgtttaaaaatgctacagatttttgcatatttattttgtgtactgaaatctcactgaagttgtatgtcagttccaggagtttttggaaagttctttagggttttctaggtctgaattgggtcttcta

SEQ ID NO: 165522 - DNA, 601 bp, Human
tcttgcaaaacagaaactttatacccatttaataataactcttggccgggcattgtagatcatgtctgtaatcccagcactttgggaggttgaggtgggcagattggatgagctcaggagttcgagactagcctgggtaacatggcaaaaccctgtctctaccaacaaagcaatcaacaaacaaaatgaaagtaacataatttcctcaactgtgcaaactaattcatattaataattccatgaaatgtgtccatagtaacacaagagcagaagatgggccttgtaaaggtggcccaccacrttatttgaggtctttgtcagtcttatctgccagatactgtgtggactaactgcagttaaaattcccattcccttatcacttgccctgaaatttatctgaaatcaaagggaatgggttgcccaaagagaagtgtccagagacgtggatgatgcgacaagaaatgttgtagaaccacacccccacctcaaatgataactctacatttctcccttccaccaccccatggcaaccaacattctactttgtgtctctataaaatcgagtatgctgggtacctcataaaagtggaatcattacata

SEQ ID NO: 165523 - DNA, 601 bp, Human
aggattgcaacccctgctttgttttgctttccatttgcttggtaaatattcctccatccctttattttgagcctatgtgtgtcttttcacgtgagatgggtctcctgaatacagcacattgatgggtcttgactctatccaatttgccagtctgtgtcttttaattggggcatttagcctgtttacatttaaggttaatattgtgtgtggatttaatcctgccattatgatgctagctgattattttgccttttagttgatgcagttttttttatagtgttgacggtctttacaaaatttrgtatgtttttgcagtggctgttcccagttgatcctttccatatttagtgtttccttcaggagctcttgtaaggcaggcttggtgatgacaaaatccccttgtggtgatgggcttccctttgtggtaacccgacctttctttctggcttcccttaacatttttcctttcttttaaccttggtgaatctgacaattatgtgtcttggggttgcccttcttgaggagtatcattgtgggtgttttctgtatttcctgaatttgaatgttggtctgtcttgctagattgtggaagttctcctgg

SEQ ID NO: 165524 - DNA, 601 bp, Human
tctttcaactaagtattccttatccattgctttctttctcccaacttccaaattatgagaactccagtctctaagccttggcatatgcagtatccttactctctcctttatcccctgtggcaattaatccctttattctccatcttcatcattgttctttctcttcactttgtatatttttgtttattcctgcactactgcaccctagaacaagttgtctgttgcctcccatctagattataatagtgtgggcccatcttgtcattgtaaacccattctcttcctctataatttatcttargttttgctgtcatattgcttttttaatatttgtttttacaaaatttcaactttataatgaatctgggggcaatattgagtccatgtacctttctgacagaaaaatataattgcagactcttgattcaggctcacagtgtctaatgatatggccccaatttacgttttctattaatttagattgtggttgtctacaggtaataatggctttaacacataatgtctttatttatctcaaatacagggattctcttggtggggcaatctaggataatacagcagccccaaagcagcagagagt

SEQ ID NO: 165525 - DNA, 601 bp, Human
atgcagtatccttactctctcctttatcccctgtggcaattaatccctttattctccatcttcatcattgttctttctcttcactttgtatatttttgtttattcctgcactactgcaccctagaacaagttgtctgttgcctcccatctagattataatagtgtgggcccatcttgtcattgtaaacccattctcttcctctataatttatcttaggttttgctgtcatattgcttttttaatatttgtttttacaaaatttcaactttataatgaatctgggggcaatattgagtccaygtacctttctgacagaaaaatataattgcagactcttgattcaggctcacagtgtctaatgatatggccccaatttacgttttctattaatttagattgtggttgtctacaggtaataatggctttaacacataatgtctttatttatctcaaatacagggattctcttggtggggcaatctaggataatacagcagccccaaagcagcagagagtcaagtgccttcctttttcccactaaatttagtatacagaccttcattttgatgattaaatcccaggatggggtctactctacct

SEQ ID NO: 165526 - DNA, 601 bp, Human
cttcactttgtatatttttgtttattcctgcactactgcaccctagaacaagttgtctgttgcctcccatctagattataatagtgtgggcccatcttgtcattgtaaacccattctcttcctctataatttatcttaggttttgctgtcatattgcttttttaatatttgtttttacaaaatttcaactttataatgaatctgggggcaatattgagtccatgtacctttctgacagaaaaatataattgcagactcttgattcaggctcacagtgtctaatgatatggccccaatttaygttttctattaatttagattgtggttgtctacaggtaataatggctttaacacataatgtctttatttatctcaaatacagggattctcttggtggggcaatctaggataatacagcagccccaaagcagcagagagtcaagtgccttcctttttcccactaaatttagtatacagaccttcattttgatgattaaatcccaggatggggtctactctacctcctacttcacatttgtgttttgagtatgaaagaggaaatagaggaaatggacctagagaccttctgcttatatatttt

SEQ ID NO: 165527 - DNA, 601 bp, Human
aatcccaggatggggtctactctacctcctacttcacatttgtgttttgagtatgaaagaggaaatagaggaaatggacctagagaccttctgcttatatattttagcaaaaaaaaatatgctgtgtgactcagctagctgcaaagagcctgatgaatggaatttttaggcaagcatggaataagggagtaggaaataaagtttgggcaagttggtctacagcctctgctatacaagcagtattttttttctagtactgtactttccagtttctatgttggtaactatataactatgtgartaattttgaattcactgtaatcaaatatgctggtaaataatttgtcagataattgcatcaaatcattcctaggaaaagcacaaccaaccatctgaatttactattgaaagcttggaaaacactgcagttgacttgtttggagctgggacagagacgacaagcacaaccctgagatatgctctccttctcctgctgaagcacccagaggtcacaggtatgatcagagatgataagttaattaattttcagaaaagattttgggaaggtgttgctagtgtcctccttcctgtttctcttaga

SEQ ID NO: 165528 - DNA, 601 bp, Human; identical to SEQ ID NO: 20210

SEQ ID NO: 165529 - DNA, 601 bp, Human; identical to SEQ ID NO: 20211

SEQ ID NO: 165530 - DNA, 601 bp, Human; identical to SEQ ID NO: 20212

SEQ ID NO: 165531 - DNA, 601 bp, Human; identical to SEQ ID NO: 20213

SEQ ID NO: 165532 - DNA, 601 bp, Human; identical to SEQ ID NO: 20214

SEQ ID NO: 165533 - DNA, 601 bp, Human; identical to SEQ ID NO: 20215

SEQ ID NO: 165534 - DNA, 601 bp, Human; identical to SEQ ID NO: 20216

SEQ ID NO: 165535 - DNA, 601 bp, Human; identical to SEQ ID NO: 20217

SEQ ID NO: 165536 - DNA, 601 bp, Human; identical to SEQ ID NO: 20218

SEQ ID NO: 165537 - DNA, 601 bp, Human
taatggctgtgaatactatgggaggtttcatcacagatgcttgccatttacttttagggacgtcgcatacgacgtccgtaaattactggctcgggttttgagctttacctggctctcgtcccctgtagtacaatcctctttattctttcaggggacaaacaacaacaaaacccgtctctcacacagacaatacaccctgacagacaagtgacccacaaacaatccctcctcaaatgaaggtaaaactagggctagaaaacgttcaactaatttaaggcaattaaccctctgaaatttttckctgatcaaaggaacaggaattgctgttttaaaatatgcaactggcatttcacacctctacactggacgacgtattgcgtggaggatggagaaggaagatcacccctactcccaaattcgtagttataagggcgggttattagaagggcgccaggaaggtctctctacaaagatggggggccggggaactccctatttgccctattttggtcccaacactgaaccaaggaaattgcgcccaaggttgaagcacacgcaatccgtccgtcatgcagacaaatgctctttcaggggtcctaat

SEQ ID NO: 165538 - DNA, 601 bp, Human
attcctaaaaacaacttaagaataaaagaagtgtatttttttgtgtaaacttactgacaaaggtccccgaataggtaagaaagtatgcctgagtttccttcttaacataatattatcttcagcctacttttattataagtggaggtggtaatgagtaactaaatgaattgaaggggaaacaaccgaaaaagagaagaaaggataagatcctaactatatgaagggtattttttcttcctacttgtagagagggaaagataaaaagagaggtttaaagcaagcaagagatagtaaagcacgytatgtgaaaacatctccttcacatattttattatttcctagaaagattagtaatttaatgttcgttaagcatgcaaataattcttaggaagccgtaccttatgttgtcttatattactagatccacaaataacagggacaaggtttctgtctataaagttacaatttacttggagatagaagatatatacacaaataactgtaatgcaaagcaaaaatggtaagaaaatagagctgactcacttcatgggaagggaggggctggagaaaccactactaagcttggaaattatgtgatgtt

SEQ ID NO: 165539 - DNA, 601 bp, Human
cccttatattttcctttgaagtacacttatctcagtgctggcataatagtcagtaagtatttgttagctactgaaattataagtgggagctaaaggatgagaacacacgggcacataaagggaacaacacacactggggcctattggaggtgaagggtgggaggaggtagaggatcaggaaaaataactaatgggttctaggcttaacacctgggtgatgaaataatacgtacaacaaacccctatgacacaagtttacctatataacaaacctgcacatgtacccctgaatttaaaagayaaaaaaaagaaattatgtctaacgtctcttccaactttataacgttctactctcttcacctggaactgtatcgttaaccaggtccaacaggtgaaaaacctaataaggttgcctacaaagtcattatacactaaggttttaaaaaggaaagggcaaggatatggtcatctcgttacaggcaatgccctagctgtgatttgggaatcaactcaccactctctacttgttgatgaatctgttttccaacctcttgctaactaataagaagaaacaaacaaatatacaaatcaaaaaccaaag

SEQ ID NO: 165540 - DNA, 601 bp, Human
ttacttaatacttataagtattcccttatattttcctttgaagtacacttatctcagtgctggcataatagtcagtaagtatttgttagctactgaaattataagtgggagctaaaggatgagaacacacgggcacataaagggaacaacacacactggggcctattggaggtgaagggtgggaggaggtagaggatcaggaaaaataactaatgggttctaggcttaacacctgggtgatgaaataatacgtacaacaaacccctatgacacaagtttacctatataacaaacctgcacrtgtacccctgaatttaaaagataaaaaaaagaaattatgtctaacgtctcttccaactttataacgttctactctcttcacctggaactgtatcgttaaccaggtccaacaggtgaaaaacctaataaggttgcctacaaagtcattatacactaaggttttaaaaaggaaagggcaaggatatggtcatctcgttacaggcaatgccctagctgtgatttgggaatcaactcaccactctctacttgttgatgaatctgttttccaacctcttgctaactaataagaagaaacaaacaa

SEQ ID NO: 165541 - DNA, 601 bp, Human
gtcccgctcttgtcacctgtgctggagtgcaatgatgcaatctcggctcactgcaacctctgcctcccaggttcaagcgattctcctgcctcagcctcccaagtagctgggattacagacgcctgccaccatgcctggctaatttttatatttttagtagagatggggttttgccatgttggccaggctggtctggaactcctgacctcaggtgatttgcccgcctcggcctcccaaagtgctgggattacacgcgtgagccactgcacccggcctatgatttcaaatttttaatgtgtcktatgaggttctacttgctttgtaccctaatttcctcttcagcctatgttttaccattccatcgcttccagccaaactggtctttcagtcccacagatacacattgattatatttcaaggccattgtttattctatttcctttgcttgggcagctaatcttttcttaacctagctatcttcaactcattcttcacagtttagtataattactccctattccctactattaaatattcccttataggtattacttaatacttataagtattcccttatattttcctttgaagtacacttatc

SEQ ID NO: 165542 - DNA, 601 bp, Human
aagtaagaggggatattactatcaatattatagaaataaatgggaatgtaaaggaacagtatgaacagttgttatctcaacaatttagagaatctagatgaaatgagtaattcttagaaagaccctcatgtagtttagatgttgctcctgctaaatctcaccttgaattgtaatccccaatgttggaggtggggcctggtgggaggtgttttggccacaggggcagattcctcatgccctggtgctatccttgagatagtcagttctcacaagacctggtcatttaaaagtgtgtgacacytctttctctcttgctctcactcctgccatgtgagaggccagcttcccccttcaccttctgccatgattgttaagcttcccaaggcctccagaaggcaagcagatgccagcaccatgcttcctgcaaaacctaaagaactgtgagccaattaaaacctcttttctttataagttacccactctcaggtgtttcttcatagaaacacaagaacagactaatagacccaaactatgagaactgactcaagaagaaacagaaaatctgaacagacctataacaagaaatggaatttgtaataaa

SEQ ID NO: 165543 - DNA, 601 bp, Human
ggtggctcacgcctgtaatcccagcactttgggaggccaaggcaggcagatcacgaggtcaggagatcgagaccatcctggctaacatggtgaaacctcctttctactaaaaatacaaaaaattagctgggtgtggtggcagtcgcctgtagtcccagctcctcgggaggctgaggcaggagaatggcatgaacctgggaggcagagcttgcagtgagcggagatcatgccgctgcactccagcctggggaacagagtgagacttcatctcaaaaaaaaaaaaaaaaaaaaaaaaattcawtaaccacatcatctaccttaagaaactagaaaaagagcaaagcagaaggaaataagcagagtatacataaatgaaacaaaaatagagaaaaatgaataaaaacaaaagctagttctctgaaaacgtcaacaatgttgacaattctgtagctagaccaaccgaaaaaaaaaagagaatactcaaattatactagatcagaaaagtaagaggggatattactatcaatattatagaaataaatgggaatgtaaaggaacagtatgaacagttgttatctcaacaatttagagaatctagatg

SEQ ID NO: 165544 - DNA, 601 bp, Human
tcagagggaggattgatagcagcaagagacaaattcccaggcagacaggggtgggtccatggtgaaacccaacattcaagtcaaaggtggcctgaagcctgaaaactgcatgccagttccggacagagtccacaactagaatgaaaacttcctcgatgcctaaggccaatccaatgcccgcccacagaccactcaacatgcactcccacattctgagcccataaaaaccctggactcagcaacacgtggggttacctacctttgggacccctatcacacagagggttatccactttgggtmccctctcatgttgagagctgttctgttgctcaataaaaatccttttccaccttgctcagtctctcatgtccatgtaatctcattcttctcagatgcgggacaaaaccctggaacctgccgaacctgccgaacctgcagaacctgccggtgggaaaggggctataacattgtagccctcctgccttctgccaggagcggacagccgccccacatgacaggaagcagtggcagggccaagcaggcccaggagccgcaagccagagtggggcagtgggcctgaatgagctgttaacacaaatg

SEQ ID NO: 165545 - DNA, 601 bp, Human
tctagctcctctttgtataatacacatatttggtccatgtatatttaacctccttgtaaaatttgtttcttctcaattagagatcattaaactccatatggtcatgcaaatggagcctcagacgatggctcccttttactgggaactcttaggcctctgagagagatcagactgctgtttttgcaaaacagcaccccgtcagcagaaagcagcaattgtggtcattgtccttatcctaatggcagttagatgtacttcttcagagggaggattgatagcagcaagagacaaattcccaggsagacaggggtgggtccatggtgaaacccaacattcaagtcaaaggtggcctgaagcctgaaaactgcatgccagttccggacagagtccacaactagaatgaaaacttcctcgatgcctaaggccaatccaatgcccgcccacagaccactcaacatgcactcccacattctgagcccataaaaaccctggactcagcaacacgtggggttacctacctttgggacccctatcacacagagggttatccactttgggtaccctctcatgttgagagctgttctgttgctcaataaaaatc

SEQ ID NO: 165546 - DNA, 601 bp, Human
ttctgaggcttcttgccttcacattttttttccaaaaacggatgaagcactgggcctctgtcagccagttaagagcgaatggcacagctgcaaaggacaggcttgctggggaagattttgtcaagcctctgccatcaccctcgggtactgggaatgttggctttgtttcaatccagtctcccttcacagaggtctagccaatgcataggatcggaataaggtcctcgggcaactgaaggcatctggctgaggctacacctcagtgttacctgaaggctcctggactggccccaatccccamcagcccgttcgggtgtcagtcaagacctccagtctttcctatagcattttctttctctcttcctggctcctatctcttcttcatacacaacgttaagggtgttgctgcaaaccacagtgataatattattgagtggaatgagcattttgcttagtcatcagcagtgtaattcagaacaacttggtttttgtctgttcttagaagcaagaaggatgcaatgactgagagttttctttcccctgttgaaggaatccatttgcattgggcaagaggttatttccctcaggcaacttcccctac

SEQ ID NO: 165547 - DNA, 601 bp, Human
tgagccaccacacttagcctgttttcagtttttagccactataagcaaacaccagtgtctaggtttttctgtgagaacaagttttccaattgatttgggtaatgtgagtgttggttcacatgaggagtacatgcataatcatataatcatgtcataatcatgtcaaactgttttcaaaagccactgtatgacttttaattcttaccagtaagaaacaagagttcctgctgctctgcatatttgtggtgaaggacttgccagtttttaaacctgttttcttattttagccattctaacaggwattagtatctcactggggtattaatttgcattttcttaatgactaatgatatggaagatcttttcatatgcttattgccatctgtatattttctttggtaaagtatcttcagatctcttatccacttaaaaaattgtttggtttttgttgttaagttttaagaattctatacatatgttctgggtacaaaccctttatcagacatgtaagatataaatattttcacccagccttttttttttgggacagggttttactctgtcacccaggctgaagtgcagccgtgcagttgtggctcac

SEQ ID NO: 165548 - DNA, 601 bp, Human
tgctctgtcacacaggctggagtacagtggctgctcacagcttactatagcctcgaactcctggcttcaagccatgttcctacctcagcctcccacagtgctgggattaaaggtgtgagccatcacgcctggcctgttttcagtattttttttttttttttgagatggagtcttgctctgttgcccaggctggagtgcagtggcacaatctcggctcaccaaaacctctgtctcctgggttcaagcgattctcctgtctcagcctcccgagtagctgggactacaggcgcacgccatcatrcccagctaatttttgtatttttagtagagatggggtttcactatcttggccaggatggtcttgaactcttgacctcgctatccactcgccttggcctcccaaagtgctgggattacaggtgtgagccaccacacttagcctgttttcagtttttagccactataagcaaacaccagtgtctaggtttttctgtgagaacaagttttccaattgatttgggtaatgtgagtgttggttcacatgaggagtacatgcataatcatataatcatgtcataatcatgtcaaactgttttcaaaa

SEQ ID NO: 165549 - DNA, 601 bp, Human
atgcaatctgggctgggtatggtggttcatgcctgcaatcccagcaccctggggggctgaggtgagaggatcacttgaggccgagagttcatgaacagcctgagcaacatagcaagactctgtctctataaaatgaaataaaaattagccaggtggcatgtgccagtagtcctaggtacttgggaggctgaggtgggagaaacttttgagctcaggcgttcaaggctacaagagctatgatcacaccaccgcattccagcttgggtaacagagtgagaccctacctcttaaaaaaatgaamagaagataatttaactttagaaactctacatattaacatttttgagtaagaatatacaaagtatacattttttattatctttcacaattatagagatgccttcccacagagaaattctgatttcacatgactccatatataaatacttcagaatccccaagttgatgtcagaggacatccagcttttataaaatttatgactatgaaattattttattgtacctctaaagaagatgccaacaaacatggaaaaattcacagtacaagttaattcttttagtatgaattagagtggcccac

SEQ ID NO: 165550 - DNA, 601 bp, Human
tgcactggctggagctgtttgagatgcaagctttctctgccgtttgatttctgcaattccagttctcgttcgggctgaaacatataagcatttaaaaaacaaattcaacgtcagggtagtttgggaattgtaagaagtcaatatgatgcaacctattatataacaacgtgttacatccacagattgaagaatgattcctaaatatatcaactaaatttatgcgactttcagaagaaactaaaatgaatacaatcaagctttataaatccaagattatatttgttctgcagtaattaatatygataacaccatgaattaagaaacctgaacttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcg

SEQ ID NO: 165551 - DNA, 601 bp, Human
tttgtgaactgagagtgctaactcctgaattctaatcccaactctgttattaactagcttcttatcccttaactaccatgtgttttcagaagtttcaagtatgcaacaaataagatataccacacactctctaaggatattcctaactctaaggttcagccaggcatatgtaggatttctaacatgtaaagatagagaagtagaaaggcattcctcattccaggaggacagactgacatcaacaaaggcaaggaagtagaaaatataatgtacattccatttaaaatcaaatacaacagcktctttttctcttaatgccaaaaattgagaattagagagttgaagacttcaattagcgtagaaataggaagaaccctagattaaaatgccttaaagattttatatgcttatagcaaatctagaagtctgttccacttttagtctctctcatcttttatggggggggccataattttacactatgagtataaagacattagtatattatctcattcatacaatttgattaacaacaaaatttaagagaacaaaatgtaaacttactggttacagtatcttgtgactgtgagtggttgaccac

SEQ ID NO: 165552 - DNA, 601 bp, Human
cctaccatgtgtaaagcatggtaaaagacactaagattaataaaatacagtctttatgccttaaggttttacaataaaatccaaagtacaatatagtctcaacaaaaaataatacagtagaatggaaaaagtctaagaagtataaactaagcattctgggtgtagaaaaggatttggaaaaggtgaaaatgagggagatcttgatggcaacaaattttagctgcacagaaagataattggtttgtgaactgagagtgctaactcctgaattctaatcccaactctgttattaactagcttmttatcccttaactaccatgtgttttcagaagtttcaagtatgcaacaaataagatataccacacactctctaaggatattcctaactctaaggttcagccaggcatatgtaggatttctaacatgtaaagatagagaagtagaaaggcattcctcattccaggaggacagactgacatcaacaaaggcaaggaagtagaaaatataatgtacattccatttaaaatcaaatacaacagcttctttttctcttaatgccaaaaattgagaattagagagttgaagacttcaattagcgtag

SEQ ID NO: 165553 - DNA, 601 bp, Human
tcaaggtcaactatattttctctatttgtgttaggaacaaagggaagtacaaaaagtattagtagtcttgaattcaaaaaaatgagtttgaagtctagctttaccacttactacctatggtctgaagcacagcaagctctgactctctaacctactttataatgaccaactgcattattgggtttactaaagaatggaatgaaataaagtatatataaagactttatttaaaaagtcagggttcctataaatgttaaatattaatgttgctcttttatggctgggcatggtggctcacatmtgtaatcccagcaattttggaggccaaggtgggaagatcacttgaagccaggagtttcagaccagcctgggcaacaaagtgagacccccatctctacaaaaaataaaaaaattagctgggtgtggcggcatgtgcctgtgctgctggctactggggaggctaaggtgggaggatcttctgagcccacaagttcgaggctgcagtgagttatgattgtaccactatactctaacctggtcaagacagcaaggccctatctctaaaaataaaaaaatggatattgctgtttgttattttata

SEQ ID NO: 165554 - DNA, 601 bp, Human
tctgtgttcggttgaaaaaaacttgagtataaatgaacccatgcagttgaaacccatgttattcaaggtcaactatattttctctatttgtgttaggaacaaagggaagtacaaaaagtattagtagtcttgaattcaaaaaaatgagtttgaagtctagctttaccacttactacctatggtctgaagcacagcaagctctgactctctaacctactttataatgaccaactgcattattgggtttactaaagaatggaatgaaataaagtatatataaagactttatttaaaaagtcarggttcctataaatgttaaatattaatgttgctcttttatggctgggcatggtggctcacatctgtaatcccagcaattttggaggccaaggtgggaagatcacttgaagccaggagtttcagaccagcctgggcaacaaagtgagacccccatctctacaaaaaataaaaaaattagctgggtgtggcggcatgtgcctgtgctgctggctactggggaggctaaggtgggaggatcttctgagcccacaagttcgaggctgcagtgagttatgattgtaccactatactctaacctggt

SEQ ID NO: 165555 - DNA, 601 bp, Human
catacatacatttgtgtatatatctgtatttttaaactcaggaatattttaagttgcaaagtttggcagagtcacttactttttctactgcaaaagcgtttggatcttggaaattccgtattgttgaatgagggccagacaaagtggtactttttctctgagattcactgaaacacattttaaaagcttttcttttaaccactatatttaacagatttaaagataaatacatatacagacataaattttaagatcaccataacagaacagatacagttgtccctgtatctgcagggggctrgtttcaggacccccaaggatatcaaaatccacatgtactcaagtcctacagtctgcactaggaagcccatgtattcaaaaagtcagcacactgcatataggcaggttttactactaaatttttaatctgtgttcggttgaaaaaaacttgagtataaatgaacccatgcagttgaaacccatgttattcaaggtcaactatattttctctatttgtgttaggaacaaagggaagtacaaaaagtattagtagtcttgaattcaaaaaaatgagtttgaagtctagctttaccacttacta

SEQ ID NO: 165556 - DNA, 601 bp, Human
gactttttatgtagtagcattcccccactccaagaaaatttccaatgacatgctcatttaaaacaaattaaaacaaaactagataggtgtttcctaatcctacttcttagaggtaagaactttggtgaatatattcctaaacattaaaatgatataaaatgaatatacgtatataaatggaaataaaatcatactataaagttccctttttttttgttttgagacagggtgtcactctgtcacccaagctggagtggaatgcagtggcgcaatcacagttcactgcagccttgacctcccragctcaggtgatcctctcacctcagccttctgagtagctgaaactacacatgtgtgccaccacatccagctagtttttatatttttagtagagatggggttttgccatgttgcccaggctggtcttgaactcctgggctcatgcgatccgcccacctcggcctcctaaactgctgggactacaggcatgagttactgtgcctggcccatactataaagttctataatctactttctttacattactctattgtagactgctttataggtccttcaatataaatctattttatccctttta

SEQ ID NO: 165557 - DNA, 601 bp, Human
gggattatagatgtgggccactgtactcagcgtgaataatatgatttaataccagcaaaataattagcagacactcgactatttctgactttttatgtagtagcattcccccactccaagaaaatttccaatgacatgctcatttaaaacaaattaaaacaaaactagataggtgtttcctaatcctacttcttagaggtaagaactttggtgaatatattcctaaacattaaaatgatataaaatgaatatacgtatataaatggaaataaaatcatactataaagttccctttttttttgttttgagacagggtgtcactctgtcacccaagctggagtggaatgcagtggcgcaatcacagttcactgcagccttgacctcccgagctcaggtgatcctctcacctcagccttctgagtagctgaaactacacatgtgtgccaccacatccagctagtttttatatttttagtagagatggggttttgccatgttgcccaggctggtcttgaactcctgggctcatgcgatccgcccacctcggcctcctaaactgctgggactacaggcatgagttactgtgcctggcccatactat

SEQ ID NO: 165558 - DNA, 601 bp, Human
cgtaaaacagacccattaggtttaatactaattgttgatatttaatgaaattttattgtatgtctataatgtaacaaaaagggaaaagagggaagcttgggaaccaacacataaggaaatgtaaataaatgtgccatgagcactatctctgaggaacatacaataaaaaattatcaatatgataggcatatcaatcactaactacatataacacagcacgcaataaatgccacaagagcccctatgaaaaaaggatttttttttttttttttttttttggagacagagtcttactctgtcrcccaggctgaagtgcagtggtgcgatcttggctcactgcaacctctgcctcccagctttagattcttctgtctcagcctcccaagcagctgggattacaggtgcccaccaccatgccaatttttgtatttttagtagatacggggtttcaccatgttggccaggctggtcttgaactcctgacctcgggtgatctgcccgcctcggcctcccaaagtgctgggattacagtcatgagccactgagcccagccataaacaaaggattttaaagacagagatcaattagaaaggattttata

SEQ ID NO: 165559 - DNA, 601 bp, Human
agccaagatcgtaccattgcactccagcctgggcaacgagagtgaaaccctctctcaaaaaaatggaaaaacatacgtaaatttgatttttccactgctctaatatgctaacatttttaagggcctatggaagagattacaagacgtgggggaaaaaaaaaactgaagatctaagaacaaagtcatttattacttggtagttctacacaatagtgtttaatattgtttcccaatctttcatgactatgtcacgctcatgaaaaaacttgagttctaccaagaaagaaagaaaaactttttyttttcccccggaaagatgtttataaacaaatgcctcagcagtttttcctgaaaatgctgtttcacctagacaccttgtgcgtactacactaacactgctggactgctttgttgccctacaagtctgagtttgaatcctgcatctactgcttattggtcctgtgatcatggttatgtattttgtcaatgaaaactaaaagctgtcttagccataacgttcagtcaagttgttgtggcaagaactgctgaattcgctaatcactaaagcggaaaaaaaaggtgtggttttgaaattaaaact

SEQ ID NO: 165560 - DNA, 601 bp, Human
ttaattatactttaagttttagggtacatgtgcacaacgtgcaggtttgttacatatgtatacatgtgtcttaaatacatatgacaaaggggcaattccactggtgcactctttcttgttttgcttctaggggtccgtcccattcttaatctttgccctttcttgtctctttcacataactctaagactcagagttttttaatcttttcttctacttctcacttcttaaccaatatagaagacaaaaataacattttaattttatatatttctcattcaaattaaaaaagaaagatgagcyagttcagttcatattttgcactaaaactaatttaacattccaaagttaaattatttgtgatcaacaaaaggaaaaacatcttaccctattagcaccatctgacattttcatcaccttagcatcattaaatacaacaggtctgaggttggaactataaaaaaataccaaaaatccccaaccccattcataatgcacaccacagttcaggtaagaacaaaaactcaccattatctttattttctttcaaaaacccattaacagcgtgtttgaatttaaaaatagtctcatcatcaggcactt

SEQ ID NO: 165561 - DNA, 601 bp, Human
aacaacaaatctaaaaggatctcagtgtttactgaatcaatttattttctcagtccctactagttctagaagcgagtggagagtgtagtgtcctctttttatcagtgagcctgttatctgtgggaagggattatagcagaggtagccaaaactgattataaacaaggtcccaagcctgctatggcagtgagtactgcaagacttagacagtcagcaccactcaggcagaagaccaacatggagttcagtctatccaactgactacaatcagtataacgtgaacaactaagatttaaaaatrtgttctcatgtattcataaggacctcctagccctcacagaacagatgaagtgctatataaaaatttcacagaaaagagcctggaagcagtgaataggccatcagctgtaccctcatatcttaaaaggtagtatttctgtgacaacagcttatacaaatgggaaagccaaacctctcaagttttaaagttaaagtacaggggaagatctgtgaacaaggtttaacataattaaaagctagtgtccacattaagtgagcgactaggttacaatttgaaattttatcttcaaacccactgatc

SEQ ID NO: 165562 - DNA, 601 bp, Human
aaaagaaagaaaaaagaaggcactcatcatcgccagcctggattactacaacaaactaatctccctacttctatctcaactgatcctccatatggcagatgttatctttctaaaacataagcctggctgggttgtttttgcttaaaaatctcaatttagcatagcatgaagcccaaatttagcatggcatttagaatccttcataaactggtatcaatctgtctttccaaccgatctaagtccacaatgatcctaactatgatttacaagggctgatatgatccacctcccttctgcccarccccaacctctctgatcccgtttctcctgctcttaccctcactcactccactccagccacactcggctctgtaacattcctcaaacatgcctagcatagtcatgcctcagggactttgcacctgctgttccctctgccttaggacattcctccccagacacccaatggcttggttcattacttcctttaaggttctgctcaaatgacatcttcataaagaggccttcctgatcactcacctcttccctcatccctttatcatgttttgttattctccaaagcacttatcaccatatatat

SEQ ID NO: 165563 - DNA, 601 bp, Human
ttatcggccaggcgcggtggctcacgcctataatcccagcactttgggaggctgaggcgggtagatcacagggtcaggagatcaagaccatcctgtctaacatggtgaaaccccatctctactaaaaatacaaaaaattagctgggcatggtggcgggtgcctgtagtcccagctactcaggaggctgaggcaggagaattgcttgaacctgggaggtggaggttgcagtgagccgagatcgcgccattgtactccagcctggatgacagagcgagactctgtctccaaaaaaaaaaaaaacgaagaattcctcatcagtatcataatgtgttttcattaactatagtattaatttctatctcaattctagaaaagggaaaacagagagaggtacctgactgattgttgcaaactttgggtctgggtgtggaaatgtcgaggagctgagtgaccctggatctgatgtagattatacctaggtccttgtttaacaggcttattgtggactggttgcatgagatgtgctgagtcttcaaaatcacttgacctgggtacactggaattccaattccttaaagagaatattttccacacaatatt

SEQ ID NO: 165564 - DNA, 601 bp, Human
agcaagaccagaaaatctcatataattatacaaaagaaaatttggggctgggcgtggtggctcgcacttgtaatcccagcactttgggaggccaaggcgggcggatcacctgaagtcaggagttcaagaccagcctgactaacatggagaaaccccatctctattaaaaatacaaagttagccaggtgtggtggtgggagcctgtaatcccagctactggggaggctgaggcaggagaatcatttgaaaccgggaggtggaggttgcggtgagctgagatcacaccattacactccagccygggcaacaagagcaaaactccatcttacaaaaaaaaataaagaaactttggaaatatgagaaaagaaaaaccccccactgcagagccctcaatcccacttactataattcaattagttagtatttccttttgttcttttccccagcatctttttctgactgttgaatcacagcctattagtttcacttatcataaatgagctaacacttccaatggctttataaaatgttatagtatggatataattatttagctacattctccactgttagaaatatagcagctacaagtttttccaca

SEQ ID NO: 165565 - DNA, 601 bp, Human
gaggtggtcaggttgggggaattaagcgaatattctcttccagggtgagtcctcacactggtctcatgcccatgatgagttgcacaccaaacacaggctgctgacttccctcctgcactagtcagtgaacttgcagacatagggtaacctcacattacagttataatctttccacctcagaaatgctggagagacagaagacataaatggaatggggctgaggaagcttgtgaatccaatgaaggggcatcccaggttttagcctagaagttaaagcctctccctcaccttcaccagtgtyccaatccaggagagagattcaaagaaagtggagaagagaggagataagagaagacacactaacattgtattttctagctcaggaagatttcctgaaggtcagacccaggaatgggggatgagatggaaaacactgggaagaggcagctcctctgtttcttacctgtgcttctcgacaggctcgcacagtggccggggcttgagatggtggagggatttctctcccatgcaaagtaattcatcacatcactgctactccactcccaaccttctccattgggctcggtgccctgtagagtag

SEQ ID NO: 165566 - DNA, 601 bp, Human; identical to SEQ ID NO: 29904

SEQ ID NO: 165567 - DNA, 601 bp, Human; identical to SEQ ID NO: 29905

SEQ ID NO: 165568 - DNA, 601 bp, Human; identical to SEQ ID NO: 29906

SEQ ID NO: 165569 - DNA, 601 bp, Human; identical to SEQ ID NO: 29907

SEQ ID NO: 165570 - DNA, 601 bp, Human; identical to SEQ ID NO: 29908

SEQ ID NO: 165571 - DNA, 601 bp, Human; identical to SEQ ID NO: 29909

SEQ ID NO: 165572 - DNA, 601 bp, Human; identical to SEQ ID NO: 29910

SEQ ID NO: 165573 - DNA, 601 bp, Human; identical to SEQ ID NO: 29911

SEQ ID NO: 165574 - DNA, 601 bp, Human; identical to SEQ ID NO: 29912

SEQ ID NO: 165575 - DNA, 601 bp, Human; identical to SEQ ID NO: 29913

SEQ ID NO: 165576 - DNA, 601 bp, Human; identical to SEQ ID NO: 29914

SEQ ID NO: 165577 - DNA, 601 bp, Human; identical to SEQ ID NO: 29915

SEQ ID NO: 165578 - DNA, 601 bp, Human; identical to SEQ ID NO: 29916

SEQ ID NO: 165579 - DNA, 601 bp, Human; identical to SEQ ID NO: 29917

SEQ ID NO: 165580 - DNA, 601 bp, Human; identical to SEQ ID NO: 29918

SEQ ID NO: 165581 - DNA, 601 bp, Human; identical to SEQ ID NO: 29919

SEQ ID NO: 165582 - DNA, 601 bp, Human; identical to SEQ ID NO: 29920

SEQ ID NO: 165583 - DNA, 601 bp, Human; identical to SEQ ID NO: 29921

SEQ ID NO: 165584 - DNA, 601 bp, Human; identical to SEQ ID NO: 29922

SEQ ID NO: 165585 - DNA, 601 bp, Human; identical to SEQ ID NO: 29923

SEQ ID NO: 165586 - DNA, 601 bp, Human
agagccatgttgaattggccacttttctatgtgaatctatcaaattttgtcatgagagtacattgtagggtgagagagggtggtagtgggaaaaaagggaaaaatgccaagaggaaagatgaggagaaagaagacaaaatgtcatggtttttgttgttgttgttgttgccacacctactaggttctgcccattgatttttttgtttgatattttatttttaaaaaattctgtgccattagattcaagaccttgagtcagacatgctcaacctctgtactgttgacactttggtctgaacarttgtttcttggggagagttctggggactgttttgtccattatgggatgcttagaagcatccctggactccacctgctaaatgtttgtagcatctctttcttctacatgccaagttgtaaccaccaagatgtctctagacattgccagatatccttgaaggaagtgggtcctggtgggcaaaataatgtgcactgagcattactgccctaaagtaaagaaataacccaaaatagggacaagttcaaacaggacagattggagcccatgtactgtggacatagtgaaaagggagtggggttg

SEQ ID NO: 165587 - DNA, 601 bp, Human
ggcaaaataatgtgcactgagcattactgccctaaagtaaagaaataacccaaaatagggacaagttcaaacaggacagattggagcccatgtactgtggacatagtgaaaagggagtggggttgggagtatattacaaagaagaatctgtaaaagggcagaataatcaaacagccttgactgaactggatgttgctgctgaaggtgtttacacacaggcaaacccctgtgtagacagatgaatggctgcatgggtaggtcactgtagggagactcccactttaccacttggctgccctcrctgagtggctggaaaattgagaggtacccaaagagtgataacacatctgtggtttattttccatgaattattttctttccttagtaaagacagtgctttgcttaagagtgcttcttgtcttgatatgaatgctgaattaaatttaagaaaattttgtagattattagtatgctaagaattatagggtagcattatgtacaaatttacctgttcattttctataaaacaatctaggctgatgaaaacacaataaattggatctacagcagacccattaaatacttacatggcatatttgat

SEQ ID NO: 165588 - DNA, 601 bp, Human
tgagtggctggaaaattgagaggtacccaaagagtgataacacatctgtggtttattttccatgaattattttctttccttagtaaagacagtgctttgcttaagagtgcttcttgtcttgatatgaatgctgaattaaatttaagaaaattttgtagattattagtatgctaagaattatagggtagcattatgtacaaatttacctgttcattttctataaaacaatctaggctgatgaaaacacaataaattggatctacagcagacccattaaatacttacatggcatatttgatgrgctcttcaataaaacctgaattataacaaattgccaaacagcttagtagtaagtacacgcttgaccagacccatcttcatagatctcgtttacaaagttgggttgctgcaggaggctgaggaggggtgaaagcacattcagcgatatcatatttatatatatatatacacacacatacagtagctcattcttcactgaatggattatattgaaatgtcatttttgtaaatttgatagctgactcaagtttgtggccatgtgagcgtgactaggttaaaagatctgtgagattctgccaga

SEQ ID NO: 165589 - DNA, 601 bp, Human
tccatgctgctccctctgtcctccctgcaacgttcttcatctcctcctcctcctgctttacatctgtttattgagattcacctttaaaatatagctctagtctcagttggagaccacagaaaactattagtcttttgacatttagtatggtatgtcctcttcagtgtaaatgactgcttacaacaggattgtctgtttttagaggcaagtgtttctataggtacccacagcctagaatggtgttttcagtaacacatttaatacgtaagtattgattaaatgaataccaaaaatgagaackttacactttgtcttttttttctgtagaaaatatgtctaccagcagcctcaggtttgcagctcaagaccaatttctgtgtatcaatgggaaatcatctgattggctttctggcctatgcttccttcagttggactgatttctgttgctagtggaatagagttttatgattggacaggtctgagtgacctgcctatctctctggctggaatatgggggactggagtatgagattgatgtcagaaggaggtggtaggggcagcttattgggaagacaaactattaagtattagagataggaag

SEQ ID NO: 165590 - DNA, 601 bp, Human
tccctctgtcctccctgcaacgttcttcatctcctcctcctcctgctttacatctgtttattgagattcacctttaaaatatagctctagtctcagttggagaccacagaaaactattagtcttttgacatttagtatggtatgtcctcttcagtgtaaatgactgcttacaacaggattgtctgtttttagaggcaagtgtttctataggtacccacagcctagaatggtgttttcagtaacacatttaatacgtaagtattgattaaatgaataccaaaaatgagaactttacactttktcttttttttctgtagaaaatatgtctaccagcagcctcaggtttgcagctcaagaccaatttctgtgtatcaatgggaaatcatctgattggctttctggcctatgcttccttcagttggactgatttctgttgctagtggaatagagttttatgattggacaggtctgagtgacctgcctatctctctggctggaatatgggggactggagtatgagattgatgtcagaaggaggtggtaggggcagcttattgggaagacaaactattaagtattagagataggaaggactatccac

SEQ ID NO: 165591 - DNA, 601 bp, Human
gtctgtttttagaggcaagtgtttctataggtacccacagcctagaatggtgttttcagtaacacatttaatacgtaagtattgattaaatgaataccaaaaatgagaactttacactttgtcttttttttctgtagaaaatatgtctaccagcagcctcaggtttgcagctcaagaccaatttctgtgtatcaatgggaaatcatctgattggctttctggcctatgcttccttcagttggactgatttctgttgctagtggaatagagttttatgattggacaggtctgagtgacctgyctatctctctggctggaatatgggggactggagtatgagattgatgtcagaaggaggtggtaggggcagcttattgggaagacaaactattaagtattagagataggaaggactatccacagtctaagttacttcggcatgactaattttaagtcggaagtgtaggaagaatgagaaagaagcctcatccagtaaagagcccttaaatagataacgtataatttgtctcaatgtcttttttatatgactaaaacctatatactctaagtattgtagaaatctgataagtttttgaagatc

SEQ ID NO: 165592 - DNA, 601 bp, Human
taagtttttgaagatctgtataatttttcctaaaagcaaatgcaaggttttggggctcagaaaacaaacgttactttgcacagtaagcatgtcagtttcccatgttccattcccgctcttggagcaatgtgatgagggcagatggattctgcacatacagtggaggtctgtgctacaggtggggaaccacaccattatgaatctaggagcttatttagaaattggtgctcctcctgagggcaggaaagaaacacttcctctctctttttttgagatgaagttttgttcttgttgcccaggytggagtgcaatggcagtctctgctcactgcaacctctgcctcctgggttcaagtgattctattgcctcagcttcccaagtagctgtgattacaggcggtcgccaccacgcctggctaattttttttttttttttttttgtattttcagtagagatggggtttcaccatgttggccaggctgatctcaaacccctgacctcaggtaatctgcctacctcggcctctcaaagtgctgggattacaggcatgagccaccgcgcctggccacgttttttatgtaaacaaattctgtccaggagg

SEQ ID NO: 165593 - DNA, 601 bp, Human
tttcccatgttccattcccgctcttggagcaatgtgatgagggcagatggattctgcacatacagtggaggtctgtgctacaggtggggaaccacaccattatgaatctaggagcttatttagaaattggtgctcctcctgagggcaggaaagaaacacttcctctctctttttttgagatgaagttttgttcttgttgcccaggctggagtgcaatggcagtctctgctcactgcaacctctgcctcctgggttcaagtgattctattgcctcagcttcccaagtagctgtgattacagrcggtcgccaccacgcctggctaattttttttttttttttttttgtattttcagtagagatggggtttcaccatgttggccaggctgatctcaaacccctgacctcaggtaatctgcctacctcggcctctcaaagtgctgggattacaggcatgagccaccgcgcctggccacgttttttatgtaaacaaattctgtccaggaggtagccaagtggttaaaaacttttggaatataaatgcatggttcctagttttatccctcttttgaaatgtaaacatatctggagaagctgtctata

SEQ ID NO: 165594 - DNA, 601 bp, Human
gtagctgtgattacaggcggtcgccaccacgcctggctaattttttttttttttttttttgtattttcagtagagatggggtttcaccatgttggccaggctgatctcaaacccctgacctcaggtaatctgcctacctcggcctctcaaagtgctgggattacaggcatgagccaccgcgcctggccacgttttttatgtaaacaaattctgtccaggaggtagccaagtggttaaaaacttttggaatataaatgcatggttcctagttttatccctcttttgaaatgtaaacatatccggagaagctgtctataaatctctctccaggttatttcactatcttaggactgttaacctttgaaccaggttaccagtattttcattcagacagggttgaccatgcagaaacatgaaaatatttcctatacactagtgtgtttgtaaatgatgtgttctcccacaattcagacatggtcagctctctcagcataagaggctgaagaaccacctcagaaaatacgaccataaccagatagcttacaatatagaaatgtaaatgattccttctcaaaagaaaagttgcttgaactctctcata

SEQ ID NO: 165595 - DNA, 601 bp, Human
gttttatccctcttttgaaatgtaaacatatctggagaagctgtctataaatctctctccaggttatttcactatcttaggactgttaacctttgaaccaggttaccagtattttcattcagacagggttgaccatgcagaaacatgaaaatatttcctatacactagtgtgtttgtaaatgatgtgttctcccacaattcagacatggtcagctctctcagcataagaggctgaagaaccacctcagaaaatacgaccataaccagatagcttacaatatagaaatgtaaatgattcctyctcaaaagaaaagttgcttgaactctctcataagataaatgcaaattaaaaactacgctgagaaaccattacccatcagaatggcaaaaatccaaaagttctataatatatatactctgttaaggattaggaaaagtcatcttatattttgcttgtagatgtgcaaaatggaggaaatttgacatcttctgtcaacagaacatatttaacatttggaaagcaatctcacttttaaaaatctgttcttcagatgtactggcaaaaaatataaaaacgtatgcacaagattatttattacaa

SEQ ID NO: 165596 - DNA, 601 bp, Human
catccttggagtattccagaaatagttttggtaatgaaaaaatgggaacctttgcatgtagccggagggcctgaaataacaggtgaacaaaagaacaacagaagtactgtatatggccagagtagtctccagatgacctccttgccaaattttaaatttgttttgtagagacaggtcttgctatactggctagagtggtctccaactcctagcctcatgtgattctccccacctcagtctcccaaaatgctgggattacaggcatgagcccatcccacttggctcctggtttgcctttctstattttacctttcctctaattctacctgatttcttccttgtcagtgaagtcccctttctaaccagaccagagaagcccactcttcggtgtacctgttactcttattatctgtgttactcatttggaacctaccatatactgccaagtatttcatactccttgttacccacttttctacttacgtttatatctgtcctagtgtttatatctgtcttctgtccatcttagtacctgaggcatgtgtgtatgtattgactttttgcatgtttttgttaaattttaacctcttaagatctgagt

SEQ ID NO: 165597 - DNA, 601 bp, Human
atactggctagagtggtctccaactcctagcctcatgtgattctccccacctcagtctcccaaaatgctgggattacaggcatgagcccatcccacttggctcctggtttgcctttctctattttacctttcctctaattctacctgatttcttccttgtcagtgaagtcccctttctaaccagaccagagaagcccactcttcggtgtacctgttactcttattatctgtgttactcatttggaacctaccatatactgccaagtatttcatactccttgttacccacttttctacttaygtttatatctgtcctagtgtttatatctgtcttctgtccatcttagtacctgaggcatgtgtgtatgtattgactttttgcatgtttttgttaaattttaacctcttaagatctgagtctacctctccattacctgcagctttaactaagagttgaaactcaaagatgtcattaatataaatgagtaacataatgacacagttaccttattctgggggattaaaccctccttaaatcgcatacttaatgatcaagataagaatcttttaagttatgtgcaataaatttttagcaagcact

SEQ ID NO: 165598 - DNA, 601 bp, Human
ttggaacctaccatatactgccaagtatttcatactccttgttacccacttttctacttacgtttatatctgtcctagtgtttatatctgtcttctgtccatcttagtacctgaggcatgtgtgtatgtattgactttttgcatgtttttgttaaattttaacctcttaagatctgagtctacctctccattacctgcagctttaactaagagttgaaactcaaagatgtcattaatataaatgagtaacataatgacacagttaccttattctgggggattaaaccctccttaaatcgcwtacttaatgatcaagataagaatcttttaagttatgtgcaataaatttttagcaagcactttattacatcttaatgcaatctaagtatttaaacatcacagatgccaaattagactgtatttattaagctaggttttgacaaacactaagctaaataaggcatcatgctcatgctcaatactttattcgttccttaagtttcagaattaaatgtgccatccttttaagttataaaccatttgtgattatttttgaaatgcttattttaaaatagaagaaaactttccaagcaagcatttt

SEQ ID NO: 165599 - DNA, 601 bp, Human
tttttagcaagcactttattacatcttaatgcaatctaagtatttaaacatcacagatgccaaattagactgtatttattaagctaggttttgacaaacactaagctaaataaggcatcatgctcatgctcaatactttattcgttccttaagtttcagaattaaatgtgccatccttttaagttataaaccatttgtgattatttttgaaatgcttattttaaaatagaagaaaactttccaagcaagcattttctttcctcaggaaaaggaatttgtgtctagacaagagcagatggawgctccctgattcttttagggtagttgtcgtgaatggaatttagagagttttttttttttttttttaccccctccttctaggcagtccttcttcatcttttatcaaacaattcatctcatgggttatgtattgccttctggaacttaaatttgatttatgtttgaaatatacatttataattttcccaacatgaatttatggaaatggcagcctttagaaactcccacagaggtaacagatgattgactcggatgaaagaaagtccaagaatgtatgcaggaagaattgggactggccaag

SEQ ID NO: 165600 - DNA, 601 bp, Human
tttttttttttttaccccctccttctaggcagtccttcttcatcttttatcaaacaattcatctcatgggttatgtattgccttctggaacttaaatttgatttatgtttgaaatatacatttataattttcccaacatgaatttatggaaatggcagcctttagaaactcccacagaggtaacagatgattgactcggatgaaagaaagtccaagaatgtatgcaggaagaattgggactggccaagatgatgatagttgtctggagaggtagaaacagctgacaaatagcagcaaatakggagcagattaagccagggtactgttgttcttgctcctggattccaattttcaacttcgaacctgatgtctcaagacagaagagaagctagtatatcattggtctaggcagaggaagattgaaatttagagaaagtatgtaaggtttatttctacattgcctctgctacattttaaaaaagcatttgaagacacttaagatttaaattcaatcaagtgatgtaaattaaataattaaagtggtgtaaatatgagatagaaaggaaatagtttcaagagaatattggatgaaactgggtgg

SEQ ID NO: 165601 - DNA, 601 bp, Human
tcttttatcaaacaattcatctcatgggttatgtattgccttctggaacttaaatttgatttatgtttgaaatatacatttataattttcccaacatgaatttatggaaatggcagcctttagaaactcccacagaggtaacagatgattgactcggatgaaagaaagtccaagaatgtatgcaggaagaattgggactggccaagatgatgatagttgtctggagaggtagaaacagctgacaaatagcagcaaatagggagcagattaagccagggtactgttgttcttgctcctggawtccaattttcaacttcgaacctgatgtctcaagacagaagagaagctagtatatcattggtctaggcagaggaagattgaaatttagagaaagtatgtaaggtttatttctacattgcctctgctacattttaaaaaagcatttgaagacacttaagatttaaattcaatcaagtgatgtaaattaaataattaaagtggtgtaaatatgagatagaaaggaaatagtttcaagagaatattggatgaaactgggtggctgagtagaaactgtgtttctactgggctaggcaagctgagt

SEQ ID NO: 165602 - DNA, 601 bp, Human
aatgtatttgtgttatttaccactcgattcccgattcccggtgcctagagtactgcttagatttgcatataaaatttagtaataaacttgttgaatgtatttctgatctttatgtaaaccctgaagggcaatgatcattatttctgttttatactgagtaaactgaggcttaaattggtttaataacgtgtaaaattaaatatcaagattcatttacacattttcctggaaccaataaatatgcttgaaacgtagatcaagcatcgttgctacaattaaacagaaattttcatgtgtcctsctagctagttttttaccaatatttttacttagggcatagctatttttactgatagttttacttatggcatagcatactacattagttatatatttctgtgtaacaaattacccgcaaatttaacttgccacgtgggcttttctttagagcagcttacaacatggcaactgtcttccatcagagttaagtaaccaagatagtaagaaaacagaagccagcatcatttttcatttcagaagtggcatcccatctttttttgccatattctgttggttagaagtgaattactagttccagctc

SEQ ID NO: 165603 - DNA, 601 bp, Human
gcttgaaacgtagatcaagcatcgttgctacaattaaacagaaattttcatgtgtcctgctagctagttttttaccaatatttttacttagggcatagctatttttactgatagttttacttatggcatagcatactacattagttatatatttctgtgtaacaaattacccgcaaatttaacttgccacgtgggcttttctttagagcagcttacaacatggcaactgtcttccatcagagttaagtaaccaagatagtaagaaaacagaagccagcatcatttttcatttcagaagtgrcatcccatctttttttgccatattctgttggttagaagtgaattactagttccagctcacattcaaggttgaggggattacacaaaggcatgaataccaggagaagaggaatcactgggggccctctcagaggcatctgtcacacatacatatttgcaaatacatgaggataggagagaccataagggtaatgaatggcataactggataaaacagtcctagggtgtgtggacaaatcccacaacatggacttaataaggacatattcaaatgctggtataatagccctattaccttgtg

SEQ ID NO: 165604 - DNA, 601 bp, Human
tctttagcctgtggtgtcagaagtcataaccaagattcgagtgcatgtgtgtaaaattaggggtggaagtgaaagctctgaacagtgtacgaacccttagccaagggctttaatgagattccagccatcctcgtacctcctagggaaggcacacacctataaatacatatggaaatgaaatagtcactatttgcgaagtagacgtatagatccatttgcctagtaggtaatgctcccacccaaacatctctaaaaagattctgagctgaggatttttaaagtcccccgtgtaggggtgaaytgggggaatacttaaagaccttctattaatttatgatcatgacattcgttactaaaatcactaatataaaatggtggccagcttctatgatttgtcatctgttcttaagtggaactaaagggagagatgtgttatggcttcagtttggggtagtttctacttctacattgactgtgaattggaacttcagactcggtcttcttacaactgattatgcttcatggatgtgtggaattgtcaaggcacaccccgtgccttatagatgccagtcagagtcccctttgggcaactttagggccc

SEQ ID NO: 165605 - DNA, 601 bp, Human
taggggtggaagtgaaagctctgaacagtgtacgaacccttagccaagggctttaatgagattccagccatcctcgtacctcctagggaaggcacacacctataaatacatatggaaatgaaatagtcactatttgcgaagtagacgtatagatccatttgcctagtaggtaatgctcccacccaaacatctctaaaaagattctgagctgaggatttttaaagtcccccgtgtaggggtgaattgggggaatacttaaagaccttctattaatttatgatcatgacattcgttactaaaatcactaatataaaatggtggccagcttctatgatttgtcatctgttcttaagtggaactaaagggagagatgtgttatggcttcagtttggggtagtttctacttctacattgactgtgaattggaacttcagactcggtcttcttacaactgattatgcttcatggatgtgtggaattgtcaaggcacaccccgtgccttatagatgccagtcagagtcccctttgggcaactttagggccccagtagttgatatcacactctcttttacccttttttcctctcttctgtcatctaatt

SEQ ID NO: 165606 - DNA, 601 bp, Human
aagtagacgtatagatccatttgcctagtaggtaatgctcccacccaaacatctctaaaaagattctgagctgaggatttttaaagtcccccgtgtaggggtgaattgggggaatacttaaagaccttctattaatttatgatcatgacattcgttactaaaatcactaatataaaatggtggccagcttctatgatttgtcatctgttcttaagtggaactaaagggagagatgtgttatggcttcagtttggggtagtttctacttctacattgactgtgaattggaacttcagactcrgtcttcttacaactgattatgcttcatggatgtgtggaattgtcaaggcacaccccgtgccttatagatgccagtcagagtcccctttgggcaactttagggccccagtagttgatatcacactctcttttacccttttttcctctcttctgtcatctaattagggggcctcctgaataatcccttagcagtgtctgacaggaaccatttttgggaaagaatactttacctgtagaaataacatcaaacatcacttacctggtataggggacactggaatggccccacagtgatcctcca

SEQ ID NO: 165607 - DNA, 601 bp, Human
ctcttctgtcatctaattagggggcctcctgaataatcccttagcagtgtctgacaggaaccatttttgggaaagaatactttacctgtagaaataacatcaaacatcacttacctggtataggggacactggaatggccccacagtgatcctccaaattaatattttctggctccaattactctgatttttccctaatctttaccgaattccaactgttacagtagaggctcagtgactgtctgtgatggggggaggatattgtactaattcctgcacaggaattagctgcaattccatycctgtcgtgatattttatgttatttttagattcctttcaatgctcttttttttattttatgttaacagttactaaactgtttatctctctcgaacaggggctttgtctattttcttttctctatgctccataataaaatttgtgcaagaaacacactcagagtgtgttggatgactgcatcaccacagttgggtgacccctgtgcatgcagatgtgcttgactggccttggcgaactagttgagaatagaattatgaatctttcttgctcaatggtgatgctccttctgaagaagcagag

SEQ ID NO: 165608 - DNA, 601 bp, Human
tgtgaaacagttgacatacagaaataccgatgaactagcctaatacagtatactgagtgctataatggtgtgcgtgtgtgtgtgtgtgtgtgtgtgtgtgtgtgagattaggatgctataaaattacagagaattgtagagaactgtctactttgggttctgaggattaaagaaggcttcacaatggcaattagttctacactggagattgaagattgagtaggagttcacctgggccaaagacgagtatgtacatttcagtatgagagaataaatcattcatggatatgttgctgtgggyccatttcatatttggagatattgaagttaaagtctgtctaactggaacatttgagaatatgtggtaataaggggtgagacagaaagacacaagaaccatataggcagataatagatgctttttgtgtttgtttcttgataaagaggttttatagttctctgtagtatagggaatcattggaatacttaaagcaggggtaaggaccttttatatacctgagggtagcgaggttacctgactcttcatctctgctacctttggttgaccttgcattttgccctttgggttgtcagcagtcct

SEQ ID NO: 165609 - DNA, 601 bp, Human
taaaattacagagaattgtagagaactgtctactttgggttctgaggattaaagaaggcttcacaatggcaattagttctacactggagattgaagattgagtaggagttcacctgggccaaagacgagtatgtacatttcagtatgagagaataaatcattcatggatatgttgctgtgggcccatttcatatttggagatattgaagttaaagtctgtctaactggaacatttgagaatatgtggtaataaggggtgagacagaaagacacaagaaccatataggcagataatagatgmtttttgtgtttgtttcttgataaagaggttttatagttctctgtagtatagggaatcattggaatacttaaagcaggggtaaggaccttttatatacctgagggtagcgaggttacctgactcttcatctctgctacctttggttgaccttgcattttgccctttgggttgtcagcagtcctatttgaatatttaacacaacttctcattcatttaactgactcaccctgtgttctgaaacttcacccctgacgtctctcaggagaatttattccagaactttctcacctctggtttagg

SEQ ID NO: 165610 - DNA, 601 bp, Human
gattggtctcagagaaagagtttcttaggggtcagacccagaaaaacactgacttatggtaaggaaaaaaatagatgtcttgtcagttacagtaaatataatgaattgaatgagttcgagttttatgttttactggccaaagaatataataagatggtttaaatattaaggctcaattgcactctgagcctctattttaaaaataaagaacttgtaccctctcccctatcgtttttttcttccttgaaaggtcgatggtagttctgttccaatctcttcataaaaattcattgtttctgcmacttctgacaaccccaggtcaataacactgttgtttataccaaaatcctaccatccaaatctcactagagagataatgtatgccatgctggtgcaaatagaatcctcttctccaaactgtatgtcacagcattactagatgtattctgagttgcagagcatcccctatgaagtccatttaggttttagctttctcctctcacccttgcgggaagtatcaggccaggaggtggttttagcgagatggcaaaaaccgcatttatttttgcaccaacctaatagcatgtcaccttctacgttg

SEQ ID NO: 165611 - DNA, 601 bp, Human
ggaagtatcaggccaggaggtggttttagcgagatggcaaaaaccgcatttatttttgcaccaacctaatagcatgtcaccttctacgttgtcctcctccccatctcttcctcagggtgaccttgccacaaacaaagcaacaccataacctttttcacccctttatattcgagaaaggtcttcatgcaaatagaggtgtgttcatgcaggttggggtctgagcggtgggcattttcccactcaacttcttagttggcagttactaaggcagaatattaagtgtttgatcacagtcataatktctgagggacttcctcacttaatgatattgttcagatcggtttctatcatgttgtgggccatgtgatagaactttattttttcagagcccagttctataagaagtacaaccttgagaataatttgatttctttttaaacatgtgaattatgaaaagattcaaagatacaaaaagaacaaagactaataaaacaaatgtctctccttccatctcaaaggtaactactatatttaaagtggtatatatccttttagaacatgtaagaacatgtacaaatgtatatgtttaaataatgcacag

SEQ ID NO: 165612 - DNA, 601 bp, Human
ggccatgtgatagaactttattttttcagagcccagttctataagaagtacaaccttgagaataatttgatttctttttaaacatgtgaattatgaaaagattcaaagatacaaaaagaacaaagactaataaaacaaatgtctctccttccatctcaaaggtaactactatatttaaagtggtatatatccttttagaacatgtaagaacatgtacaaatgtatatgtttaaataatgcacagttttcatttgtgtatttaaaaatttttcacaaacgatgtttcttttcctactcacaygatattgtttttcccactcgaactttgacctcagggcttattcactttaatatattgactgtcccctgactcacatccctaagtctgttttatcccacccagatgtactgtctgtggatctgcagttagcatatcaaagtggttcctgagttggaggattcagaatagggctggggtagagcctgtagacagagctcccttaaagcaattattttcattctcaggttttgtataattttcttcttaactctttgaatatataacctagcaggaaacaactgtctctatggttatagagac

SEQ ID NO: 165613 - DNA, 601 bp, Human
ctctccttccatctcaaaggtaactactatatttaaagtggtatatatccttttagaacatgtaagaacatgtacaaatgtatatgtttaaataatgcacagttttcatttgtgtatttaaaaatttttcacaaacgatgtttcttttcctactcacacgatattgtttttcccactcgaactttgacctcagggcttattcactttaatatattgactgtcccctgactcacatccctaagtctgttttatcccacccagatgtactgtctgtggatctgcagttagcatatcaaagtgsttcctgagttggaggattcagaatagggctggggtagagcctgtagacagagctcccttaaagcaattattttcattctcaggttttgtataattttcttcttaactctttgaatatataacctagcaggaaacaactgtctctatggttatagagacacaaaaacatttttgtgactccaatgtacaattacttacccctcctaatcagcatctctttagaagttaatatttggccaagcccctagagaatgccccaaatcacagggagtggattttactagattttgtcaaagcactt

SEQ ID NO: 165614 - DNA, 601 bp, Human
tataactcagtttaagaaagagggaacttgtaattatatttaagaagatacttattctcaaattctaatatgtacaaaaataatttcatgctcactattgagtcatttaaaaaagtttattcccaacacgaataactcaaatagtctgagtttaatgcagtggtttttagaaatatagttttatttgattcatatttgtggcagtacagcttaatatttcccaaattcttttatctaaatatagcttaaaagcccaaatgaaaaattcaagtaatatagagaaccaattatagtaattcayccatagaaggagatttccccatgcatgctgtggtttcggtaatttctactaaagtgtgggcacacagttttcctctaaccctgctgtctccccctccttttttaagtctgtcttttcctggtagaaatacatttttccaggaatgttttatcttgaatactctgaccctacagagtaaagtaatttagcagaatttctcacagagggattaaaatggatattaaagtatccacagaggatgaaagtgagtataaagaggaatcaggcatgaaagttcaggaatggaaatagatgaatgat

SEQ ID NO: 165615 - DNA, 601 bp, Human
gaacttgtaattatatttaagaagatacttattctcaaattctaatatgtacaaaaataatttcatgctcactattgagtcatttaaaaaagtttattcccaacacgaataactcaaatagtctgagtttaatgcagtggtttttagaaatatagttttatttgattcatatttgtggcagtacagcttaatatttcccaaattcttttatctaaatatagcttaaaagcccaaatgaaaaattcaagtaatatagagaaccaattatagtaattcatccatagaaggagatttccccatrcatgctgtggtttcggtaatttctactaaagtgtgggcacacagttttcctctaaccctgctgtctccccctccttttttaagtctgtcttttcctggtagaaatacatttttccaggaatgttttatcttgaatactctgaccctacagagtaaagtaatttagcagaatttctcacagagggattaaaatggatattaaagtatccacagaggatgaaagtgagtataaagaggaatcaggcatgaaagttcaggaatggaaatagatgaatgatgtttctattttatcatccttgta

SEQ ID NO: 165616 - DNA, 601 bp, Human
ttaagaagatacttattctcaaattctaatatgtacaaaaataatttcatgctcactattgagtcatttaaaaaagtttattcccaacacgaataactcaaatagtctgagtttaatgcagtggtttttagaaatatagttttatttgattcatatttgtggcagtacagcttaatatttcccaaattcttttatctaaatatagcttaaaagcccaaatgaaaaattcaagtaatatagagaaccaattatagtaattcatccatagaaggagatttccccatgcatgctgtggtttcgrtaatttctactaaagtgtgggcacacagttttcctctaaccctgctgtctccccctccttttttaagtctgtcttttcctggtagaaatacatttttccaggaatgttttatcttgaatactctgaccctacagagtaaagtaatttagcagaatttctcacagagggattaaaatggatattaaagtatccacagaggatgaaagtgagtataaagaggaatcaggcatgaaagttcaggaatggaaatagatgaatgatgtttctattttatcatccttgtaaataaaacgaatatgc

SEQ ID NO: 165617 - DNA, 601 bp, Human
aaagtatccacagaggatgaaagtgagtataaagaggaatcaggcatgaaagttcaggaatggaaatagatgaatgatgtttctattttatcatccttgtaaataaaacgaatatgcttttggctttcatttactatacaaattgattgttacaggataaaagctgagaaaattgaattataatttttgagaatcagtgaatcagcagcatcttttaagaagttagtggaggtgttccagacgctccgctgagtttactttccactaatctctagggtgtgtgcaggatccctgtgaaaakaacgaagtgtcagcattttagaaatttatatacgtatgctctttcacatccgggtggtcctggtaagatggaacactttatctttgagcccattggtcttctctttccataggacattctgctgaaatgtcccgtgtctgtctccctcttttctattacacactccttccccatcttcccttgctccaccctcccctcccccatgtctcaagtccagcatttctgacaaaagtgggaagggttgtatcatttcatccacatttgattgtgaagccatttgggttaaggtctgctactcac

SEQ ID NO: 165618 - DNA, 601 bp, Human
gaagccatttgggttaaggtctgctactcaccagctatgactgtaacatccgatattagttaaatatttattgatacttccaaagggccagattccacccaaaacttttttgcattttcccactgaatcacgaagtagaattttattacattttatagacaaagaaacaggttaaaacgtggccaaggatttacagtaaccagtaaccagcagcaaccagcagaaatgcaactcagtttggggttagggtaacatgaaaactatattcacacactacaccacactactgtgggcaggtttyaaaaactttgtcttttgcaaaccatcaccatgcatagaataacaattgggaaagtttcctttccctgctcctgaggtaactgtcataaagactactaaattgggctcacttcaaactggacagatgagtgtcttgctccacttaacttttagaatgcccgaggacctgccacttcgcccaagagctggaataagaggtagtgagagagaaattgcctaatcctctgctttttatttttaacccagtgatgccacgcttcgctgaacaagtagaggttgccattgaagccctgagtgccaa

SEQ ID NO: 165619 - DNA, 601 bp, Human
gggttaaggtctgctactcaccagctatgactgtaacatccgatattagttaaatatttattgatacttccaaagggccagattccacccaaaacttttttgcattttcccactgaatcacgaagtagaattttattacattttatagacaaagaaacaggttaaaacgtggccaaggatttacagtaaccagtaaccagcagcaaccagcagaaatgcaactcagtttggggttagggtaacatgaaaactatattcacacactacaccacactactgtgggcaggttttaaaaactttstcttttgcaaaccatcaccatgcatagaataacaattgggaaagtttcctttccctgctcctgaggtaactgtcataaagactactaaattgggctcacttcaaactggacagatgagtgtcttgctccacttaacttttagaatgcccgaggacctgccacttcgcccaagagctggaataagaggtagtgagagagaaattgcctaatcctctgctttttatttttaacccagtgatgccacgcttcgctgaacaagtagaggttgccattgaagccctgagtgccaacgttcctcaa

SEQ ID NO: 165620 - DNA, 601 bp, Human; identical to SEQ ID NO: 29924

SEQ ID NO: 165621 - DNA, 601 bp, Human; identical to SEQ ID NO: 29925

SEQ ID NO: 165622 - DNA, 601 bp, Human; identical to SEQ ID NO: 29926

SEQ ID NO: 165623 - DNA, 601 bp, Human; identical to SEQ ID NO: 29927

SEQ ID NO: 165624 - DNA, 601 bp, Human; identical to SEQ ID NO: 29928

SEQ ID NO: 165625 - DNA, 601 bp, Human; identical to SEQ ID NO: 29929

SEQ ID NO: 165626 - DNA, 601 bp, Human; identical to SEQ ID NO: 29930

SEQ ID NO: 165627 - DNA, 601 bp, Human; identical to SEQ ID NO: 29931

SEQ ID NO: 165628 - DNA, 601 bp, Human; identical to SEQ ID NO: 29932

SEQ ID NO: 165629 - DNA, 601 bp, Human; identical to SEQ ID NO: 29933

SEQ ID NO: 165630 - DNA, 601 bp, Human; identical to SEQ ID NO: 29934

SEQ ID NO: 165631 - DNA, 601 bp, Human; identical to SEQ ID NO: 29935

SEQ ID NO: 165632 - DNA, 601 bp, Human; identical to SEQ ID NO: 29936

SEQ ID NO: 165633 - DNA, 601 bp, Human; identical to SEQ ID NO: 29937

SEQ ID NO: 165634 - DNA, 601 bp, Human; identical to SEQ ID NO: 29938

SEQ ID NO: 165635 - DNA, 601 bp, Human; identical to SEQ ID NO: 29939

SEQ ID NO: 165636 - DNA, 601 bp, Human; identical to SEQ ID NO: 29940

SEQ ID NO: 165637 - DNA, 601 bp, Human; identical to SEQ ID NO: 29941

SEQ ID NO: 165638 - DNA, 601 bp, Human; identical to SEQ ID NO: 29942

SEQ ID NO: 165639 - DNA, 601 bp, Human; identical to SEQ ID NO: 29943

SEQ ID NO: 165640 - DNA, 601 bp, Human; identical to SEQ ID NO: 29944

SEQ ID NO: 165641 - DNA, 601 bp, Human; identical to SEQ ID NO: 29945

SEQ ID NO: 165642 - DNA, 601 bp, Human; identical to SEQ ID NO: 29946

SEQ ID NO: 165643 - DNA, 601 bp, Human; identical to SEQ ID NO: 29947

SEQ ID NO: 165644 - DNA, 601 bp, Human; identical to SEQ ID NO: 29948

SEQ ID NO: 165645 - DNA, 601 bp, Human; identical to SEQ ID NO: 29949

SEQ ID NO: 165646 - DNA, 601 bp, Human; identical to SEQ ID NO: 29950

SEQ ID NO: 165647 - DNA, 601 bp, Human; identical to SEQ ID NO: 29951

SEQ ID NO: 165648 - DNA, 601 bp, Human; identical to SEQ ID NO: 29952

SEQ ID NO: 165649 - DNA, 601 bp, Human; identical to SEQ ID NO: 29953

SEQ ID NO: 165650 - DNA, 601 bp, Human; identical to SEQ ID NO: 29954

SEQ ID NO: 165651 - DNA, 601 bp, Human; identical to SEQ ID NO: 29955

SEQ ID NO: 165652 - DNA, 601 bp, Human; identical to SEQ ID NO: 29956

SEQ ID NO: 165653 - DNA, 601 bp, Human; identical to SEQ ID NO: 29957

SEQ ID NO: 165654 - DNA, 601 bp, Human; identical to SEQ ID NO: 29958

SEQ ID NO: 165655 - DNA, 601 bp, Human; identical to SEQ ID NO: 29959

SEQ ID NO: 165656 - DNA, 601 bp, Human; identical to SEQ ID NO: 29960

SEQ ID NO: 165657 - DNA, 601 bp, Human
caaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaaggtgaggcccagagccagggagctgaagattttttcattaaacccagaagtgtagcagtgtgtattagcatgtgaaagcctgctgaaaaattaaaatataccaacgcaaggtggtggtattataaatttacatgtataagtcaaaatgatctgsacttaattcctagcagataggtatatctttttggtcaaggagaatagattcaatgttgtaattattgttgttataattatctaccctaaggcagtcataaaatcaaaccccgagggacgggtgactcatctttggtctgtgctattttgcaatatgcttaagtattattctgaagataaagtgaatgatttgttaatatacctttggaaaaatatgtacctctgtgtgtgtgtgtgtgtgtgtgtgtgtgtgtgtgtgtgtgtgtgcgcgcgcgcgcatgtatacatatagtatgttgta

SEQ ID NO: 165658 - DNA, 601 bp, Human
ataaatttacatgtataagtcaaaatgatctgcacttaattcctagcagataggtatatctttttggtcaaggagaatagattcaatgttgtaattattgttgttataattatctaccctaaggcagtcataaaatcaaaccccgagggacgggtgactcatctttggtctgtgctattttgcaatatgcttaagtattattctgaagataaagtgaatgatttgttaatatacctttggaaaaatatgtacctctgtgtgtgtgtgtgtgtgtgtgtgtgtgtgtgtgtgtgtgtgtgctcgcgcgcgcatgtatacatatagtatgttgtaatattagcttgtgatctagcattaatttaagctcacattttattcttacatattaagaatcagatacaacaatctaagattccattgttttcacagagaaattaaagttgtataagatttatttcctttagctctgagctagtacctttgacaaatcaagtgaccagtcagaattttgtcaggagacttttcttcaacaagggttagtgctcttttctatcattgcattttggtctcttctttaaaagaagatgatatctctgccctt

SEQ ID NO: 165659 - DNA, 601 bp, Human
catgtataagtcaaaatgatctgcacttaattcctagcagataggtatatctttttggtcaaggagaatagattcaatgttgtaattattgttgttataattatctaccctaaggcagtcataaaatcaaaccccgagggacgggtgactcatctttggtctgtgctattttgcaatatgcttaagtattattctgaagataaagtgaatgatttgttaatatacctttggaaaaatatgtacctctgtgtgtgtgtgtgtgtgtgtgtgtgtgtgtgtgtgtgtgtgtgcgcgcgcgcggatgtatacatatagtatgttgtaatattagcttgtgatctagcattaatttaagctcacattttattcttacatattaagaatcagatacaacaatctaagattccattgttttcacagagaaattaaagttgtataagatttatttcctttagctctgagctagtacctttgacaaatcaagtgaccagtcagaattttgtcaggagacttttcttcaacaagggttagtgctcttttctatcattgcattttggtctcttctttaaaagaagatgatatctctgccctttcaacacaa

SEQ ID NO: 165660 - DNA, 601 bp, Human
ccctaaggcagtcataaaatcaaaccccgagggacgggtgactcatctttggtctgtgctattttgcaatatgcttaagtattattctgaagataaagtgaatgatttgttaatatacctttggaaaaatatgtacctctgtgtgtgtgtgtgtgtgtgtgtgtgtgtgtgtgtgtgtgtgtgcgcgcgcgcgcatgtatacatatagtatgttgtaatattagcttgtgatctagcattaatttaagctcacattttattcttacatattaagaatcagatacaacaatctaagattccrttgttttcacagagaaattaaagttgtataagatttatttcctttagctctgagctagtacctttgacaaatcaagtgaccagtcagaattttgtcaggagacttttcttcaacaagggttagtgctcttttctatcattgcattttggtctcttctttaaaagaagatgatatctctgccctttcaacacaaaggacaaaccaagggagagcaaaactcagtaggaacctccctgaattttgagtcagaatatcaggtgatttgggggcaagtctcttactctctatttgcgaaatggt

SEQ ID NO: 165661 - DNA, 601 bp, Human
aagatatatttgaggggtcttgttacatggtgttaaataagacacatgtctgttagtcaaagtatagttttaaaagtgagaagaaggtgtcttcagtttcatagggatttcatatcattatgctgatttaaataatgaaatgtctagggagctactagttacaatttttcccactgcatgatgagtcgttttgtgttctttttgttagggcaaagggaggagtatagtaatgaatgactggagaaccagagtagactgtgcgtttgaaatgcaacacaggaagttgaggcttcattgctgsctccatctgcacagcctgtttttttttttttttttttttgcaaacagacagctgactagtgcctttctttgtggcctctcacctaagttcactatatttgaccttatacattgttattattgcccttccacttgcatattccacttcaaggaggaataattttagctccataactctaaacattcttaagtaccattttctcttatttaaagaatggatgtagctgattaggaattgaaacttggccactctccataatgtgtatgtgtaaagggcatgtgggtacacaataccctggca

SEQ ID NO: 165662 - DNA, 601 bp, Human
ttaccaccctccatctccagaacatgttcatcttcctcaacagatactctgtacttactgaatgtaaactccccatctgccttccatttctatgaatttgactaatacaggtatctcacatcagttgagtcacacaatatttgtccttttgtgactggcttatttcatttagcataatgtcttcaaagttcatgcatatattgtagcatatactcaaatgcgtttccttttaaaggtttaataatgttccattgaatgcatgtaccacccacattttctttatccactcatctcttaatargcacttgggttgcttccaccttttggctattatgaataatgctgcactgtacatgagtgtataagtatgtaagttcctgctttcatttcttttaagtgtatacccagaagtggaattgcaggatcatatagtaattcttttaaatgtttgaggaatcacaatattatttttcacagtggctgcaccattttacattcccaccagcaatacacaagtgttcaaatttttccacaatggtcaaatttctccacatccttgccaaaacttgttttctgtttttttcttgatagtagccatcct

SEQ ID NO: 165663 - DNA, 601 bp, Human
ttatgtaagcaaaaggaaatgagtaactttggtcccctacctccagaaatggcacaactattttttttctatttcccttctcttctgttcatgatgtggggaaactgggtcatgtcactaactttgtgctcatttaaagaaacctgggccttgaaactttcttagaagggtgttgcatcatgctcagaacacatatgagatattcaggatttcccagatgattcaaataattttctttattttacacatgactttaactgcattttagtagttcaaaattttttttaatgtttatttattwttatactttttagggtacacgtgcacaatgtgccgattagttacatatgtatacatgtgccatgctggtgtgctgcacccattaactcgtcatttagcattaggtatatctcctaatgctatccctcccccctccccccaccccaagtagttcaaatttttatgaatatttagacaatagaatttggtagttgacaatttttctcatgttatttttctgggtatttttgcattctgtgtttatattttatagtaatacatttacttatacagaatttaaagataaaaggtaataaaattt

SEQ ID NO: 165664 - DNA, 601 bp, Human
catgatgtggggaaactgggtcatgtcactaactttgtgctcatttaaagaaacctgggccttgaaactttcttagaagggtgttgcatcatgctcagaacacatatgagatattcaggatttcccagatgattcaaataattttctttattttacacatgactttaactgcattttagtagttcaaaattttttttaatgtttatttattattatactttttagggtacacgtgcacaatgtgccgattagttacatatgtatacatgtgccatgctggtgtgctgcacccattaactcrtcatttagcattaggtatatctcctaatgctatccctcccccctccccccaccccaagtagttcaaatttttatgaatatttagacaatagaatttggtagttgacaatttttctcatgttatttttctgggtatttttgcattctgtgtttatattttatagtaatacatttacttatacagaatttaaagataaaaggtaataaaatttaaaaataaaattgttcgggaaaggattaacttttcaatgtattgtccagggacaattggttactggttggaaaaataaagagtgtgatt

SEQ ID NO: 165665 - DNA, 601 bp, Human
atttaaagaaacctgggccttgaaactttcttagaagggtgttgcatcatgctcagaacacatatgagatattcaggatttcccagatgattcaaataattttctttattttacacatgactttaactgcattttagtagttcaaaattttttttaatgtttatttattattatactttttagggtacacgtgcacaatgtgccgattagttacatatgtatacatgtgccatgctggtgtgctgcacccattaactcgtcatttagcattaggtatatctcctaatgctatccctccccmctccccccaccccaagtagttcaaatttttatgaatatttagacaatagaatttggtagttgacaatttttctcatgttatttttctgggtatttttgcattctgtgtttatattttatagtaatacatttacttatacagaatttaaagataaaaggtaataaaatttaaaaataaaattgttcgggaaaggattaacttttcaatgtattgtccagggacaattggttactggttggaaaaataaagagtgtgattcctatctcaccctatacaaaaggcataaactgtaggtggatt

SEQ ID NO: 165666 - DNA, 601 bp, Human
tttatttattattatactttttagggtacacgtgcacaatgtgccgattagttacatatgtatacatgtgccatgctggtgtgctgcacccattaactcgtcatttagcattaggtatatctcctaatgctatccctcccccctccccccaccccaagtagttcaaatttttatgaatatttagacaatagaatttggtagttgacaatttttctcatgttatttttctgggtatttttgcattctgtgtttatattttatagtaatacatttacttatacagaatttaaagataaaaggkaataaaatttaaaaataaaattgttcgggaaaggattaacttttcaatgtattgtccagggacaattggttactggttggaaaaataaagagtgtgattcctatctcaccctatacaaaaggcataaactgtaggtggatttaatatctaaatataaaaaggaaactttaaaattttagaataaaatggaaggatattttcaattaccttgggataaggaagagcttcttaaaggaatgtatgaaaagcacaaacggtagtgtaaatgatgaatacatttgactacaataaaattaaaat

SEQ ID NO: 165667 - DNA, 601 bp, Human
tttatagtaatacatttacttatacagaatttaaagataaaaggtaataaaatttaaaaataaaattgttcgggaaaggattaacttttcaatgtattgtccagggacaattggttactggttggaaaaataaagagtgtgattcctatctcaccctatacaaaaggcataaactgtaggtggatttaatatctaaatataaaaaggaaactttaaaattttagaataaaatggaaggatattttcaattaccttgggataaggaagagcttcttaaaggaatgtatgaaaagcacaaacrgtagtgtaaatgatgaatacatttgactacaataaaattaaaatttatattttaaaaactgtaaaaaaaagaaacctaacatatagaccaagactaggagtaatttgcagtataacaaaagatcagaatccaaaatatctgaagagcttagataagcaatttagaaagagtcaatagaaacatatgcaaaagatttgaaaagacaactcagagaaaatatataaatcattaataatgatcaataaatgatgaagagactcagtctcctctgtcataacagaaatgaaaattattttttta

SEQ ID NO: 165668 - DNA, 601 bp, Human
taaaatttaaaaataaaattgttcgggaaaggattaacttttcaatgtattgtccagggacaattggttactggttggaaaaataaagagtgtgattcctatctcaccctatacaaaaggcataaactgtaggtggatttaatatctaaatataaaaaggaaactttaaaattttagaataaaatggaaggatattttcaattaccttgggataaggaagagcttcttaaaggaatgtatgaaaagcacaaacggtagtgtaaatgatgaatacatttgactacaataaaattaaaatttrtattttaaaaactgtaaaaaaaagaaacctaacatatagaccaagactaggagtaatttgcagtataacaaaagatcagaatccaaaatatctgaagagcttagataagcaatttagaaagagtcaatagaaacatatgcaaaagatttgaaaagacaactcagagaaaatatataaatcattaataatgatcaataaatgatgaagagactcagtctcctctgtcataacagaaatgaaaattatttttttaataaccatcagcttgacaagaaaaagtaaatacattttaacatctaa

SEQ ID NO: 165669 - DNA, 601 bp, Human
acttgtacaactatcacccagctcaagaaaccttcataaaccttttctaagtcccaatacctttattctcgactagttgtaactattaccttgagctttttcaagatctgatgacggtctacaggggaaaaagccctgaactttgtagcatttgctgatgtccaggaagtaaatattcccattatggcagatttcaagctcccaacatttcaactggcttgcccagttcctaaaaacctaacaaataattctcgtatgtataagcctactccagcactcatgtcaattctgtcatttcttygggttttttcttctttttgtgtgtgtgtgtgtaccacctaagtgagcatctttaaatagttttgttttagttgcttctgggaatatcaatattatgtaactgaatgaaattactttccttctgatattctggaagagtttaaatagcattgagattatcttctctttaaaggtttagttaactcctgtaagaaaccacctggatttaatgacttttttctttctttcttttttttttttttttttgatgagttctatctgacaactttgtttcttccatggaaatcagactgttttgatt

SEQ ID NO: 165670 - DNA, 601 bp, Human
ctcaagaaaccttcataaaccttttctaagtcccaatacctttattctcgactagttgtaactattaccttgagctttttcaagatctgatgacggtctacaggggaaaaagccctgaactttgtagcatttgctgatgtccaggaagtaaatattcccattatggcagatttcaagctcccaacatttcaactggcttgcccagttcctaaaaacctaacaaataattctcgtatgtataagcctactccagcactcatgtcaattctgtcatttcttcgggttttttcttctttttgtstgtgtgtgtgtaccacctaagtgagcatctttaaatagttttgttttagttgcttctgggaatatcaatattatgtaactgaatgaaattactttccttctgatattctggaagagtttaaatagcattgagattatcttctctttaaaggtttagttaactcctgtaagaaaccacctggatttaatgacttttttctttctttcttttttttttttttttttgatgagttctatctgacaactttgtttcttccatggaaatcagactgttttgatttttcggaatctcctttctggt

SEQ ID NO: 165671 - DNA, 601 bp, Human
tttttcttctttttgtgtgtgtgtgtgtaccacctaagtgagcatctttaaatagttttgttttagttgcttctgggaatatcaatattatgtaactgaatgaaattactttccttctgatattctggaagagtttaaatagcattgagattatcttctctttaaaggtttagttaactcctgtaagaaaccacctggatttaatgacttttttctttctttcttttttttttttttttttgatgagttctatctgacaactttgtttcttccatggaaatcagactgttttgatttttcrgaatctcctttctggtctgttttgataatttatattctcctagaaacttatttcatctgttttcacatttacttacatatatttgagaaagcagctttgtgatacatttttttgttttctaaggttattgctgtcttatcttttttacttttggatatttttctcctattatttcttgatagtgttctaaatatattttctatatctttttggtttagagctagttttaggatttatccataatttctagtgttttgttttctgacacattaatatctgtttgtaattttattagttttt

SEQ ID NO: 165672 - DNA, 601 bp, Human
agttaactcctgtaagaaaccacctggatttaatgacttttttctttctttcttttttttttttttttttgatgagttctatctgacaactttgtttcttccatggaaatcagactgttttgatttttcggaatctcctttctggtctgttttgataatttatattctcctagaaacttatttcatctgttttcacatttacttacatatatttgagaaagcagctttgtgatacatttttttgttttctaaggttattgctgtcttatcttttttacttttggatatttttctcctattwtttcttgatagtgttctaaatatattttctatatctttttggtttagagctagttttaggatttatccataatttctagtgttttgttttctgacacattaatatctgtttgtaattttattagtttttttccaacctcttctttctgaattcttgagccatctatttagttagtgttttttgtaacttcgtgtgtattaatgtatgtagttaaggctacttgtttttctctgagcacgttactttagctgttaagaatgaatcatatttagaaaaaaagtgtactaaattatgattcag

SEQ ID NO: 165673 - DNA, 601 bp, Human
taagaaaccacctggatttaatgacttttttctttctttcttttttttttttttttttgatgagttctatctgacaactttgtttcttccatggaaatcagactgttttgatttttcggaatctcctttctggtctgttttgataatttatattctcctagaaacttatttcatctgttttcacatttacttacatatatttgagaaagcagctttgtgatacatttttttgttttctaaggttattgctgtcttatcttttttacttttggatatttttctcctattatttcttgatagygttctaaatatattttctatatctttttggtttagagctagttttaggatttatccataatttctagtgttttgttttctgacacattaatatctgtttgtaattttattagtttttttccaacctcttctttctgaattcttgagccatctatttagttagtgttttttgtaacttcgtgtgtattaatgtatgtagttaaggctacttgtttttctctgagcacgttactttagctgttaagaatgaatcatatttagaaaaaaagtgtactaaattatgattcaggacacacagact

SEQ ID NO: 165674 - DNA, 601 bp, Human
tatgcatttattttggctagagtctgcttaaaattttgaattttttacttatgacctgtataagcttggataagttactagatcattttgggctcattttattttctaaatgggagtgatgatacctactttgtagagttgttataaagtcagaatgaggtagtctgtacaacagcttttggtacacggtaagcaactataaaattttcatttctcttgtgatgatcttttataactggccattgtttagaaatatagaacttaatgtaaaagataaaatgtgaacatgcacataaaaatrtgggaaaatatttccaaaaacgactactaatatagaaactggagttaagcaggaaaatattcaaaattcgactaatgtggccagtgccaaataaaatacaacactagactcctggacaaaggatatggtaggttggtctctttcccgtcattaagtggatttctaattatgttgtatatgttgtttcagaggcaaaggcccattgaaaaatacatctgatgtcattaatgctgccaagaaaattgccgaagcaggttctcgaatggacaaattagctcgtgctgtggctgatcaggtaat

SEQ ID NO: 165675 - DNA, 601 bp, Human; identical to SEQ ID NO: 29961

SEQ ID NO: 165676 - DNA, 601 bp, Human; identical to SEQ ID NO: 29962

SEQ ID NO: 165677 - DNA, 601 bp, Human; identical to SEQ ID NO: 29963

SEQ ID NO: 165678 - DNA, 601 bp, Human
gaatatttagaagaatcacaatttcttggcaagatttccaaatatgtgttgaggttcttcaccttggcttcttctcctccctcaacccctttctctcaacacagggtgccatttgttgcaaattatttgcaagtccagaaatgtggctctgacaccttagttcttttcccagtcagacatgatgatgctaccatttcaagtgagtaattaccaggcacgtaatattatcagcgtggtgaataccttatgaaaatcagactagtcacaaagctcaggtcttcctgaagccatttttggaaayttagaagtttggccatttggtaaaaacacgtgaacaaatcattcttgaacccaactgtttttgttcccatattgtttgagttgcagaaaacatagctgggaaaagaactgatctggcttgcatagagacaccatctggaaagcctgtttcatgcagtcccacctagagcccagtaaattggctattttgtgcctcttcccaaagcacagtcacctctttgcatttccaaaatgatcctgcttcaacattcttcagcaaccaagagcaatctgtcttgcaatgtgtcctttctgccaagct

SEQ ID NO: 165679 - DNA, 601 bp, Human
acttgcactgttggcttttatagaggtgtttgagattgggaacaccatcaagaagcctgttcccttctttgagtcttgttggtaaagttcataaatccttgcatgggagaaggcttcttttagaagaatgttgttcaacttgataattattctgaggcaaatgcattataaatatttgctatatatgctctgtcatgggcctgctcttggcttcctcatgatttattccaagcttgattgctgtttggtgccacacctacatctatagtctgctgtctttgccaattctgcctccatcttwttcttcatgctccttcactgatggccaatggagaaaaaaaatgaatatgcttactgtgcaaaatagccacaaatgactgctttcaaagttctgaaagagtcaagaatgtgagaccccatacacacacattttcaatgattttgccaagaaaattacacccatttattctgtcatgtggcatggcaaagttgctgttttttttcagaagaagccatcatagtttaatgtacaatcaaaaaagaaatacttaaatcttctttcttttttccctgtgtttatacacatgggattcaaagccac

SEQ ID NO: 165680 - DNA, 601 bp, Human
ttgtcttgtgtctgcttttggcttgagaggtggggacagataattcaacaggtcacggaggagaatggatacaaaagctctccaggcatcatgacggcgatctggagaaataaagcagtccaggatgtgtttctgtgtatgctcatccacacaactgctatctaagaaataccattggtttcctacctggcaattaggtttttttttttgtcattggcttaaacctgtctcaaccaaaaagtgacattcttattaaatctcaaagtagaaaatgcatttgtgagccaattcagcttaaccyggttactaagggagtaatggaaaagaaaaaatatgatagaattgttaaagtgaaagtagaggaaactgagtttcagaagattaaaccgtctataaattggctttatttatttgcttagtttaatgtttgcttgaattcttaagccagtttacaggcttttttgagaaaaagaatattgaaagcagaaagaaagataaggaggggaggggagggtagaagagaagaggcataaaagaagaaggtagaagaaaagaaaaaagaaagagaaagttaaagataacatgtcttgaattagtttag

SEQ ID NO: 165681 - DNA, 601 bp, Human
agtcaattcttcatgatctccatggatcaaagtgtaacagtaatgaaaaaaatctaaagtgctagctatttcaatttgggtttggaatgcatgttagtgtttcatttgaacaaaagggtagatgttctaggaattcatagcagttcaaaataattttatccagaccttccgtgcttaaaggaccttcccttatgtaggaaaagttgcagtgtccaaacctagagagagtaagataaaaacaaacttcagattgtaaatctggatgttaggcatagtggagaaattgtgacaaatgaaatgtgtagttaccttttacagagtaaatggcagtagttctttgcatatactttgctagtaaaatgagttgttgcatgattccatattttccccaaaatccattccccaatctgttgatagtgaaactataaccatttaaattctgattcctgcattaagtcttccttagttacattcataccagtatgaatggtcattgatttctgcacaacccaaattatagacaccctcagagggaaataacctttctatggtttttttcactgaacattcattcccccagagtgttaaaagtgacagttta

SEQ ID NO: 165682 - DNA, 601 bp, Human
gaaatggtgtctgtaaattcagcccctgtaaacacttgaatttttcagttctcagctctagtcaagaaacagattatttagaattggttacttaaatgcattgtgattttttttttcttgtttctactggggcttaccccaggaattcctggactgaagtctgttgaagaaaaaagttgatatgtgaacaaggtgatataatgtgaataggcaaaagagaagggatattgaaatcatatgctaaagattatctggggattttgtcattgattttacacatctttccattaccttagctggwtaaaaataagatagaatccatagcaaaactgagtcaggatttttttattcagtactggatttgataacattttgacaataatatttttcttaaaatacatcagtttccataagtcgtttctaatttccaatggcaaacaatcagagattcaaagagctgcatttatttgttgttcacataagaatattttctgattcattcactgaattcaacatttccattgcatccctactatgtaaaaggcacggtgatatattttgactgagttgggaatttaaagtctctttatctctaatacca

SEQ ID NO: 165683 - DNA, 601 bp, Human
ataatatttttcttaaaatacatcagtttccataagtcgtttctaatttccaatggcaaacaatcagagattcaaagagctgcatttatttgttgttcacataagaatattttctgattcattcactgaattcaacatttccattgcatccctactatgtaaaaggcacggtgatatattttgactgagttgggaatttaaagtctctttatctctaataccaaataattttcatgaaaaggataaatttttctgtcccttgtgtttttattagactgtgtagtctatgtttattttttttccatttagtttctcagcttactgaaatagggttttcagctagaatagcagagtatctgttgatggctatttctgtgcattcgttgttttcttggtttactatatgctagaaataaaagtgtgtttaacttactgttgtctacattctgtccctgcagattattttgtcaagtgctttttccagcctaagttaaatcatttataaaatatgactttgagtgcagcccttagaaaagaaatatgtgccactttatggcccatgtatcttacaaataagaaagtttccggatgggcaatgtgg

SEQ ID NO: 165684 - DNA, 601 bp, Human
aaatcatttataaaatatgactttgagtgcagcccttagaaaagaaatatgtgccactttatggcccatgtatcttacaaataagaaagtttccggatgggcaatgtggagtttctttgttcagatttcttttactgcatcggaacacattgtcttactctatcttaaatagtaattttccttctgggctataaatatatctcaaatacttcatcctaattctattttcttgaaggcaagctttcttaattcagacttttaatcttttcttttatcatcaatactgtatcttgttttattrgttttctctgaacaccttcatctgtgcagatgccttgctgataatgaaattgactggaactctggctagatgtcctgtcaaatcggaacaacctgtctcttgacctctttcatccattttctttggcaaatctcttttgcaactgagaatatcctggagaagttatggtcaacatcgtcttttaagaaccatgtacgtttgtcagcccaaatttctgtatgtgagacgctaccataaaacaaaatcaaaacatctctttatccgagaacttccaatttgaatctgctgctatccacattt

SEQ ID NO: 165685 - DNA, 601 bp, Human
ttacatgaaaaaaatgcctgaccttgtcttccatgatgaatgcatctgcagattgttcttttggaatgcacatgttattccacctgacttttctcaatcttttgtgctaagaagctaaacaactttttattaacctcaaagatttgagaccagccctacatctgtctggtcagaatgaaattactaccgtgactataataatggagtcttgactactgaaatcttgcaaacacttcatatcttgtcttaaagggctacttacccatttctgaaatatcatgggaagtatacagctaatcttcagttggagtagagcttagttttcatgaaaaatgtcaagaggctagatcctgagatttggaaattatctgatcctggcattgcatcctgtatcaaaggcagttttattattttaactaatatcatatataaaggcattattataatatcacaatcaatcatactaaattcacctaagaggtcagcacagttcaccactctgcatccttttgatgcagcctagttttgcattgggttcctgaagtcattttccatttccaaagagacaataggcaattataagaaatgccaatagacaatc

SEQ ID NO: 165686 - DNA, 601 bp, Human
accttgtcttccatgatgaatgcatctgcagattgttcttttggaatgcacatgttattccacctgacttttctcaatcttttgtgctaagaagctaaacaactttttattaacctcaaagatttgagaccagccctacatctgtctggtcagaatgaaattactaccgtgactataataatggagtcttgactactgaaatcttgcaaacacttcatatcttgtcttaaagggctacttacccatttctgaaatatcatgggaagtatacagctaatctacagttggagtagagcttagktttcatgaaaaatgtcaagaggctagatcctgagatttggaaattatctgatcctggcattgcatcctgtatcaaaggcagttttattattttaactaatatcatatataaaggcattattataatatcacaatcaatcatactaaattcacctaagaggtcagcacagttcaccactctgcatccttttgatgcagcctagttttgcattgggttcctgaagtcattttccatttccaaagagacaataggcaattataagaaatgccaatagacaatctaagttcagtttgttttatt

SEQ ID NO: 165687 - DNA, 601 bp, Human
agctaaacaactttttattaacctcaaagatttgagaccagccctacatctgtctggtcagaatgaaattactaccgtgactataataatggagtcttgactactgaaatcttgcaaacacttcatatcttgtcttaaagggctacttacccatttctgaaatatcatgggaagtatacagctaatctacagttggagtagagcttagttttcatgaaaaatgtcaagaggctagatcctgagatttggaaattatctgatcctggcattgcatcctgtatcaaaggcagttttattattytaactaatatcatatataaaggcattattataatatcacaatcaatcatactaaattcacctaagaggtcagcacagttcaccactctgcatccttttgatgcagcctagttttgcattgggttcctgaagtcattttccatttccaaagagacaataggcaattataagaaatgccaatagacaatctaagttcagtttgttttatttcaatattttaaaagtgtttaactccatttttattttaatatcttaatgctgggagaattgtaccatctgtattgggtagtaaaaacttaag

SEQ ID NO: 165688 - DNA, 601 bp, Human
aaagggctacttacccatttctgaaatatcatgggaagtatacagctaatctacagttggagtagagcttagttttcatgaaaaatgtcaagaggctagatcctgagatttggaaattatctgatcctggcattgcatcctgtatcaaaggcagttttattattttaactaatatcatatataaaggcattattataatatcacaatcaatcatactaaattcacctaagaggtcagcacagttcaccactctgcatccttttgatgcagcctagttttgcattgggttcctgaagtcatkttccatttccaaagagacaataggcaattataagaaatgccaatagacaatctaagttcagtttgttttatttcaatattttaaaagtgtttaactccatttttattttaatatcttaatgctgggagaattgtaccatctgtattgggtagtaaaaacttaaggtgtttattggaagaatggacaattgcatcattaatcttaatgaactttaaattttttatgagatgatccaagtaagtttctaatacgtaataatttttaaaactgagaaattgtgctaagtgactaatttatttc

SEQ ID NO: 165689 - DNA, 601 bp, Human
ctgcatccttttgatgcagcctagttttgcattgggttcctgaagtcattttccatttccaaagagacaataggcaattataagaaatgccaatagacaatctaagttcagtttgttttatttcaatattttaaaagtgtttaactccatttttattttaatatcttaatgctgggagaattgtaccatctgtattgggtagtaaaaacttaaggtgtttattggaagaatggacaattgcatcattaatcttaatgaactttaaattttttatgagatgatccaagtaagtttctaatasgtaataatttttaaaactgagaaattgtgctaagtgactaatttatttcctacaatgggaaaaatcagaaaatccctaacttataaaaccaaatgagattgttataaaaaatcaaagataagccaactagtcaatgatccaatatgtaaaagtggagagaaaataaaacttcatagggccattaattgcaaaatctcacacacaaaaaaagctgttgaatatataatttgaatttagacttagaattgttgaaaataaaaataataaatgatacagcaaggaaaatatatgcagagtatc

SEQ ID NO: 165690 - DNA, 601 bp, Human
tttgttttatttcaatattttaaaagtgtttaactccatttttattttaatatcttaatgctgggagaattgtaccatctgtattgggtagtaaaaacttaaggtgtttattggaagaatggacaattgcatcattaatcttaatgaactttaaattttttatgagatgatccaagtaagtttctaatacgtaataatttttaaaactgagaaattgtgctaagtgactaatttatttcctacaatgggaaaaatcagaaaatccctaacttataaaaccaaatgagattgttataaaaaatcaaagataagccaactagtcaatgatccaatatgtaaaagtggagagaaaataaaacttcatagggccattaattgcaaaatctcacacacaaaaaaagctgttgaatatataatttgaatttagacttagaattgttgaaaataaaaataataaatgatacagcaaggaaaatatatgcagagtatcattgcctcttctgttaagtacagaaaaagtcaaatataggcaaaacacccatctttttatatgcaagacttttttttcttttctatttactttaattctttaaagacattc

SEQ ID NO: 165691 - DNA, 601 bp, Human
atgcagagtatcattgcctcttctgttaagtacagaaaaagtcaaatataggcaaaacacccatctttttatatgcaagacttttttttcttttctatttactttaattctttaaagacattctttaaatgtctctaacatttattttgaagtgaaaaatggacatgatgttgccaaatccataatcagtttgaatttagtagcttctgtgtttcaaactgctctctcatctgccaattttgcttaattttaaattgcaattattgtaatacacttatgtatttagtacgctaagaatgaygggcttagaaatagaattatattggcttaaaacagaaaaatcccaaattaagatttttgtttatctgtatatagaaacaggctttggtttttagccatttatgatgccataatttgcaagctattgttttgaatgtctaggtttcctaaatttttttctgtggaaagagatggtttcacttttcatgtattccactagtcagatgaaggccttttatgtggatggtttcaggatgtgcctgctcttcaatagtgtctgttacttttgttttgccataatcaataactttgagtattctat

SEQ ID NO: 165692 - DNA, 601 bp, Human
aaataaagctatgactagagcagaaatcgtccatgacaaaaacattttggtcagttggcatcactgggtcatgtaacttgacctctgagagtgacagtgcatttttttatgattgcagaaaacttgccatttgattttttctacagttctgaagatgaactctaactactccttttagttgtatatttgatacacgcagaaaaagtcaagattgtaacattttatattgaaagaatcttatgaaaagactctaaaggtagaaaagggcattggttattggcttatcctttaaattatgccyctcacacaatccacccttgggttaaaaggaacagtcaaaagagttgcaattgtagcaacaatgaatgcattagtccttcagtgatcccaatgaaagaggtaagtatccccttagtagaggaccatgtacagaggttggatgtgcagaggccaaaggcttaaggaaggtcacacagcagggcgatggaacttccaagaaagacatcagggatccccacataccgttccaggctttaagagctgcagcccttgccttctctcttggtgatcttcaacactttaaataggggattcaccccct

SEQ ID NO: 165693 - DNA, 601 bp, Human
ccttctctcttggtgatcttcaacactttaaataggggattcaccccctttgagccccactatagttgtcccattcagtgcctgacaaggcagggtgcatcttcattctcctcccacatggttcctttatctgttcaagagccaatgagaaatcgaaatggccaggccgcttaatgtcaagaaagcccatatgtatatctctttcagcacgtaattccttcatatacctcttttttcccaattacccattccctcttccactccctaatcccttcccaagtagggtactttttttttttttcttttgctctctctctcattctctcttttctgtatctctcggaaatcagacaggagttcagagcactttcactaccttttatgaggtagattgtgatgtcatagatgggggcagggctagtcaactttctacccacctcccaacctgtgctgagggagctccgatcgggagtggaagcagtgattcctccatggtgagtaaattgactttctaatctaatgtctttcattgtaatcatgaattctgaaggcaggggggattggattttagggaaataaaaatgtgcccactgaaggcctc

SEQ ID NO: 165694 - DNA, 601 bp, Human
gtctttcattgtaatcatgaattctgaaggcaggggggattggattttagggaaataaaaatgtgcccactgaaggcctcttaatattaaccaactttgggcaaaggacttatttattctttatgtgggtcagaaattccacagcacagatatatcttcaattgtggtctaaacttgagaagtgaaaaaggtatttttatttctttatttctcagtctttcttcccattgggactgaaagtcatggcatatgtggaatgaatccattctatagtctctttgtgagcttcactaaggaaggstagtcagaaggatgtattcttctttgtttggaagatttcagggtcatgaaatatcctttactcatgtttgccatgagaatcagtgggcccttctaaaactgtggaggttaaaatgtgcatgaggatgatacatgaggattatcaacaaatactttgggtgttaacaaataaaagctttctaatgcagtgactaaaatgttcattttttgaaaaaagttacaactcctgcaagtttaaggtcacagccatttcaaggtgtcacagccagatttactacccatttttgttgttgcacgtcct

SEQ ID NO: 165695 - DNA, 601 bp, Human
ctttgggtgttaacaaataaaagctttctaatgcagtgactaaaatgttcattttttgaaaaaagttacaactcctgcaagtttaaggtcacagccatttcaaggtgtcacagccagatttactacccatttttgttgttgcacgtcctaaccctgatgctgtttcatagggtctcttgctagttaagaggcatgaaaagctgctattgtttcatttgggtttctatatattgctgattagttcttttatatgccttagtatttagaaagaaaagatcaactggagcgggcacttttctcyacttctttcctcgttctctcctgggtacctattaaaactatcaagatgcaagcttttgtataaaagggtaaagggagttcatggaggtggttgactttttaagggatatcaaagcactagggtgggtgttcttagaagggtttgaccaccagaatgtgaaaccctgtttttttcttagggtgggatgaaagcatcctggtgtggattatgagtattataaaatatataaagagggtatcatcccttttttttttcctaaatatacatccctggttggctagccatgatgaacatttgtgt

SEQ ID NO: 165696 - DNA, 601 bp, Human
tttcaaggtgtcacagccagatttactacccatttttgttgttgcacgtcctaaccctgatgctgtttcatagggtctcttgctagttaagaggcatgaaaagctgctattgtttcatttgggtttctatatattgctgattagttcttttatatgccttagtatttagaaagaaaagatcaactggagcgggcacttttctccacttctttcctcgttctctcctgggtacctattaaaactatcaagatgcaagcttttgtataaaagggtaaagggagttcatggaggtggttgactytttaagggatatcaaagcactagggtgggtgttcttagaagggtttgaccaccagaatgtgaaaccctgtttttttcttagggtgggatgaaagcatcctggtgtggattatgagtattataaaatatataaagagggtatcatcccttttttttttcctaaatatacatccctggttggctagccatgatgaacatttgtgttggagaattggtttcggtttaaaaatgaagagtcctttctgtctcatcaacggcttctttgttatgcataaatccctgacccccaaagttatacact

SEQ ID NO: 165697 - DNA, 601 bp, Human
atatataaattgatacctgaagagaggcagaatccatgataggtagctacataatgattttggaagaccgattcatgttttaactccatacctttgtgttattctaattattggggatgtaaaaaacatttactaggtaatagatgtagctgatcttactggggcttcaaagtttaaaattacctatgtaatattgcaggaaatcccaggtggttttggaagggttgataagtagggaattggtgagtatggaactatgtactatgggggataaaaaagtgtaaagccttgctcctgaatytgaggaatgtgcaacctctttgaggagtctgtacatgtgccaagtgccgacttggaagtgaatacagtaagtgccaaaataaatatccctgtggcctgggtgggctggattgcactggggagtcttataaaaagctgatacttttagctagctgagaacagaacggtttagatgtttgtgttattgtatataaaaaggacagggaagcgttccaggtcttcaagaccacagaattgtaaatggagctgaagatatatcttgtgttcagacatgacatgtgtcaaaatcaaaatgtattgc

SEQ ID NO: 165698 - DNA, 601 bp, Human
aattattggggatgtaaaaaacatttactaggtaatagatgtagctgatcttactggggcttcaaagtttaaaattacctatgtaatattgcaggaaatcccaggtggttttggaagggttgataagtagggaattggtgagtatggaactatgtactatgggggataaaaaagtgtaaagccttgctcctgaatttgaggaatgtgcaacctctttgaggagtctgtacatgtgccaagtgccgacttggaagtgaatacagtaagtgccaaaataaatatccctgtggcctgggtgggytggattgcactggggagtcttataaaaagctgatacttttagctagctgagaacagaacggtttagatgtttgtgttattgtatataaaaaggacagggaagcgttccaggtcttcaagaccacagaattgtaaatggagctgaagatatatcttgtgttcagacatgacatgtgtcaaaatcaaaatgtattgcttacagttcaacctcatactttttctgaacccctttcccctaaatcatatgctgactgtactagaggagatacatgtctttggaagaatttaggaggcagcaagt

SEQ ID NO: 165699 - DNA, 601 bp, Human
gtatcattaacagatttagaaacgtcagatggtgatggaaatgtccatcagctaatgagaatccgtgtaaccaagatgactttataaagcaaacaatttccttgggcactaagcaagaataacatcagtttctccatcctttaacagccaatattgacaaggttttaacactaagtaaaactgaacatgattatgcaagtctccttcccatatactcttgggaataggttattgatttgggtatgatttattcacactgacgaagaacacttaatttgaaagcctctctgttgctgtagayttgcagaagatttgcggtggatattttgcctcacgtagggaaaactgtttttgtatttcttgccattcgagtctcttccaagttattaccttggccattctaaaagactggaattccacgattagaactgctttgttacctagcccctttaccagattataagaacttagtaagtaaaccaaggactcagtttagatcacccagtgacatggcttctaatttcctattgtgacatcagaattagcttctagaatttgttttctcaggaaatcactttcaaaggctaaatttttctgtttg

SEQ ID NO: 165700 - DNA, 601 bp, Human
atcagtttctccatcctttaacagccaatattgacaaggttttaacactaagtaaaactgaacatgattatgcaagtctccttcccatatactcttgggaataggttattgatttgggtatgatttattcacactgacgaagaacacttaatttgaaagcctctctgttgctgtagacttgcagaagatttgcggtggatattttgcctcacgtagggaaaactgtttttgtatttcttgccattcgagtctcttccaagttattaccttggccattctaaaagactggaattccacgatwagaactgctttgttacctagcccctttaccagattataagaacttagtaagtaaaccaaggactcagtttagatcacccagtgacatggcttctaatttcctattgtgacatcagaattagcttctagaatttgttttctcaggaaatcactttcaaaggctaaatttttctgtttggggatggtgaagtagtatgatcaaaggtagtttaacaaagcaagactactagcgctagtttctaaaaaaaaaaaaaaaaaaagttcaagcagaagttagattatgtttgtttcaagagaaaaa

SEQ ID NO: 165701 - DNA, 601 bp, Human
aattgtggttaagcatgagaactaagaaagatggttattaaatataatcagtgatgctattgaatctccttgaaagtgagacaagaaactgtaaacattcaagagaccatccttcatttttctttgtcatgctccaatacaaggagttaatgaagattgaagctaagttgttctacatcttccaagttgtgccaagataagagataggggcaataatccagagtaacatttgtttggggatggtattcttttgtagggccatttgacttctttaattaagtgaacttccttggaaaaaaaacgtgtatgtcagcattctcatcatgactggaagaaccgaactttcatgcccatgcagtatatgacctatatggtctatgttgaaaatgttaattatgtatgtttaaatcaatagtcacttacaagtgctaaattctttgttgtttgtttttctttttttcgtgaacaacagctgttaccttacacccatcaatctgtgtagaaagttagagaagtggtaaaagacctaaggagagggagatactagaaaggaattttacattttactgagacatgaaaatgagccctggttgagaagaaa

SEQ ID NO: 165702 - DNA, 601 bp, Human
ttcaagagaccatccttcatttttctttgtcatgctccaatacaaggagttaatgaagattgaagctaagttgttctacatcttccaagttgtgccaagataagagataggggcaataatccagagtaacatttgtttggggatggtattcttttgtagggccatttgacttctttaattaagtgaacttccttggaaaaaaaacgtgtatgtcagcattctcatcatgactggaagaaccgaactttcatgcccatgcagtatatgacctatatggtctatgttgaaaatgttaattatrtatgtttaaatcaatagtcacttacaagtgctaaattctttgttgtttgtttttctttttttcgtgaacaacagctgttaccttacacccatcaatctgtgtagaaagttagagaagtggtaaaagacctaaggagagggagatactagaaaggaattttacattttactgagacatgaaaatgagccctggttgagaagaaagtgagtcttagttcacagcaacaaggattgattctaatttagccccctaattgctttgcatacaacgtatcatttccagattgccagaatcttctgt

SEQ ID NO: 165703 - DNA, 601 bp, Human
atgtcagcattctcatcatgactggaagaaccgaactttcatgcccatgcagtatatgacctatatggtctatgttgaaaatgttaattatgtatgtttaaatcaatagtcacttacaagtgctaaattctttgttgtttgtttttctttttttcgtgaacaacagctgttaccttacacccatcaatctgtgtagaaagttagagaagtggtaaaagacctaaggagagggagatactagaaaggaattttacattttactgagacatgaaaatgagccctggttgagaagaaagtgagycttagttcacagcaacaaggattgattctaatttagccccctaattgctttgcatacaacgtatcatttccagattgccagaatcttctgtatttattttttttatttgagaatagctttgtttggaagtcgaggattgatggggaaccctatttttaattgttttctgccgttaatttcagtgtcttctcttgggtatagatactgtcactttctagaatcagttgactggtaggaggcagtgcctgccattaagtgaacaaactaaggttgacgacctaaggatatatgtatctatat

SEQ ID NO: 165704 - DNA, 601 bp, Human
ttgctttttattagaatagcaatagctactcagagggataattgcccatggtaaatatcaaaatatcaacagttacattaacataaactgaaggattagtatgtgccaggcattgtatgaagcatttaaaatgcactatgaaatatgttttttcaattgtgctctggaggaaatactatcatccccattgaaaatattagaataatgaggttcagaggagttcagaaacttcctggaggtcacaaagtcagtgtttggtacacactagtgcttcaggaagacttctttgatattctccaamagcatggtgtactctttctgtcattttttgtatgacacttaaatgtcattatatttctctcaactagtctgtaagctagttataacagggaatatgtttgaatgctcatttttttccctggttccctgcataatgaacacataatctatgcttaacacattagcttctttatcatcctttcttccattgtagtgagttatcacacccaaaaagtcccaataattgattttgaagtctatcagtcattcatactttcattcatttatttctatgtgaaagcatctgacttcaaatgctaga

SEQ ID NO: 165705 - DNA, 601 bp, Human
atactatcatccccattgaaaatattagaataatgaggttcagaggagttcagaaacttcctggaggtcacaaagtcagtgtttggtacacactagtgcttcaggaagacttctttgatattctccaacagcatggtgtactctttctgtcattttttgtatgacacttaaatgtcattatatttctctcaactagtctgtaagctagttataacagggaatatgtttgaatgctcatttttttccctggttccctgcataatgaacacataatctatgcttaacacattagcttctttaycatcctttcttccattgtagtgagttatcacacccaaaaagtcccaataattgattttgaagtctatcagtcattcatactttcattcatttatttctatgtgaaagcatctgacttcaaatgctagatttcgaaatgcactgtttaactaggatttggggccaaaaatcaagtaattaaatgcaattatttttctagttaacttaatttctttataatttactctgttaaattttcagatatattaaaccctttttaagaaaagattatgccatagaaacctacagaattttttcccaa

SEQ ID NO: 165706 - DNA, 601 bp, Human
tcatccccattgaaaatattagaataatgaggttcagaggagttcagaaacttcctggaggtcacaaagtcagtgtttggtacacactagtgcttcaggaagacttctttgatattctccaacagcatggtgtactctttctgtcattttttgtatgacacttaaatgtcattatatttctctcaactagtctgtaagctagttataacagggaatatgtttgaatgctcatttttttccctggttccctgcataatgaacacataatctatgcttaacacattagcttctttatcatccyttcttccattgtagtgagttatcacacccaaaaagtcccaataattgattttgaagtctatcagtcattcatactttcattcatttatttctatgtgaaagcatctgacttcaaatgctagatttcgaaatgcactgtttaactaggatttggggccaaaaatcaagtaattaaatgcaattatttttctagttaacttaatttctttataatttactctgttaaattttcagatatattaaaccctttttaagaaaagattatgccatagaaacctacagaattttttcccaaaaagct

SEQ ID NO: 165707 - DNA, 601 bp, Human
tttctgtcattttttgtatgacacttaaatgtcattatatttctctcaactagtctgtaagctagttataacagggaatatgtttgaatgctcatttttttccctggttccctgcataatgaacacataatctatgcttaacacattagcttctttatcatcctttcttccattgtagtgagttatcacacccaaaaagtcccaataattgattttgaagtctatcagtcattcatactttcattcatttatttctatgtgaaagcatctgacttcaaatgctagatttcgaaatgcactrtttaactaggatttggggccaaaaatcaagtaattaaatgcaattatttttctagttaacttaatttctttataatttactctgttaaattttcagatatattaaaccctttttaagaaaagattatgccatagaaacctacagaattttttcccaaaaagctgaatgaatcaaattagtaatttattgtaaaaagaaatttgaaagtaacatggttgatttcatttgcccccttatgcaaaggttatgacacacaaattgttatataattatatataaatatgaaatattttaacttaa

SEQ ID NO: 165708 - DNA, 601 bp, Human
atatttaatgcccactattgtattaaaaatttgtatatagtttcaactacaaatgatgaaacatacaactagagttatttctctctcacatggaatacatctgtctgtagttcagggagagtagagtgaacacagagtcatcaaggactttgacacctcctaactttatggcccatctattctcaagttcatcttttggtctaagatgactgctagtgttccacctttccaattttcatgtaggaagaagaggtgagagggttaaaccaggtgcttcctagctatgttagtaccctctaargaggcttcctggaaacttccacccctctgcccttcttcagtttccactttcatcaccatacatatggtttgctgcaagagagactggtaaacacaatgttttagctcagcacattgctgctctgattaagattgagatgccactaaataaagagaagggcaaatgaatattagatgagcaaccaagacaggatgctaagaataagaattaaattacccttataagattcaattcgaagtaagcaagaatttggggaatggaaatcaaaatctattcttttttttaattattagactttaa

SEQ ID NO: 165709 - DNA, 601 bp, Human
tgttagtaccctctaaggaggcttcctggaaacttccacccctctgcccttcttcagtttccactttcatcaccatacatatggtttgctgcaagagagactggtaaacacaatgttttagctcagcacattgctgctctgattaagattgagatgccactaaataaagagaagggcaaatgaatattagatgagcaaccaagacaggatgctaagaataagaattaaattacccttataagattcaattcgaagtaagcaagaatttggggaatggaaatcaaaatctattctttttttwaattattagactttaagttctggggtacatgtgcagaacgtacaggtttgttacataggtatacatatgccatggtggtttgccgcacccatcaacctgtcatctactttaggtatttctcctaatgctatccctccccgagccccctaccccctgacaggccccagtgtgtgatgttcccttccctgtgtccatgtgttctcattgttcaactcccacttatggtgagaatgtgcggtgtttggttttctgttcttgtgttagtttgctgagaatgatggtttccaacttcatccatgt

SEQ ID NO: 165710 - DNA, 601 bp, Human
tttgctgcaagagagactggtaaacacaatgttttagctcagcacattgctgctctgattaagattgagatgccactaaataaagagaagggcaaatgaatattagatgagcaaccaagacaggatgctaagaataagaattaaattacccttataagattcaattcgaagtaagcaagaatttggggaatggaaatcaaaatctattcttttttttaattattagactttaagttctggggtacatgtgcagaacgtacaggtttgttacataggtatacatatgccatggtggtttgcygcacccatcaacctgtcatctactttaggtatttctcctaatgctatccctccccgagccccctaccccctgacaggccccagtgtgtgatgttcccttccctgtgtccatgtgttctcattgttcaactcccacttatggtgagaatgtgcggtgtttggttttctgttcttgtgttagtttgctgagaatgatggtttccaacttcatccatgtccctgtaaaggacatgaactcattctttgtttatggctgcatagtattccatggtgtatatgtgccacattttcttaacccatt

SEQ ID NO: 165711 - DNA, 601 bp, Human
tgttttagctcagcacattgctgctctgattaagattgagatgccactaaataaagagaagggcaaatgaatattagatgagcaaccaagacaggatgctaagaataagaattaaattacccttataagattcaattcgaagtaagcaagaatttggggaatggaaatcaaaatctattcttttttttaattattagactttaagttctggggtacatgtgcagaacgtacaggtttgttacataggtatacatatgccatggtggtttgccgcacccatcaacctgtcatctactttagrtatttctcctaatgctatccctccccgagccccctaccccctgacaggccccagtgtgtgatgttcccttccctgtgtccatgtgttctcattgttcaactcccacttatggtgagaatgtgcggtgtttggttttctgttcttgtgttagtttgctgagaatgatggtttccaacttcatccatgtccctgtaaaggacatgaactcattctttgtttatggctgcatagtattccatggtgtatatgtgccacattttcttaacccattctatcattgatgggcatttgggttggttc

SEQ ID NO: 165712 - DNA, 601 bp, Human
tttttttaattattagactttaagttctggggtacatgtgcagaacgtacaggtttgttacataggtatacatatgccatggtggtttgccgcacccatcaacctgtcatctactttaggtatttctcctaatgctatccctccccgagccccctaccccctgacaggccccagtgtgtgatgttcccttccctgtgtccatgtgttctcattgttcaactcccacttatggtgagaatgtgcggtgtttggttttctgttcttgtgttagtttgctgagaatgatggtttccaacttcawccatgtccctgtaaaggacatgaactcattctttgtttatggctgcatagtattccatggtgtatatgtgccacattttcttaacccattctatcattgatgggcatttgggttggttccaagtctttgctattgtgaacagtgctggaataaacatacgtgtgtgtgtgtctttatagtaaaatgatttataatcctttgggcatttacccagtaatgggatggctaggtcaaatggtatttctagttctagatccttgaagaatcgccacactgtcttccacaatggttgaattagtt

SEQ ID NO: 165713 - DNA, 601 bp, Human
gccccctaccccctgacaggccccagtgtgtgatgttcccttccctgtgtccatgtgttctcattgttcaactcccacttatggtgagaatgtgcggtgtttggttttctgttcttgtgttagtttgctgagaatgatggtttccaacttcatccatgtccctgtaaaggacatgaactcattctttgtttatggctgcatagtattccatggtgtatatgtgccacattttcttaacccattctatcattgatgggcatttgggttggttccaagtctttgctattgtgaacagtgctgsaataaacatacgtgtgtgtgtgtctttatagtaaaatgatttataatcctttgggcatttacccagtaatgggatggctaggtcaaatggtatttctagttctagatccttgaagaatcgccacactgtcttccacaatggttgaattagtttatagttccaccaacattgtaaaagctttcctatttctccacatcctctccagcatctgttgtttcctgactttttaatgatcgccattctaactggtgtgagatggtatctcattgtggctttgatttgcatttctctaatgatcag

SEQ ID NO: 165714 - DNA, 601 bp, Human
cagtgtgtgatgttcccttccctgtgtccatgtgttctcattgttcaactcccacttatggtgagaatgtgcggtgtttggttttctgttcttgtgttagtttgctgagaatgatggtttccaacttcatccatgtccctgtaaaggacatgaactcattctttgtttatggctgcatagtattccatggtgtatatgtgccacattttcttaacccattctatcattgatgggcatttgggttggttccaagtctttgctattgtgaacagtgctggaataaacatacgtgtgtgtgtgtctttatagtaaaatgatttataatcctttgggcatttacccagtaatgggatggctaggtcaaatggtatttctagttctagatccttgaagaatcgccacactgtcttccacaatggttgaattagtttatagttccaccaacattgtaaaagctttcctatttctccacatcctctccagcatctgttgtttcctgactttttaatgatcgccattctaactggtgtgagatggtatctcattgtggctttgatttgcatttctctaatgatcagtgatgatgagcattatttcatat

SEQ ID NO: 165715 - DNA, 601 bp, Human
cattctttgtttatggctgcatagtattccatggtgtatatgtgccacattttcttaacccattctatcattgatgggcatttgggttggttccaagtctttgctattgtgaacagtgctggaataaacatacgtgtgtgtgtgtctttatagtaaaatgatttataatcctttgggcatttacccagtaatgggatggctaggtcaaatggtatttctagttctagatccttgaagaatcgccacactgtcttccacaatggttgaattagtttatagttccaccaacattgtaaaagckttcctatttctccacatcctctccagcatctgttgtttcctgactttttaatgatcgccattctaactggtgtgagatggtatctcattgtggctttgatttgcatttctctaatgatcagtgatgatgagcattatttcatatgtttgttggctgcataaatgtcttcttttgagaagtgtctgttcatatcctttgcccactttttgatggtttttttcttcttgtaaatttaagttctttgtaggttctgaatattagccctttgtcagatggatagattgcaaaaattttctccca

SEQ ID NO: 165716 - DNA, 601 bp, Human
gatcgccattctaactggtgtgagatggtatctcattgtggctttgatttgcatttctctaatgatcagtgatgatgagcattatttcatatgtttgttggctgcataaatgtcttcttttgagaagtgtctgttcatatcctttgcccactttttgatggtttttttcttcttgtaaatttaagttctttgtaggttctgaatattagccctttgtcagatggatagattgcaaaaattttctcccattttgtaggttgcatgttcactctgatgatagtttcctttgctgtgcagaagytcattagtttaattagatcccatttatctattttggcttgtgttgcctttgctttttgtgttttagtcataaagtctttgtccatgcctgtgtcctgaatggtattgcctaggttttcctctagggtttttatgatttttaagtcctacatttaagtctttagtccatcgtctcagccccaaatctccttaagctgataagcaacttcagcaaagtctcagggtacaaaatcaatgtgcaaaaattgcaagcattcctatttaccaataagagacaaacagagagccaagtcatgagtga

SEQ ID NO: 165717 - DNA, 601 bp, Human
gctttgatttgcatttctctaatgatcagtgatgatgagcattatttcatatgtttgttggctgcataaatgtcttcttttgagaagtgtctgttcatatcctttgcccactttttgatggtttttttcttcttgtaaatttaagttctttgtaggttctgaatattagccctttgtcagatggatagattgcaaaaattttctcccattttgtaggttgcatgttcactctgatgatagtttcctttgctgtgcagaagctcattagtttaattagatcccatttatctattttggcttktgttgcctttgctttttgtgttttagtcataaagtctttgtccatgcctgtgtcctgaatggtattgcctaggttttcctctagggtttttatgatttttaagtcctacatttaagtctttagtccatcgtctcagccccaaatctccttaagctgataagcaacttcagcaaagtctcagggtacaaaatcaatgtgcaaaaattgcaagcattcctatttaccaataagagacaaacagagagccaagtcatgagtgaactcccattcacaattgctacaaagagaataaaataccta

SEQ ID NO: 165718 - DNA, 601 bp, Human
taggattaatggtattgatgtgcaccatacattgagcacagggtccagaatgtaggtgtactaaataaatgagtaggtattttttgttatcttctctccccacaaaagactatatagtcttttggataatattggtgccctccggttcttatatcatgtctaccccaaggaaggtgctggacataacagcagtgagcaaccaacgaatcaaggtctctgctgtcatcaagattgcattcttttgtcactgggagtccttgaggaatcaccgacagagaggggatagttgaaaatacagaarggaataacctcaatagaagtgaaacagtgattgtcacatttcactctgtaaaacgaatctcatgggtagccaaccaaaatggagattcctgaaatccacagttctgaaactcagctctgagaagggatcaggaatctgcattttattcctaaatctttcggatacagatgattcatggatcacacttttaaaaaaacactggtctaggaagtggaggaaagagaaacctataggctatagtgagaatttctccagacagtttaatccctttcctagtcccttttctaggaaaactgggtt

SEQ ID NO: 165719 - DNA, 601 bp, Human
cccaacggtaattaagggtttcagtgaaaatattgtctgaaataaaagtttaaacaaggtaaaatggctttcacttcttactttttacaaacaagagtattgaagttaaaacaattgttttcctaccgcttttttagaaaaccttttcatatgtcattacatatttacctagtctctctgtctctctgtacattttaaaatttttgctcatgcctgtaatcccagcactttgggaggccgaggcgggtggatcacaaactcaagagatcaagaccatactggccaacatggtaaaaccccrtctctactaaaaataaaaaaattagctgggcatggtggggcatgcctgtaatcccagctacttgggagactgaggcaggagaatcgcttgaacccaagaggtggaggttgcagtgagccgagattgcgccgctacactccagcctggcaacggagcaagactccgtctcaaaaataaataaataaaaataaatagttaaaataaaatttttacatggtgagagaatgagtaactacattttaaaaaataagaaaaaactaaagtgatagttaaaataatcattttaataatgttaagaac

SEQ ID NO: 165720 - DNA, 601 bp, Human
gaaaaccttttcatatgtcattacatatttacctagtctctctgtctctctgtacattttaaaatttttgctcatgcctgtaatcccagcactttgggaggccgaggcgggtggatcacaaactcaagagatcaagaccatactggccaacatggtaaaaccccgtctctactaaaaataaaaaaattagctgggcatggtggggcatgcctgtaatcccagctacttgggagactgaggcaggagaatcgcttgaacccaagaggtggaggttgcagtgagccgagattgcgccgctacrctccagcctggcaacggagcaagactccgtctcaaaaataaataaataaaaataaatagttaaaataaaatttttacatggtgagagaatgagtaactacattttaaaaaataagaaaaaactaaagtgatagttaaaataatcattttaataatgttaagaacataaggctaaggatccccttgagattcaaattgcttctgtgtttgttaatatatattatgatgatgagtaactctgccatgttgaaattagtgctgggtgagcccttcaaaccaagcaagttgtaggtagaagctg

SEQ ID NO: 165721 - DNA, 601 bp, Human
tggtggggcatgcctgtaatcccagctacttgggagactgaggcaggagaatcgcttgaacccaagaggtggaggttgcagtgagccgagattgcgccgctacactccagcctggcaacggagcaagactccgtctcaaaaataaataaataaaaataaatagttaaaataaaatttttacatggtgagagaatgagtaactacattttaaaaaataagaaaaaactaaagtgatagttaaaataatcattttaataatgttaagaacataaggctaaggatccccttgagattcaaattrcttctgtgtttgttaatatatattatgatgatgagtaactctgccatgttgaaattagtgctgggtgagcccttcaaaccaagcaagttgtaggtagaagctgaagaagttgcatggcttagcattcgttttttaaaagaaaattggagaactgtaacaggcagtgacttcagatgtaacagaaatcatgctttctttcaaagatataccttcggtataattgaagaatttttcctggcattttttaatgtatcagataaaggaataatgatgcaacctttacatcttgtaataaatatg

SEQ ID NO: 165722 - DNA, 601 bp, Human
atgatgcaacctttacatcttgtaataaatatggaggtgatttaactttgtcaaaggctagattcacagggactctaagatagcaattgtgccatgaggaaactttcatcttaatattaagcatgatttttagtaggtacaagatactgtatcataccatctccagccctttaatgtttatctttgttccttggttaaaagttgtcatcttattggaagttaaaggtagtacttttttttcaaagaagttttccaattgcatgaacttgaggctttctttcaaagaaaccactaatttttctttttttttttttagcaacactattatgcatttccagtccgctgaggattcgattcctttaatctgttgttttgaaagtttcttgtataactcagcctcgttgcaagggaacagacaatatgttgtccatccatggaggctctttgttggaccaaagagatgatatttccagttttagattgaagggaaccctttggcgcttttgctgaattttccctgaagtacattcactccaggagaaacagactagaaggttccaattaggccaagccctggcaggcacctatatggagaagtatc

SEQ ID NO: 165723 - DNA, 601 bp, Human
tacatcttgtaataaatatggaggtgatttaactttgtcaaaggctagattcacagggactctaagatagcaattgtgccatgaggaaactttcatcttaatattaagcatgatttttagtaggtacaagatactgtatcataccatctccagccctttaatgtttatctttgttccttggttaaaagttgtcatcttattggaagttaaaggtagtacttttttttcaaagaagttttccaattgcatgaacttgaggctttctttcaaagaaaccactaatttttttttttttttttttagcaacactattatgcatttccagtccgctgaggattcgattcctttaatctgttgttttgaaagtttcttgtataactcagcctcgttgcaagggaacagacaatatgttgtccatccatggaggctctttgttggaccaaagagatgatatttccagttttagattgaagggaaccctttggcgcttttgctgaattttccctgaagtacattcactccaggagaaacagactagaaggttccaattaggccaagccctggcaggcacctatatggagaagtatcctggcttattagg

SEQ ID NO: 165724 - DNA, 601 bp, Human
aaactttcatcttaatattaagcatgatttttagtaggtacaagatactgtatcataccatctccagccctttaatgtttatctttgttccttggttaaaagttgtcatcttattggaagttaaaggtagtacttttttttcaaagaagttttccaattgcatgaacttgaggctttctttcaaagaaaccactaatttttttttttttttttttagcaacactattatgcatttccagtccgctgaggattcgattcctttaatctgttgttttgaaagtttcttgtataactcagcctygttgcaagggaacagacaatatgttgtccatccatggaggctctttgttggaccaaagagatgatatttccagttttagattgaagggaaccctttggcgcttttgctgaattttccctgaagtacattcactccaggagaaacagactagaaggttccaattaggccaagccctggcaggcacctatatggagaagtatcctggcttattaggagaaccaccttaaatgccctttatttcatcttttatttaaaggcagttggaactgtggtatattgataaatgcactatacctgagg

SEQ ID NO: 165725 - DNA, 601 bp, Human
ctacccctttattccatctaaaggattcagtagtgctagaaaagatacataagtgttggtattttcctattcccctcatgaacttctccattccttatccctaaaactgtaatattcaggcactgagaccaagccaagatggtggtagcttcagtaagaagagagtttaaaaaaatctaaaatgctgaatgggggaaactttgaaaggaaaagaaggatgaagatgtaggaaaagagaaacataaattttttaagaccatgtttggactcacctggtgatttaaggaaagatgggtcatartaataataaaagctgagatgtattaagggcttaccatgtgccaggcactcaacttcagtggcattatctcatttaatgctttataatactagaaagtgctattttcatttttaattttaaagaacttttatgaggtagaggtaagtttagtggttgttcaagatcgtgtagttagtgatccatccagtcaaggtttgaactcaggctttaagtctagagtccaggtttccctcagtaggagagatgaaaacatgcatgtaagaatgaattaccagtgacagagagtgcacaggagaggaa

SEQ ID NO: 165726 - DNA, 601 bp, Human
atgctggagggtaggagccattttgcaagttattaaatggccttcagtacttagcagcagataccatgttcatacaaggttaggcagttcagaaagggtggggtcatttagtgactttgatccattttatgaaaacatatttctcatgggttcctagataattgttcctcttacatttgtcttctggtcatgatgatatcacctagggagggagaagggtagaaatagagggatcaaaggtagtgatgctctgctagctggctctcctatcggtaaggcaaaaaggaggcttagctccttkcataattatttatgagacataaaccttgggtggtcaagacatgctgatgcacagaatcagagacaagatcaacagttaatgccttatgtattcatgtgacataaggactgtctgcccaagaatatttcccaattatggggggggtgcctgaaagcccattggctcttctctttgttgcataattcctcatgatttttttgttacatggaaaccaataacttagaggaggtctctggcaggagatcctgaagggttgggataagcgagggtgctgaaaggaaggcaaggaaagagtaagta

SEQ ID NO: 165727 - DNA, 601 bp, Human
catgggttcctagataattgttcctcttacatttgtcttctggtcatgatgatatcacctagggagggagaagggtagaaatagagggatcaaaggtagtgatgctctgctagctggctctcctatcggtaaggcaaaaaggaggcttagctccttgcataattatttatgagacataaaccttgggtggtcaagacatgctgatgcacagaatcagagacaagatcaacagttaatgccttatgtattcatgtgacataaggactgtctgcccaagaatatttcccaattatggggggggtgcctgaaagcccattggctcttctctttgttgcataattcctcatgatttttttgttacatggaaaccaataacttagaggaggtctctggcaggagatcctgaagggttgggataagcgagggtgctgaaaggaaggcaaggaaagagtaagtataggaaaagaaggtggggactacctggataaacaggtggccctgttccgaactttccaagggccaacctgtcagtactcccacttatctttgagatttccatgttagaaagaatgccttgtttcgggttgagcaaaaactgttt

SEQ ID NO: 165728 - DNA, 601 bp, Human
taaggactgtctgcccaagaatatttcccaattatggggggggtgcctgaaagcccattggctcttctctttgttgcataattcctcatgatttttttgttacatggaaaccaataacttagaggaggtctctggcaggagatcctgaagggttgggataagcgagggtgctgaaaggaaggcaaggaaagagtaagtataggaaaagaaggtggggactacctggataaacaggtggccctgttccgaactttccaagggccaacctgtcagtactcccacttatctttgagatttccaygttagaaagaatgccttgtttcgggttgagcaaaaactgtttcacctttattggtgagaaaaaaaatggctctaagccatatttaggaaatttgttgactataattaagatttcatgggcgtccccaaggtttacttacccataattgaaaaaatgcaaatgaagacagttaatcagtggactggccgactatgaagcactactacctatgtaaatgaattaaaaatgaagacacaaaatatgtccagttgagaaagttaccaaagagccaagtggtaaatttctcagcaaggctgtgga

SEQ ID NO: 165729 - DNA, 601 bp, Human
tatctttgagatttccatgttagaaagaatgccttgtttcgggttgagcaaaaactgtttcacctttattggtgagaaaaaaaatggctctaagccatatttaggaaatttgttgactataattaagatttcatgggcgtccccaaggtttacttacccataattgaaaaaatgcaaatgaagacagttaatcagtggactggccgactatgaagcactactacctatgtaaatgaattaaaaatgaagacacaaaatatgtccagttgagaaagttaccaaagagccaagtggtaaattyctcagcaaggctgtggagaattttttcttagcctgacagcctgcagtgccttcctgccaaggtctttgccaatttaatcttgagccattccatacagatttcctcacaactggccttcagcactggctggttctctggcattacttaaggaagccctgaagaaaagataacagacctctttgtcctcttttctgtgtaattgatccactacttagagctgtaaaatatttgctttacaagatcctgttatcaaatggaatttgaaactctttaggagttatcgcacagaatttcacttat

SEQ ID NO: 165730 - DNA, 601 bp, Human
ttattgccaattctcccatcaaaatttcctaccctgaaaacctactctaggtctgaacatgtttagaacaacccccttaaaatcgttcttgttcttatatgttaaagctatgctattcccattttaaaatattgcaaaaggctaaagtggactttacacatatttagggaaatattttagcattatcaaactcattagtgttattggctctgacttacaaaaatgaaaataaaatagcaaggcccaaatggaactggttccttcttccaggcatttctaagccatttgaagtaatcaaagyaaacacctcagttcttttatttcaaaatcaccttccagatggatttggcttattttattctatttagcttagccagcggtcccatgacatttgcattatttttaatccaatgacagattgctttgtgatttggattttcatgaactgccatttatgtgtcattaatttttgttagtagatgatcagcttttttgaaaaaagacatacaatgtgaaaattgatctctctctccatgcatattgtaaatatatgaattcagaacacacagtcaaatcctaattctcttctttaatcgtatgc

SEQ ID NO: 165731 - DNA, 601 bp, Human
ttaaaaatatcttagattattaaaaggatattaatattgattttaaaggtcttattctgagaaattttttggtaaatttattgaacttttgtgtatggatttaatctttgtaaaaacagtaaggaatatgaaaggacaaaatcaaacatgttatacacctacagtatgcagaacatcaccctacatgaaacaattgggaagatcaatataagcaaaacatgatttttttaatatttactcccataaatacaactggacctctgataaatcacctagatgtaacatacacacctcaaactcrgtatgtccaaagttatactcagcattgtagcacttcaacatcctttatatttccgcaatctaggttgagagcattgatgtatactaagttggactagttaggtatttgagaattgtccttcctcgtcactgttaaccattcagtcaccaacaacctcttattaaagagtgtttagatatcatgcccacaatgaagctgtttcccttctcctatccctacttgactcaaggtaaattgctattccttttgttcatttagcatctcgcatcctactaaaacactgtcatacagtgttaaaac

SEQ ID NO: 165732 - DNA, 601 bp, Human
agagtgtttagatatcatgcccacaatgaagctgtttcccttctcctatccctacttgactcaaggtaaattgctattccttttgttcatttagcatctcgcatcctactaaaacactgtcatacagtgttaaaacctttagtttgtgtctatttttctcattgtattgtgagctcttgtgtttcagtgcttatgtctatttgtgtttctatacccaacacttaagcacagtagttggcagaaagtattcagtaggtgtctgaagaaatacttggatgatgtgtagatggaaaaatgtagsgatagactggaggataaaaagtcagtgataattcaacatttcaagaggtgtagttgcactttcctttgaaagaatgtggttgacttctgcagtcgaattctgtttctgttgaaactgaacacctgttgcagcataagtcctgtttgaatgaagtagcatgcagctaaggacataggctttcagaaatattcagttgataacataagctgtagcaagagtcatttcaaatacttattacgatgttcttcagctttggtgatataaggaattaggctgcacaaatattgataaatggaagaa

SEQ ID NO: 165733 - DNA, 601 bp, Human
aatggggagtaataatcattcctacttcgagaatttttgaaaattaaatcacacaattaaaaggactcaatgtcaggcgtctagtaagtgctcactgaattttgattattatgaaaacttatacgtattcacttacctatcttgttgaaaacgccatcattacaataagtcacaaaagagaatgcaactatgttaaataaatgttcctaaacttggtatttaaaaactgttgccatgcagctttattctaatatcttttctttaggaagtgaagttttagccaaccttgccaattggaaarcagagttttggcaccatcttggaaaggcataaagaaacccatttttaaattggaaagaattgtgattgtgctgataatgatctaaatcatgaaagtgcatctacagaaaagggcaaaatgtaacctttggaaattcaactttttttaaaagtcaaattttgtattaactttaaattgggcttattgtttgtggaaatatttgttccagttcagttggctggatctctcacctcctcactttaccttgctgcaaattcaagatctgccttagcaggtggcttgaataaaattcttggcttt

SEQ ID NO: 165734 - DNA, 601 bp, Human
ctgcaaattcaagatctgccttagcaggtggcttgaataaaattcttggctttatatttcaaagctatctcactctcaaacagtgtattaggtttatttacaggattcctgcatcaggtttgaaaggcaaaggggttctgaagaagagacaggctctcatatttttgctgcagaattaaacaccatctatttgaaaatggaatctgtggtaaaaatctccaaatttacttgtaatcccttctcttcagatcagctcaattctcccaagactcactctttggggaccatttaataatacaakagcaatatcatcttgttctatttctactaattctgttgcccaaagcaaatcaatgaaacgtccctgtcatattttaccctttatttactcatagcatgcgatagaattaactaattttatgaattaacattactcatttttgaaacctgacagacttacagagaactgtgcattggccaaaggtgttaggtatttagcttctaaagaaactgtgacttatctgttcctgattgttcccaacattttgctgtctcatctctgtccttcattatttacacttctacctgggggtaagatggg

SEQ ID NO: 165735 - DNA, 601 bp, Human
ttaactaattttatgaattaacattactcatttttgaaacctgacagacttacagagaactgtgcattggccaaaggtgttaggtatttagcttctaaagaaactgtgacttatctgttcctgattgttcccaacattttgctgtctcatctctgtccttcattatttacacttctacctgggggtaagatgggaaagacgaaaaagtaaaattcatgtgagataactggctatgatattaccaaacttgtgtatgacggaagtcctgaaatcactggataaagtaaaccatcaagacagkctttaggtttcattaatccagtggttctcaaactttggcaagtatcagaacctcctggatggctagctagttaaaacaaagattgcaaggttttgattcagtaagttttggattgggcctgataaatgcgatttctaacagattcccgggtgatgctgatgctgttgcacctcagggactaggctttgagaatcaccccactaattcatgcttggcttctctcctgttaacatgaataacctagagtttgcttttccttagctatctttagaaatttgggctgtataaacgaaagagtat

SEQ ID NO: 165736 - DNA, 601 bp, Human; identical to SEQ ID NO: 29964

SEQ ID NO: 165737 - DNA, 601 bp, Human; identical to SEQ ID NO: 29965

SEQ ID NO: 165738 - DNA, 601 bp, Human
ttttaactcactgcttgtgtggtgggggagccagggattcccctttagtaactccgcaccctcttcctggcttgcagccagaagagctactcctcctggaagaattggagagaaatcaagtgatggggaagatgagggcaaaaggcatgcctctagtcagctaaacgtgcaagaattccacagagggaaaaggagaaaaagggaggcagattgagatttctttaagtctgtttggaagcttttgctctataaatctgccgcttaagccagggttttagggtagacagagccaagggcagarttttcagagatagtattgaaaaatcaaagcccagggccccaaagtctttctaatttatagttgatctgggcctggtttggaagattttgaatcccaatctaatccccgtgggagatcaatactacaatcaatcttattgtttccacaatgactttcttgtcctgtgcttaaatctgagataggctctgagtagagacaaggcaagccttcagataaaagcgtttgtagcagctgcctgtttttttttcatgtgcaccgaaatgtggatttttttttcttttatgatactacatgtggttt

SEQ ID NO: 165739 - DNA, 601 bp, Human
aatgtaataagaacaactgttttagacacctcttctggaaatttagcatggaagctctcaactttatttttaaggcctggaagatgctgtgtctctgttacaacttaaaaggaagatcatttaagttagttaacacctaaaacattccattgtgtgaggattttatcagtgatgtctgcatattctcatcattcatctagaagtggtttgatcagaactaaacaggctacacgttattcaactgtgttattttaacttaaaaagcatgcttgagtttataaaatcagaatttatatctttrtgagtgtaaatgttacctgagaaacagtacagaagtgaccaacttgattaaaatcaacttgtaataacttcaggtcttaatgcagttagataatggagaaaagctatgtaattttgccccaaatttcaactaatccatttcttgtctcattatgactaatatatcatccttaatctggatggatatagcacttttttcaagactaatcattgttgtatacacccaggatttgcttttgataaacatccttgtgccatgcatgccacgaaaaaagtttttggtaaaccatgtgatgaaggt

SEQ ID NO: 165740 - DNA, 601 bp, Human
ggacacatagatccaccaaaaccaatacttacctggtatggttccctagtggccccaggtatttcattgtcattacagaggccacattaagtaggaaaattactctatttggaaatggttgttgagattgaggctttggtgtccagtgatacttccttggcactgacattttccgttccacctgttttttagtggttcccctaaatttctcttaatccctttgcagtgaactattttgcgttcttagacttgctctttgtgtattttcactgagacaataagagaatatttcatcattccraaggtgttggtgttaagggtgggcagaggccaaatcagggttgttgatgacaaccatgctctctattcctttatttgccattcccttgttgtattttttttaaaatggaatgtttttaaccttttgtatttgatattttttttctccttgatcagttgtctgttattttattatctggaaaatcttatattatactcagcctctttcattttgtgttagggcagtgacttccagccttactgattgccagcatatccccaggttttgttgttgttgttgttgttttactggagatttttt

SEQ ID NO: 165741 - DNA, 601 bp, Human
cttccttggcactgacattttccgttccacctgttttttagtggttcccctaaatttctcttaatccctttgcagtgaactattttgcgttcttagacttgctctttgtgtattttcactgagacaataagagaatatttcatcattccgaaggtgttggtgttaagggtgggcagaggccaaatcagggttgttgatgacaaccatgctctctattcctttatttgccattcccttgttgtattttttttaaaatggaatgtttttaaccttttgtatttgatattttttttctccttgwtcagttgtctgttattttattatctggaaaatcttatattatactcagcctctttcattttgtgttagggcagtgacttccagccttactgattgccagcatatccccaggttttgttgttgttgttgttgttttactggagattttttagcccaaagtgtgttttaaaatcctcgaagcataacggtaacttacttttttgataaaacttaccatactttatttagaacaaaagggcagccacaaaatagcagtggctccttataaaatagacacattccagtgggccccgtcactttt

SEQ ID NO: 165742 - DNA, 601 bp, Human
tgtctgttctgtccatcatacctaagtcatatatttctgttcatttagttgggacagaactcacccaatgttatcattgtactaaatataaatgtgcccctaatggttttgacttttgcttaagtttttgagtcctcatgtatgttaggtagtgccatctagtagccagaaatttgggaactggctgggcatgatggctaatacctgtaatcccagcactttgggaggcttaggtgggtggatcacttgaggtcaggagttccagaccagcctggccaacatggtgaaaccacatctctaytaaaatataaaaaaatagccaggtatgatggcccatgcctgtaatccgagctaattgggaggctgagatgggaggactgcttgaacctgggaggtggaggctgctgtgagccaagattgtgccactgcactccagcctgggcaacagagtgagaccctgtctcacaaaaacaagaaacaaaacaaaacaaaagacaagaaacctgagaagcgcagtagattcaattatatatatctacttttaatttgctagctctgtgaccttaggaaagttacataacctctctgaactgcaactgtt

SEQ ID NO: 165743 - DNA, 601 bp, Human
atcccagcactttgggaggcttaggtgggtggatcacttgaggtcaggagttccagaccagcctggccaacatggtgaaaccacatctctactaaaatataaaaaaatagccaggtatgatggcccatgcctgtaatccgagctaattgggaggctgagatgggaggactgcttgaacctgggaggtggaggctgctgtgagccaagattgtgccactgcactccagcctgggcaacagagtgagaccctgtctcacaaaaacaagaaacaaaacaaaacaaaagacaagaaacctgagamgcgcagtagattcaattatatatatctacttttaatttgctagctctgtgaccttaggaaagttacataacctctctgaactgcaactgtttcatttacaaaatggagataatgatagtttttctctaattggtttgttgtgagataattcatataaagctgatggtgccagattacactcaaaaaaagcattcagctgtcattatcattatgacttcttttgttaatgttatagcctttccttctctagggaaaaggaggccagagtggacctaggctgactgagagaattcagctcag

SEQ ID NO: 165744 - DNA, 601 bp, Human
actgcaactgtttcatttacaaaatggagataatgatagtttttctctaattggtttgttgtgagataattcatataaagctgatggtgccagattacactcaaaaaaagcattcagctgtcattatcattatgacttcttttgttaatgttatagcctttccttctctagggaaaaggaggccagagtggacctaggctgactgagagaattcagctcagtcttttgaattattttgaggtagaggaatgattgatatagtatagattattaaattaggacttcacttttggagaaaagktcagatatcattgttgtcttatttttcttcactttcccacatttttgcagccatagctccatccatttggttaagaacttagaagctcacaaactcgggtcaaagacaggtcgaaatcctcaaatcccttaagaacttcagcttattcaggaagggatatttacagaaaactagcaattgtataagtctccaaaaaagcatacattacttgaggatccatatatttttggcatcctcagggttgctgtgatgatttatagaaggtttgtttatttaatttactttatttcaaataggttt

SEQ ID NO: 165745 - DNA, 601 bp, Human
acattacttgaggatccatatatttttggcatcctcagggttgctgtgatgatttatagaaggtttgtttatttaatttactttatttcaaataggttttaatttttgtacccttaagaaaagattcgtactcttccctggcagattaaagaaaatgagcgtatattccctaaccttggccagttactttcctgggtttgagggtttctgtgaacgtctaacttacctctgtgacctgtttctgcaaccaggggtgttgcaatggatgcttttgtcttgaggatgggacctttcaagaaayagattcactgaggtgcagtgggaaggtcagagaaagatcttcgtatcgcctattattatttgctcgtctattttttctcctttcttaaggccactaactgattctcctttgctaaggctgcctacttccactgagaccttgaaccacatgaaattgttgttgtctgtgtttctggtcaaatagtggcaattttgtatgattcaatcttgtcatttaattttttgggaggttattattctatttcataccttttttatacccatcttctttacttcatttacctgtccctcatacttgact

SEQ ID NO: 165746 - DNA, 601 bp, Human; identical to SEQ ID NO: 34194

SEQ ID NO: 165747 - DNA, 601 bp, Human; identical to SEQ ID NO: 34195

SEQ ID NO: 165748 - DNA, 601 bp, Human; identical to SEQ ID NO: 34196

SEQ ID NO: 165749 - DNA, 601 bp, Human; identical to SEQ ID NO: 34197

SEQ ID NO: 165750 - DNA, 601 bp, Human; identical to SEQ ID NO: 34198

SEQ ID NO: 165751 - DNA, 601 bp, Human; identical to SEQ ID NO: 34199

SEQ ID NO: 165752 - DNA, 601 bp, Human; identical to SEQ ID NO: 34200

SEQ ID NO: 165753 - DNA, 601 bp, Human; identical to SEQ ID NO: 34201

SEQ ID NO: 165754 - DNA, 601 bp, Human; identical to SEQ ID NO: 34202

SEQ ID NO: 165755 - DNA, 601 bp, Human; identical to SEQ ID NO: 34203

SEQ ID NO: 165756 - DNA, 601 bp, Human; identical to SEQ ID NO: 34204

SEQ ID NO: 165757 - DNA, 601 bp, Human; identical to SEQ ID NO: 34205

SEQ ID NO: 165758 - DNA, 601 bp, Human; identical to SEQ ID NO: 34206

SEQ ID NO: 165759 - DNA, 601 bp, Human; identical to SEQ ID NO: 34207

SEQ ID NO: 165760 - DNA, 601 bp, Human; identical to SEQ ID NO: 34208

SEQ ID NO: 165761 - DNA, 601 bp, Human; identical to SEQ ID NO: 34209

SEQ ID NO: 165762 - DNA, 601 bp, Human; identical to SEQ ID NO: 34210

SEQ ID NO: 165763 - DNA, 601 bp, Human; identical to SEQ ID NO: 34211

SEQ ID NO: 165764 - DNA, 601 bp, Human; identical to SEQ ID NO: 34212

SEQ ID NO: 165765 - DNA, 601 bp, Human; identical to SEQ ID NO: 34213

SEQ ID NO: 165766 - DNA, 601 bp, Human; identical to SEQ ID NO: 34214

SEQ ID NO: 165767 - DNA, 601 bp, Human; identical to SEQ ID NO: 34215

SEQ ID NO: 165768 - DNA, 601 bp, Human; identical to SEQ ID NO: 34216

SEQ ID NO: 165769 - DNA, 601 bp, Human; identical to SEQ ID NO: 34217

SEQ ID NO: 165770 - DNA, 601 bp, Human; identical to SEQ ID NO: 34218

SEQ ID NO: 165771 - DNA, 601 bp, Human; identical to SEQ ID NO: 34219

SEQ ID NO: 165772 - DNA, 601 bp, Human; identical to SEQ ID NO: 34220

SEQ ID NO: 165773 - DNA, 601 bp, Human; identical to SEQ ID NO: 34221

SEQ ID NO: 165774 - DNA, 601 bp, Human; identical to SEQ ID NO: 34222

SEQ ID NO: 165775 - DNA, 601 bp, Human; identical to SEQ ID NO: 34223

SEQ ID NO: 165776 - DNA, 601 bp, Human; identical to SEQ ID NO: 34224

SEQ ID NO: 165777 - DNA, 601 bp, Human; identical to SEQ ID NO: 34225

SEQ ID NO: 165778 - DNA, 601 bp, Human; identical to SEQ ID NO: 34226

SEQ ID NO: 165779 - DNA, 601 bp, Human; identical to SEQ ID NO: 34227

SEQ ID NO: 165780 - DNA, 601 bp, Human; identical to SEQ ID NO: 34228

SEQ ID NO: 165781 - DNA, 601 bp, Human; identical to SEQ ID NO: 34229

SEQ ID NO: 165782 - DNA, 601 bp, Human; identical to SEQ ID NO: 34230

SEQ ID NO: 165783 - DNA, 601 bp, Human; identical to SEQ ID NO: 34231

SEQ ID NO: 165784 - DNA, 601 bp, Human; identical to SEQ ID NO: 34232

SEQ ID NO: 165785 - DNA, 601 bp, Human; identical to SEQ ID NO: 34233

SEQ ID NO: 165786 - DNA, 601 bp, Human; identical to SEQ ID NO: 34234

SEQ ID NO: 165787 - DNA, 601 bp, Human; identical to SEQ ID NO: 34235

SEQ ID NO: 165788 - DNA, 601 bp, Human; identical to SEQ ID NO: 34236

SEQ ID NO: 165789 - DNA, 601 bp, Human; identical to SEQ ID NO: 34237

SEQ ID NO: 165790 - DNA, 601 bp, Human; identical to SEQ ID NO: 34238

SEQ ID NO: 165791 - DNA, 601 bp, Human; identical to SEQ ID NO: 34239

SEQ ID NO: 165792 - DNA, 601 bp, Human; identical to SEQ ID NO: 34240

SEQ ID NO: 165793 - DNA, 601 bp, Human; identical to SEQ ID NO: 34241

SEQ ID NO: 165794 - DNA, 601 bp, Human; identical to SEQ ID NO: 34242

SEQ ID NO: 165795 - DNA, 601 bp, Human; identical to SEQ ID NO: 34243

SEQ ID NO: 165796 - DNA, 601 bp, Human; identical to SEQ ID NO: 34244

SEQ ID NO: 165797 - DNA, 601 bp, Human; identical to SEQ ID NO: 34245

SEQ ID NO: 165798 - DNA, 601 bp, Human; identical to SEQ ID NO: 34246

SEQ ID NO: 165799 - DNA, 601 bp, Human; identical to SEQ ID NO: 34247

SEQ ID NO: 165800 - DNA, 601 bp, Human; identical to SEQ ID NO: 34248

SEQ ID NO: 165801 - DNA, 601 bp, Human; identical to SEQ ID NO: 34249

SEQ ID NO: 165802 - DNA, 601 bp, Human; identical to SEQ ID NO: 34250

SEQ ID NO: 165803 - DNA, 601 bp, Human; identical to SEQ ID NO: 34251

SEQ ID NO: 165804 - DNA, 601 bp, Human; identical to SEQ ID NO: 34252

SEQ ID NO: 165805 - DNA, 601 bp, Human; identical to SEQ ID NO: 34253

SEQ ID NO: 165806 - DNA, 601 bp, Human; identical to SEQ ID NO: 34254

SEQ ID NO: 165807 - DNA, 601 bp, Human
atggcttgactttttgtcatatcctgaaatgaagctttgcatttacccgatgagttgcgtctcctggtgctcctcagttcttgctatttcttttgtcttataaaagatcaggagcagacttattgtgcagatcgtccacctcttcctaatggagcgcatcttgggtgcccgagaaagtcctggttgccccagctcccgcaccttctcttgatataaaggctccgttttggggagatagtcgcgggggtgaaatctgtaaaatgcgaggagagcttggagccgggatcccgggatcagatcrctggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttcgggggcgtcactggcccttccctcttgctaggagataaacgctgcgcaaagccaatcaccaggctgagggggcggaggctgcttggagagtaacgtccccggctctgcctgctctgtgccggga

SEQ ID NO: 165808 - DNA, 601 bp, Human
ttctatgaataaaatgctaccattttactccgctgtttgaattgctttcattgagctggtgataagccaaatttcagactttcatcactggaaagaattttgaatgaaaatatctacaactagtcacactttttatagtcagtgtgggagaaggtcaaacttagtacaatctgaagctctagagtaaatttctctgtataaagttaaatgggtcccatgggatgtttcactcatgaccttggtagcattctgtctcagaaaaggctcttccttcccatgaatgcgaagcttgaaggatgttgccacccccctacttgtctctcattccagatcagacatgacttttgaacagctgcactgaaaacatttattgcataggatcatctacaagaagattcaatatgtacttttaaaaggaaaatagcgaaacacatcaacgaaatcactccacataaatcaatataatacaaaggatccctgcttatttggatcaaagaaaaattcactaagatggtcatctatgtgataccagtggcaggaattaatcattttttaggtaacctagtgtctacaaatatttccaggcttcaccacaatttac

SEQ ID NO: 165809 - DNA, 601 bp, Human
tttgtatctacttgttcacaaggtttctcttatagtctaattagtttaacagttcaagttttaaaaagctaaattgatttcacattaatctctgacccttcacccaagagagaaaaggaaagataataaggtaaaatgtttgcagttttatttgctattatgaattttcttcacttgataatgcttgagtgtgatttctcatgactttttttttaaaagtagttacctatttatgcttttaagactttatttaaaaatattcaaaaaatattcaaaatattcaaaaataatgtattccagyatatcttcaagagactgtgtttttcaacatgtcaactcagcatacttttctatctatctttatattgtactatttcatatttcaatatccatgtttctgtcatttagctaatttttctaaggaactaaaacaatccaaaaaaactgtacagatataaaaattgatcattaaaaactgcttatatttatgatgtgattataattccatttctactgttgagtttttttcagttaataggttaatcaaacacacaattcatcaaatatcttttaaccgttaatgaaaaacaaacatgcacgc

SEQ ID NO: 165810 - DNA, 601 bp, Human
gtcacatcagaaattctagaggccttacattttttcacagctatacttcgcatagacttcgacatttgaagctcctgatttccacttccattgccattccctcatcaaattttttacatcttctttctatacaattgtctttgtttgtatctacttgttcacaaggtttctcttatagtctaattagtttaacagttcaagttttaaaaagctaaattgatttcacattaatctctgacccttcacccaagagagaaaaggaaagataataaggtaaaatgtttgcagttttatttgctaytatgaattttcttcacttgataatgcttgagtgtgatttctcatgactttttttttaaaagtagttacctatttatgcttttaagactttatttaaaaatattcaaaaaatattcaaaatattcaaaaataatgtattccagtatatcttcaagagactgtgtttttcaacatgtcaactcagcatacttttctatctatctttatattgtactatttcatatttcaatatccatgtttctgtcatttagctaatttttctaaggaactaaaacaatccaaaaaaactgtacagatataa

SEQ ID NO: 165811 - DNA, 601 bp, Human
aagaagtcatttagactctattttcctccagtattatcaccttttaaaattccctattgcgattgttgaaatccttacattgcaacaattttgattatgccttgacatcgttacttctttgttttacctgacttatgatttagtcacatcagaaattctagaggccttacattttttcacagctatacttcgcatagacttcgacatttgaagctcctgatttccacttccattgccattccctcatcaaattttttacatcttctttctatacaattgtctttgtttgtatctacttgtwcacaaggtttctcttatagtctaattagtttaacagttcaagttttaaaaagctaaattgatttcacattaatctctgacccttcacccaagagagaaaaggaaagataataaggtaaaatgtttgcagttttatttgctattatgaattttcttcacttgataatgcttgagtgtgatttctcatgactttttttttaaaagtagttacctatttatgcttttaagactttatttaaaaatattcaaaaaatattcaaaatattcaaaaataatgtattccagtatatcttcaagagac

SEQ ID NO: 165812 - DNA, 601 bp, Human
tcacagacctggagacctaggagaaaatggtttcacgggctgggcccaggatccctgtgtgcagcctagggacttggtgcactgcatcccagctgctccagccatggctgaaaggggccaatgtagaactcaggctgtggcttcagagggtgtaagcccgaagcctttgcagctcccataaggtgttgagcctgtgagtgcacagaactcaagaaatggggtttgggaacctctgcctagacttctgaagatgtatggaaatgcctggatgcctaggcagaagttcgctgcaggggcgggrtgctcacggataacctctgcaagggcagtgtggaagggaaatgtgaggttggagccccccacccctcccacaatccctactagggcaccgcctagcggagctgtgagaagagggccaccatccttcagaccccagaatggtagatgcacagacagcttgcaccgtttgcctggaaaagccgcactcaatgctagtgcgtgaaagaaactggatggaagactgtatcctgcaaagccacagaggcggagctgcccaagaccatgggaacccacctcttgcatcagcgtgacctacacgtga

SEQ ID NO: 165813 - DNA, 601 bp, Human
agatacgtctaaggaataataccaaaacaatattttcttttatgctcccatttgctttttttcctcaagcaggtgagaaatggtacataaatggcacatcaatgcctaaccaaatttgtcaaaattttgcttgtctgtaatcatatgacaaaatcttagtattacaaggacattatctttttttataaacctttcttatcagagggtactgccggacaagaagtaagatatctttaacctagccaatgactggcttcctttgtttttctatcttagccaatcttctttctttgaaacatgrtatttgctatttaaggaatctcgtaaaaatactaggcatttttagagttccacatataaaaacattgatcacagtgtatttaaaattcttacttaaattagagttttagacatttttgttaagaaataagaattttactcttatgattatttttctgttatttagggatatatgtacatgagacctaaattttagaaatcagtttgatattgagtcactcggtaggaaatgaaaattgagctttaatttattttcctatttttttctgtttctttttttaactttaagcatcatgtaatg

SEQ ID NO: 165814 - DNA, 601 bp, Human
gagtctagtgataccatcatggctcactgcagcctcaacctcccggggtcaagtgatcctctcacctcagtctcctgagtagctgggactacaggcacacatcactaaacctgtctaattttttaatttttttagagaaggagttttatcatgttgcccaggctggtctcaaactcctggaatcaagcaatcttcccacctaggcctgacaaagtgctgggataacaggtatgagccactgtgctcagcttctatctgtcatctctgtttatcatctatctatctctatgtttacatgatrtttagcacatcaaacaatccaagtgcaaaatttaaaaaataatatcaattggacaatttttctaatgcttactagcttttatttaacttaataaagattctatcattattccattttatgtggcattaaagaagtgttatgtaagttaaattcagctcagatatgtactagacaatcccctgaactgtatgtaaagtctaaaagtgggtcaaagtattctacagtacaggtaggtagagaccaccagggttttagtcagttgaatatttttcagccccttatgatggtgactgaatctgt

SEQ ID NO: 165815 - DNA, 601 bp, Human
ataagatatgtaaaatatttgccaaaatgaatggaaatatttgaagttaaaagtgctatatcttgattaattgtttaatttaatgatcacatttttccttcacatataacacacatattttctttcaaagagtaaactaaaagatgtttgtataagtaaaaataatgactatgtgaaaaatttacttcaatgaaatgttacaaagacatctttgtttattttaacacttgtaaaggacttcaagaatgccaggacctcttctaaatttcacacacacacacacacacacacacacacacacaaatacatattatatatatgtttacacacacatatacataaacttaacatttaagcctcataacaacacaatgaagtagtactacaatcatatgtactttacagatgagtaaactgaagcacaaacacagaggatgggtgaccagcccaaggtcattgatttgtaagtgctagagctggggttcaaaaccaagcagtctacatctgattctacactcaaacttttttttaatacctgggctaaataaacatacacatagatgtgaaaaatacgtcattaaacttcatgagcattgttagg

SEQ ID NO: 165816 - DNA, 601 bp, Human
ttttaaatattagatgaaacaaatttgactccataggcagtgtggaaactttaaaactcatagacatggtcaattgtacttaaaaagaggaatatgactcaactgttcaggagaataaggcctcccagttacaatttcataataacataattcacatagaagataagaaaaatattttattgttgctctaagaagaatacttaaatttttaaaatatttatttctttatttctttatttattttgagatggagtctcacactgtcgccctggctggagtgcagtggcgggatatcggctcmctcctatctccgcctcctgggttcaactgattctcctgcctcagcctcctaagtagctgggattacaggcgccccccaccaccccagccattttttttttgtatttttagtagagacggggtttcactatgtttgtcatgctcgtcttaaactcctgtcttcaggtgatccacccgcctctgcctcccaagtagctgggattacaggcatgagccaccgcacctggccgaataccttttattgaacatttgttatgtgccagggagcattctctgtgctttgcatgtaatatatgtgatt

SEQ ID NO: 165817 - DNA, 601 bp, Human
aatttctcaaaaggtggtaagatgctcatcaattaaagctgaaggctgaaagataaatgctttccactttgaaagcaaaaagaagctaatggaataagaatatttatggagaacagattaatttaggaaacaaaccaacatatttgatttaattaatgaatgctaaatgagtatggtgctaactaaaggagcaattggagatcaaagagtaacaaatccacatgcagagtcttgaggatctgagcagagcacaatcagactttgtcaaggatagtaactgaggtacaggaaataacaagayagaagacacttcataaaatacaacgctttgtggttttaggagtccagcttgttcattttcctggggaagaatatatatacattttccctggaaaatagagtaatacaatgtccacatgttgctggtaaattaacaactctgtggttgagtcagatttttagtcatataattagctgaatgccacttatttaaaagaaagcattaaaaaatcaaaaataaccaacgagctgtgttgcactccagcaattcagtagacttgttgtgagcatccaaacattactagcagcaaaactgctgatt

SEQ ID NO: 165818 - DNA, 601 bp, Human
tttttcttgccacatctttaaacatcccaccccctatccgtatttgccaatacccactcttgattttctggtcatgaatttctcaaaaggtggtaagatgctcatcaattaaagctgaaggctgaaagataaatgctttccactttgaaagcaaaaagaagctaatggaataagaatatttatggagaacagattaatttaggaaacaaaccaacatatttgatttaattaatgaatgctaaatgagtatggtgctaactaaaggagcaattggagatcaaagagtaacaaatccacatgsagagtcttgaggatctgagcagagcacaatcagactttgtcaaggatagtaactgaggtacaggaaataacaagacagaagacacttcataaaatacaacgctttgtggttttaggagtccagcttgttcattttcctggggaagaatatatatacattttccctggaaaatagagtaatacaatgtccacatgttgctggtaaattaacaactctgtggttgagtcagatttttagtcatataattagctgaatgccacttatttaaaagaaagcattaaaaaatcaaaaataaccaac

SEQ ID NO: 165819 - DNA, 601 bp, Human
ttccactaaaacaaaccctcagtaatttctttttagaggattccaattgtagagaaaacaatatttgtactttattttcactataatagtaaaactagtaaaaaccaacccaattaaatagaataaaaatgatatattctgctgaattatcccttcaggaaaaaaatcactcaattactgtatactttttcttgccacatctttaaacatcccaccccctatccgtatttgccaatacccactcttgattttctggtcatgaatttctcaaaaggtggtaagatgctcatcaattaaagcygaaggctgaaagataaatgctttccactttgaaagcaaaaagaagctaatggaataagaatatttatggagaacagattaatttaggaaacaaaccaacatatttgatttaattaatgaatgctaaatgagtatggtgctaactaaaggagcaattggagatcaaagagtaacaaatccacatgcagagtcttgaggatctgagcagagcacaatcagactttgtcaaggatagtaactgaggtacaggaaataacaagacagaagacacttcataaaatacaacgctttgtggttttag

SEQ ID NO: 165820 - DNA, 601 bp, Human
gaaatgttggcttaattcattaaaacagcatctgtgactttggggggaagcattaaggcattttatcgcagccagcctcctttctcactactaggcctcttggctacagatgggacttaattgctccttaaatatatctaacatttatgcttacacaatattgcccactagccattcagcacttctgttgtagtttccctacccaaagctcattaattttactatgaattcttattactttttagtgcaaaaatataaaaattagtagtttgttcatgaacacacataaataagtgccagkttcaacaatttgctttttcaaaaaagagggtgagttaaaatcatatcgtacataaacaaacttcaagtttgtaaatagagtaaccattataaaataacggaaacatatatccatttggagattttactgaagcttattcttgtctagtgaaaatgtttagttatatgtgttccactgtgccaaggacaaactggtcctttccagtcacttaccctctgacagcatgaataagtctcaatgacggataggcagttcgcactttcagtttattcttaaggattaatgcattaacccactcca

SEQ ID NO: 165821 - DNA, 601 bp, Human
aatgcttttttctgaacttgtgttaataaaagggaaatgttggcttaattcattaaaacagcatctgtgactttggggggaagcattaaggcattttatcgcagccagcctcctttctcactactaggcctcttggctacagatgggacttaattgctccttaaatatatctaacatttatgcttacacaatattgcccactagccattcagcacttctgttgtagtttccctacccaaagctcattaattttactatgaattcttattactttttagtgcaaaaatataaaaattagtaktttgttcatgaacacacataaataagtgccaggttcaacaatttgctttttcaaaaaagagggtgagttaaaatcatatcgtacataaacaaacttcaagtttgtaaatagagtaaccattataaaataacggaaacatatatccatttggagattttactgaagcttattcttgtctagtgaaaatgtttagttatatgtgttccactgtgccaaggacaaactggtcctttccagtcacttaccctctgacagcatgaataagtctcaatgacggataggcagttcgcactttcagtt

SEQ ID NO: 165822 - DNA, 601 bp, Human
tatatcgcgagtatagactatataaagtctgtacagtgtgtgtgtatatataacagtaaatatgtatgtatactaattttatttttcatatatataacaaataaatactacttcagatataggttttccacaattgacatttatcaaaaaagttacgcatttttaaaaaaattaataattgcagaaatcaaagaaagggcaaattcagcaacaaacatgtctgtctattctttttatataatatttacctaggtatatatacatgcttatatatatgaatgtgtaactatgtgtgtctatrtgtgtatatatatttcttatatatttcaaatatatatatttcttatatatatttcttctgctgtcaagtaaacatttagatgatgttgggttaacttaactgtggtgttgaaacatgtaaagaataaatatcaagagaaaatgactttaaagaagaaatactttagaaagctatctttattatcataattaccaaaaatttaatgaacctgtttaggaagttacagagaatacattcctgaggatgtttaattaaggacaagagtttttttgtgacagtttgaatattcccatgtgtaag

SEQ ID NO: 165823 - DNA, 601 bp, Human
gactaattttaaaacaagtaagccattttcagaaagcacttggagtgaatattctcttttcaaagttgtttttttaaaattgcttttccttatgtgacttgagttgattgaatactccaaaacaatccattagagtgactaataaacttgatttcctgaggtctattgatgatgtattttagcctatagttttgctaaagactattgggagcctggtctgattcaaatccttctgcaaacccatgacattcacatgaagttatcctgcagaaggtcatcttcattttatatagactttaasctttactttcatttaaaatgaatttttacatctgaaagatgagtgcagcaactaacatttgagaaatgatatttttgttagtcttaatgctgaaaaaaagttgatggatgatgtgtgaaaatataatctgtttatttgttagaaaccataaaaaatattctaccaaagcaactaatgtgtgctttcattcttttaataaccattaaatatttttcaacagagtgaatactacccagatgagaagttagctagatatgtcacttgatatccgtaagacgtaatttttccctcttacattta

SEQ ID NO: 165824 - DNA, 601 bp, Human
caatgtctaacttcagcacaactttgcccatttttattccccacccctttgcacatgtgcctcaacctccaccgtaacatatactgggaatttatgcttcttattagttatagagatgaataagtcaatctttgctatgaaaaaatttaaaataaacctacagagttgaaaataaacaatagtcatacattatgaagaatgttccaaaagggaaatacatcccttgagaagagaatacagagagcagaaacccaggtcaatctcaccaaaaggaaaaagagtgagaaatgatgcccaattraaacttaacctttaaattgagacttgaaggaataaaaaatgatctatgtgaagaagagagaaaaatccataccaagaaggaaagcccaaatttgccaatgttacaggggtgctatgaaagcttaactactcttccaaagaaattctagatatttcgcaaagccttttagtctcagtgagagataaccagaactgggaagcatattggtcaggggcagaatgaaagctgttttccataggttccagtttgagccacacacttgggaatatcttctcagacataaactatttatacttccac

SEQ ID NO: 165825 - DNA, 601 bp, Human
tttaactttaaactcccaactatttaatatttaataattagttaaaatatattaattattttactatatataagaaatctctgaatgcgtaatcgaccagtcatcttgacttaaattagaataacttaatgcaaattaactcagtatatattttgcatattgatcaatgttcttttctcctgaaaagtcaaataaacaagggaatttccgaggttacctgtgcaccttctatcactcattaaaagattgagccttgaaagtaaaaggtaatagaacaaattattgagctttccctgtagtycgttaatatagcagtatagcgctttgttctgattatgaaattttagtcttagaatttataaaataatgacaattaatttatttccccagctaaaatatttttagtaacgatttttcctctattgaacaccatgataaattaatattaaaaaataatggattgatttctttatgcagattttgaaagataacacccaagagaaaactgttactaaattatagatctagggtacttttctcaggtggccaggatgaatttatagatggtcaaactggatgctcccatgcgtcatgcctcatt

SEQ ID NO: 165826 - DNA, 601 bp, Human
ttctccacaaactcaggaagtagctagtcatgttcactgtctaaaaatttatatttgcatttaactttaaactcccaactatttaatatttaataattagttaaaatatattaattattttactatatataagaaatctctgaatgcgtaatcgaccagtcatcttgacttaaattagaataacttaatgcaaattaactcagtatatattttgcatattgatcaatgttcttttctcctgaaaagtcaaataaacaagggaatttccgaggttacctgtgcaccttctatcactcattaraagattgagccttgaaagtaaaaggtaatagaacaaattattgagctttccctgtagttcgttaatatagcagtatagcgctttgttctgattatgaaattttagtcttagaatttataaaataatgacaattaatttatttccccagctaaaatatttttagtaacgatttttcctctattgaacaccatgataaattaatattaaaaaataatggattgatttctttatgcagattttgaaagataacacccaagagaaaactgttactaaattatagatctagggtacttttctcag

SEQ ID NO: 165827 - DNA, 601 bp, Human
gcgacgtttattaatggagacttgctgatggattatttgattatagcacagatggattccacaaagtatcaagttcctttttttaaaacaaaaacaaaaacaaaagttgactattaagaagcaaaaacaaagctgaaaattttgataaactgcccacatcccacctcaacactatccccagtttttattattctcagataggggctattaacatttataatgactgtacaattctttcaagcagtattgagaaacatatattttggtataaggttagcttgccatattgtagattttataygtgcctataaaatggtttttgcaaaaagctcactgaattctattgagaggaatatgatcataatttgaataaaatgcagaatcagaactttagctgcaagtaatgattttactttaattaagattcaccagtgaaaagaaaaaaaagttagtttctattagatcaaattatcaaatatattaatagtgtaaagtagaatctgtgccatgctagattatgttatgatacattcagtcacatgattcttttagctatttaatttcatccaagtttgtaactgatgcaaatattgttgagtat

SEQ ID NO: 165828 - DNA, 601 bp, Human
cttgaataggcgctgggtaaaataagactgagacctgctgggctacattccagacgattaggcattctaagtcacaggatgagacagaaagtcaacacaagacacagatcataaagaccttgctgataaaaccgtttgcaataaagaaaccaggcgaaactcaccaaaacctgtaatcccagcactttgggagaccgaggcgggcggatcacgaggtcaggagattgagatcatcctggctaacacggtgaaaccccgtctctactaaaaatacaaaaaagtagccgggcgtggtggcggscgcctgtagtcccagctactcggggggctgaggggggagaatggtgtgaacccgggaggcagaggttgcactgagctgagatggcgccactgcactccagcctgggagacagagtgagactccgtctcataaacaaacaaacaaacaaacaaacaaacaaacaaaccccaccaaaaccaagacggtgatgagagtgacctctggtcattctcactgctacactcccacaagggccatggcagtttacaaatgccatggtgatgtcaggaagttaccctgtatggtctaaaaagggaaggt

SEQ ID NO: 165829 - DNA, 601 bp, Human
tatgtaaatgaaatttaatatattatgtcgaagaaatcacattaacaaaatcaggtcacaatacctatgtacatgtgtcagaggcatttgaaacagagcaactccatcttgaataggcgctgggtaaaataagactgagacctgctgggctacattccagacgattaggcattctaagtcacaggatgagacagaaagtcaacacaagacacagatcataaagaccttgctgataaaaccgtttgcaataaagaaaccaggcgaaactcaccaaaacctgtaatcccagcactttgggagrccgaggcgggcggatcacgaggtcaggagattgagatcatcctggctaacacggtgaaaccccgtctctactaaaaatacaaaaaagtagccgggcgtggtggcgggcgcctgtagtcccagctactcggggggctgaggggggagaatggtgtgaacccgggaggcagaggttgcactgagctgagatggcgccactgcactccagcctgggagacagagtgagactccgtctcataaacaaacaaacaaacaaacaaacaaacaaacaaaccccaccaaaaccaagacggtgatgaga

SEQ ID NO: 165830 - DNA, 601 bp, Human
aagaaagtagaaaatcttttctacagaagctcttcatagtatacatacagacaatactttatcaaactttataagcttaattcatcagaggcataaaggactcatggcatgaagaaaggaatggagatactactttatgctcaatgatcactaaattctattcagtaccgatgtatgttatctgacgtctatcagagaaataaggctttgctgttagctctgaatttcacccctcttctttttatctgtctatgcacattgtcacatcaagtatggatacaatgttaagaaattctagatstacctatattatgttgattttgccaactgtctcatatttagtgaatacgtaactctcattattgtgatattaataattttactccatatagtttcaaaccactttcacatgatcctcataaaatattataatatacacaatagaatatattatcatccctacttcatagaggatgcagttgtggctcaagaagtaaaatagcttatccagttttactcagccaacaagctgtacattggtacgttggtgaatgtttaaagcagacactgggtgtcgggagacagttcaatgatatattag

SEQ ID NO: 165831 - DNA, 601 bp, Human
tgctgcattccactggaagtctatgtcaagggttaaaaaaatgtcttttggttcttccagtctgcagtaatttgagatattataaaataattggctttttttctttttttttttttgagacagagtctcgctctgtcgctgtgtcacccaggctggagtgcaatggcgcaatcttggctcactgcaatctctgcctcccgggttgaaactattctcctgcttaagcctcccaagtagctgggattacaggcgcccactacaacacccagctaattttttttttttttttttttttttttgkatttttggtagagactgggtttcaccatgttggccaggctggtctcaaactcctgatctcgtgatccacctgcctctgcatcccaaagtgctaggattacaggcatgagccaccgtgcccagccagataattggctttctattagtaatctttgcaggacatatctgcacattctcaactctagagtcaccccagaaacctaatagagaccatttatgatgaccttatttttcccatcaaaaatcacagtatggagcaataaataaatgtatgttttttgagattccatcattcacattt

SEQ ID NO: 165832 - DNA, 601 bp, Human
gaatgtgagatgaagtgtataacaaaatatacctttgtattcttaattaaggagtctcctctatttctcctctcatatttgtcttccagtaactgagatttgtgctgcattccactggaagtctatgtcaagggttaaaaaaatgtcttttggttcttccagtctgcagtaatttgagatattataaaataattggctttttttctttttttttttttgagacagagtctcgctctgtcgctgtgtcacccaggctggagtgcaatggcgcaatcttggctcactgcaatctctgcctccsgggttgaaactattctcctgcttaagcctcccaagtagctgggattacaggcgcccactacaacacccagctaattttttttttttttttttttttttttgtatttttggtagagactgggtttcaccatgttggccaggctggtctcaaactcctgatctcgtgatccacctgcctctgcatcccaaagtgctaggattacaggcatgagccaccgtgcccagccagataattggctttctattagtaatctttgcaggacatatctgcacattctcaactctagagtcaccccagaaa

SEQ ID NO: 165833 - DNA, 601 bp, Human
tttaacaagaaaggttgtaatgctgtaaaagagacagtaaaggtaaaagaacataaagcttgacatataataagcaatactacttggctctcaacatatcccaaaacaatcattcttcagtcccactcacaaacccacttctctcttggaaccttctgtgactacttattggctggacaattgtggtaacgtcgtttaacctcaatggacatgtttccttaattctgaaacaaacatttaattctatggctttggggtttcctctataaaattcaattgcagtttcaaatcttctctctcygtgaaattgtgtgaaacactcttattccttgtctccttcctcctcaccattttgttccctttccttccttcaggttgtaacacattgcgaagaaaagaaggtacctaataaatgcttattgattttaaatcctgtaatattttagattttatctcataataaaagcagataataatcacccgatgagtcaaaatacctgattatttcaagcaaccacagttttaggaacaaaaatgttatatttaacaacgttgatactaaggagagctcacattcaatatattgacaaacaaggaatat

SEQ ID NO: 165834 - DNA, 601 bp, Human; identical to SEQ ID NO: 23001

SEQ ID NO: 165835 - DNA, 601 bp, Human; identical to SEQ ID NO: 23002

SEQ ID NO: 165836 - DNA, 601 bp, Human; identical to SEQ ID NO: 23003

SEQ ID NO: 165837 - DNA, 601 bp, Human; identical to SEQ ID NO: 23004

SEQ ID NO: 165838 - DNA, 601 bp, Human; identical to SEQ ID NO: 23005

SEQ ID NO: 165839 - DNA, 601 bp, Human; identical to SEQ ID NO: 23006

SEQ ID NO: 165840 - DNA, 601 bp, Human; identical to SEQ ID NO: 23007

SEQ ID NO: 165841 - DNA, 601 bp, Human; identical to SEQ ID NO: 23008

SEQ ID NO: 165842 - DNA, 601 bp, Human; identical to SEQ ID NO: 23009

SEQ ID NO: 165843 - DNA, 601 bp, Human; identical to SEQ ID NO: 23010

SEQ ID NO: 165844 - DNA, 601 bp, Human; identical to SEQ ID NO: 23011

SEQ ID NO: 165845 - DNA, 601 bp, Human; identical to SEQ ID NO: 23012

SEQ ID NO: 165846 - DNA, 601 bp, Human; identical to SEQ ID NO: 23013

SEQ ID NO: 165847 - DNA, 601 bp, Human; identical to SEQ ID NO: 23014

SEQ ID NO: 165848 - DNA, 601 bp, Human; identical to SEQ ID NO: 23015

SEQ ID NO: 165849 - DNA, 601 bp, Human
cccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctccmagacccctgctccactggcccttcgaccagtcctcccttctgttctctctttccccgtccttcctctctctctctctctctctttctgtgtgtgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccac

SEQ ID NO: 165850 - DNA, 601 bp, Human
aggcctgccctcccatcatgttactttgggctcccaaaacaagcccttgtgcttctttctcaagacttccaagcagatacctcttcccacagaattccaaatcagttaggaaatagatatgggatagggagagatatagcgataggtagcaaacgtcaccttggatggagtgcctggcttgcctggtgtttctttgaggccaaaatgggcttcctgacacttgccgcaagtctagactcgagttacattgttaaaaaggaaagggtgacctgaccaggcagtggcagggctacaggacagkagtaaccaaccgtggtgtccccctactcatgtgttttatgttctacttgttaagtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggtttgtaatgcatcacactggaacttaaaattcccacctttgagccctctgtgacttttccattacattttccctagtgtgagcacctctttgaagaaaagccagtgt

SEQ ID NO: 165851 - DNA, 601 bp, Human
gagaaaaaaatctgcctgtaaatggactcacaaggttcaaacccatgttgttcaggggtcaactgtaatactgcctgaagacctgctcaacatcaggccactttacatataagtagttcatcccattgagatgcaaaagtatcccatcaggtagacagtactggtctcactcaacaaatgagaaacaggctcagagaggttaagcgacttgcccaaggtcacacagcctgcacacagcctgcgcagaacttgtgtttttcccttgtactctgtcaggcttccgatctgcaggttgacggastgggaagcaaggtatggagggacattaagctagaagggttaccaggggcaaaactgggcagagggatcacaggccaggctaaggagccctttacggttcaggctctgaaggtttaagagcagggagatgccctgaccagggccgttcactacgaagattaacctggtagagcagggaggactagctaggtgagagctgggaaacaggggagctactcatcagttgtctaatatgtgcccctctctgttctaggtcctggagtaccagtagtgaatacaacaaagatgcctgccctcagac

SEQ ID NO: 165852 - DNA, 601 bp, Human
ctgtgaaacttcctccccctccccagggaaggtgagtcgcttccacagcacctgtttctgctctcatcctcacactcagcaccctgtaggacaccacgagcccctggaggcccagcagacagcctggaatggaagatgggtttgagtgaattatcgtgctgccgctggccatgaggccttatctgtaaaacagcgtccttcttccctacctcagagctactgtgaggctcaaacaaacccccagggttaaagcgggagctgtaacttgtaaaagaacccccaggtgtcacctcatgcattratttcctcattcacaagttatcaaatgccagccactaccaggcagaagctgacaaagacacactgccaaccttcaaggagcccgccatctagggtgggagacaggagcaagcaaagagtcacagaagtgcgtttccactctgatgagggcaagcccagagcaccaatgcaggctgctggctcagggaagcctgccccaactaggagatccctaagctgacttcaaaaggccccagaagagtgagtaaaacagagcgcatggtgtcctgaaagacattccatggccagggtgggaaggaca

SEQ ID NO: 165853 - DNA, 601 bp, Human
caggaatccagagcccccgatcactgtgcatctcttggcctgtggaaagagaggaacggtggggaagaccagggtagtgaggactggaagctacagagtccagacttacatatcatgagccactgcaatggcagatatacttgtttgtttggaactcttcttgagccaagttggaagctttatatcatcctggtgttccatcactagtgcaaccctaaccttctctcctgggatcagtaaggagggaagagagatagcgaatgacactgagattgactttggttgggtttgatgacaagayccatgctttgtattcagtgaaaggaaatcaaaccacctatgaccaaaactggacaatctaaaaaataccccaaaaaacagtgataccttcttgttcccgatagctgatccctgggcgcttctctaaggacaaaacaaaacaaaacaaaacggcagccatttggtagctgatagcttgcactgaaaacaacagaaagaagaaagcagtctccatacttgcaggacaaagtcagtccctttccctctctggccacaacagggctgggctgtgtggctctgggctcatcgcccaaccccttct

SEQ ID NO: 165854 - DNA, 601 bp, Human
caaccaccagatatggttgcctcaaggtccctggtggcagtgactgggtagggaagaggaggtggcttccagctggcaccaggatgggcactttggtggggatgaggcgtcctcgggaacagcaggggaggctgagtagagacgtggatgtgggcaggtttgtggagatggtgcttggtggtaccaagggtctgcttgagggccatggccatgcacaaggcaagatttaaccagggtgggggttacaatgtgaagtacactgtggtggccacatttatttgccacctgggccaggctctartccccggtgactccattaaacacgagtgtaggtgttgctgtagaggtattttgtagctgtggttgacatctacaaccagctgactttaagtaaggagattacccttgctactctggacaggcagtatatactcagttcaaagaccttaaaagtgaaactgaggtttctgtaagaagaaattctaacgtgggaccacagcatcaattcctgcctgagtttctggtctgccctacaaatttcagacttgcctagtcagcccccacaatcatgtaaaccaattctgtgaattaaatctcaacc

SEQ ID NO: 165855 - DNA, 601 bp, Human
ctggaaaagcagagtaggccatttatggagatagagaagacttagcagaaataggtttgctgtggtgggggaggggcttgcgtcagggaaccaggagcttaattttggatgtagcaagcttgaagtgtccatgaggtatccaaacagggatgtccagcaggcatacacacacatacgctcacacacacacacacacacacacacacacgtgcctgagagagctaggggttggagataacaagcagggagcacatcagcttctagacagtaattaatccatgagatgggatggagtcactgygacactgtctaaacttggagaagaaaagagaataagttctggagtctgcaaagtttagaaatgatagtgatcaggagacaatcagtgaggcaggaggagaaatgagtgaggtggtatctcagaaggcaagcaaagaaagcatcagatgctgctacagggccaagtcagaggaggactgagattcaaccaccagatatggttgcctcaaggtccctggtggcagtgactgggtagggaagaggaggtggcttccagctggcaccaggatgggcactttggtggggatgaggcgtcctcggg

SEQ ID NO: 165856 - DNA, 601 bp, Human
gttggattggggatctattctgagtggagccaacaagatttcctgatggatgggatgaagggcatgagagagaaaggaatcgggcagggatgaatctaaggtttttggttgatggaactggaaaagcagagtaggccatttatggagatagagaagacttagcagaaataggtttgctgtggtgggggaggggcttgcgtcagggaaccaggagcttaattttggatgtagcaagcttgaagtgtccatgaggtatccaaacagggatgtccagcaggcatacacacacatacgctcacaaacacacacacacacacacacacacgtgcctgagagagctaggggttggagataacaagcagggagcacatcagcttctagacagtaattaatccatgagatgggatggagtcactgtgacactgtctaaacttggagaagaaaagagaataagttctggagtctgcaaagtttagaaatgatagtgatcaggagacaatcagtgaggcaggaggagaaatgagtgaggtggtatctcagaaggcaagcaaagaaagcatcagatgctgctacagggccaagtcagaggaggactgagatt

SEQ ID NO: 165857 - DNA, 601 bp, Human
tataactatatatacataaactttatctatatgtatgtatatctgtctctctcctctctctctctctctctctactgactataaaaacacatttttaaaaaaaaagaaatggggggggtcttgttatgtagtccaggttagtcttgaactcctggcctcaagtgatcctcccaccttggccttccaaatagctgggggactacaagtgcataccaccacacccaggtgaaagtacattttaaaagtccttctcggctgggcgcagtggctcacacctgtaatcccagcactttgggaggcmgaggcgggcggatcacctgatacaaggagttcaagaccagcctggccaacatggtgaaaccctatctctactaaaaatacaaaaattagccgggtgtggcggtgggcacctataatcccagctattagggaggctgaggcaggagcatcgcttgaacctgggaggcggaggctgcagtgagcttagattgtgccacagtctgggcaacagagcaagactatgtctaaaaaaataaaaataaaaataaaataaaataaaataaaataaaaaaggtcctctcctgccatgtctttcacccac

SEQ ID NO: 165858 - DNA, 601 bp, Human
taccagtatacagaaaatactggaggacagaagggcatgttaaacgcaatggggatgtaatcggcaaaacccagactgtgggaaatactacagcaccataaacatggtttctactaaacatcagttattcaataaatagactgaagtttaaaaaaatgaagggaatcgtaaattaaaagagagctaaatatttcaaccaaatccatagtcttgatcttgcttggttccttatttggaaaaacaataatacaaaaacatttataagacattcagggatatctgaacgctggctagatactarggaactactgtcaatgtttttaaaaataatccttatcttttagagacaaatactgaaatatttgcagataaaatgatatgatgtctaggattgacttcaacataatctgaggaggaatataggtgaaacacgattggccatgagcagaggcagggaggaggaaatctcctatgaaatagtacaaaaagagaaagagaaggaatgcaagaaagagaggataagagacagatgatacaatgaaagaccaccatatgtccagcacggcttctagaaagagagaaaagagagaaaaggggtaga

SEQ ID NO: 165859 - DNA, 601 bp, Human
ctggcattgcaggcgctagccctgcacccagcccacggattctttttgaaatcaaaatgcattgtcatccactactgttatgttttgagaggctcaaaatgctcaaaatgtcccaaatttggccaggggaagcccttcaagttggctcttgtatcttcttggcaggtccccattcattttgtgctaagaaaatgtcccagactcattttgtactgcccttgccctagggtcctagaatgagcaattttcccaagaagccctagttctttttatgggaaatggtatatagaaacccaaatcygagcactaggcatgcttattactattggagtatcagaagtaataataccccagagggaaaaactgaaccagagtccgatcaagtctttagtccagtagaaacataataaaagtcacagtgactttaaagtttatagtaatgacattaaaaagtaaaaagaaaaaggtgaaattaactttaatgagacagttacattccttttttctgtaggtagtttttgaaatctggtgtggacttcacacttacagtgcttctcaattctgacttgccacattttaagtgcccaatagttgcacgtgg

SEQ ID NO: 165860 - DNA, 601 bp, Human
tttttgtattttagtagagatggggtttcaccatgttggcaaggctggtctcgaacttctgacctcaggtgatccacctgtcttggcctcccaaagtgctggcattgcaggcgctagccctgcacccagcccacggattctttttgaaatcaaaatgcattgtcatccactactgttatgttttgagaggctcaaaatgctcaaaatgtcccaaatttggccaggggaagcccttcaagttggctcttgtatcttcttggcaggtccccattcattttgtgctaagaaaatgtcccagackcattttgtactgcccttgccctagggtcctagaatgagcaattttcccaagaagccctagttctttttatgggaaatggtatatagaaacccaaatctgagcactaggcatgcttattactattggagtatcagaagtaataataccccagagggaaaaactgaaccagagtccgatcaagtctttagtccagtagaaacataataaaagtcacagtgactttaaagtttatagtaatgacattaaaaagtaaaaagaaaaaggtgaaattaactttaatgagacagttacattcctttt

SEQ ID NO: 165861 - DNA, 601 bp, Human
gattttttttttgaaaccagtcaagtaagttgcagacatcatgctgcctctaaacgcttcacaggtatctcctaagaacaaaagcattctcctaaataaccataaaacaatgatcacactcaagaaacttaacagatatgatgttcttatccaataattagtctatattcaaattcccccaattgtcccagtaatgtcttttatagccttttgttttggggtccaggatccaattgcgcatgacatgtagtatttagtcctcaggtctcttccatctcttttaatctgagacaaattcccrtcttttctgtcttattttaatgctgccatttttcaagggtttgggttattttatagactgtccttcagtttggattagtctgtttcctcaagattagattcaggcttaatggttttggcaagaataccacatcagtggtggtgtgtccttctcagggaattacctcaggaggtgcaagtctgtcccacttttggtgatattaagttggagcacgtggtgatgatgatggctgccagattccggccatcaaaaaggtaccttttcctttgcaattgataagtaatctgtagcatgttaatt

SEQ ID NO: 165862 - DNA, 601 bp, Human
aaccagagttacatatgccaagatgaataaagaaaaacataacactggggaaaaaagcaagttgcaggaggatctgttcaataagatatcattgtataaaatcttataacatgcaatccaatactttatattgcttacacatggagcaaatggaaataaacccaaattcagaattgctatccatggctacaagaagagagcaatggcatcgaggatgggcacacattacacatgccagtaatgttgtttcttaaatgctgtggtgagtggagaggtgctgttttattctcaaatcttgttrtttttttaattttttttttaagagacaaggtcttgctctgttgcctaggctggggtgtagtgttgggatcacagctcactgcagcctgaaaatcctgggctcaagcgatcctcctgcctcagcgtcccgaaacagttgaggctacaggtgcataccaccacacctggcttttaaaaattcgtgtagaggtggggtattgctatgttgctcaggctggtcttgaactccttggctcaagggatcttcctgccttggcctcccaaagcgctgggattacatgtgtgagccgccacacctggg

SEQ ID NO: 165863 - DNA, 601 bp, Human
ccaacactgaacaccattagcatgaatcatatcgttcccattcttattcaacattgtatgagaagctctagccagagtggtagggtaagataaacacgaatttataatgatttgaaaagaaactgaacttccatcgcttacagatgagagaaaaatctacacagaaaacacaggcaaatatgtagaaaatattagcgtttggcaaagttgctgaattaaaaatcaatatacaaaaattaactcgtcttatatattagcaataactgaaaatgtaatagaaagttattaaataacaaaaaaygaagtacatacaaataaatttaacgagatatgcaaaatctttacgaagtaaagtataaaactctattgatgacattaaagagcgagataaacagaaacatatcccatatttatggacaggaacactcaatatgggaaagatgtcaattctctccaaaattacctacaagttcaacacaattacaacagcagtctcagctggctttagcaaggaactggttaagccaaacatatgtagaagaacaaagggctcagaatagccaagtgaagtttgaagaaattggttgggggcgtgatttat

SEQ ID NO: 165864 - DNA, 601 bp, Human
cccctgcacgaaggccagggccactcccaagtcttggcatttgagagactgtgacctacagaatggctgccacctcacttggcaaggccggcccaggcactcatggatgcctgtactggttaaagatgtacactgggccgggactcctgggtcttcagggttagtggaatctgaaagctgggggacctgcccacccattccagcatggccaacactggtgctgtctctcctgtcccgatttgggtagcagcttttcagccccttcccaggagacacggggccaacgccttgctctggtccyccgtttattgaccagtctccctgtaatccttcaaggtgacaagtcagggtagcagtgaggctgagtgagaaacaggaaggcaaggcagagggaaaaaggaaggaagagagagaggagaaaaggaggaaatgaaggaagagaaagcctatttgggagagaggcacactgttgtcccctgtggaggcccctccacctgcacttaacccgaggagaaaagtaatgcccccgcctgccttcccagatgcaaggacagtcaagccctggcctttgacccggggcccattgctttccctctgagtc

SEQ ID NO: 165865 - DNA, 601 bp, Human
tgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgcccctgcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtc

SEQ ID NO: 165866 - DNA, 601 bp, Human
cctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcrctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccac

SEQ ID NO: 165867 - DNA, 601 bp, Human
acacacagctgctgcggtccctccgtagtacacttgagccccgtcctgggtgctctcaccctgacacccgcacaaagtctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactstatggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtg

SEQ ID NO: 165868 - DNA, 601 bp, Human
cagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagyaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctg

SEQ ID NO: 165869 - DNA, 601 bp, Human
ttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgycctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaatcacataacaaacttcaacagaaccattttaaccttttgaaagtacataactccgaggttta

SEQ ID NO: 165870 - DNA, 601 bp, Human
agggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttcyaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtag

SEQ ID NO: 165871 - DNA, 601 bp, Human
atactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctrtccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtc

SEQ ID NO: 165872 - DNA, 601 bp, Human
cactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacasagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacagg

SEQ ID NO: 165873 - DNA, 601 bp, Human
tcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagyttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggc

SEQ ID NO: 165874 - DNA, 601 bp, Human
tcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattkttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaa

SEQ ID NO: 165875 - DNA, 601 bp, Human
ctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccrggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttg

SEQ ID NO: 165876 - DNA, 601 bp, Human
gcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctstcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttt

SEQ ID NO: 165877 - DNA, 601 bp, Human
attctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctyggcctcccaaagtgctggaattacagctgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaacta

SEQ ID NO: 165878 - DNA, 601 bp, Human
tgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttmagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcagggacaccagattgaaccagacccagtcagacacgggggctgtgaggaggcca

SEQ ID NO: 165879 - DNA, 601 bp, Human; identical to SEQ ID NO: 35533

SEQ ID NO: 165880 - DNA, 601 bp, Human; identical to SEQ ID NO: 35534

SEQ ID NO: 165881 - DNA, 601 bp, Human; identical to SEQ ID NO: 35535

SEQ ID NO: 165882 - DNA, 601 bp, Human; identical to SEQ ID NO: 35536

SEQ ID NO: 165883 - DNA, 601 bp, Human; identical to SEQ ID NO: 35537

SEQ ID NO: 165884 - DNA, 601 bp, Human; identical to SEQ ID NO: 35538

SEQ ID NO: 165885 - DNA, 601 bp, Human; identical to SEQ ID NO: 35539

SEQ ID NO: 165886 - DNA, 601 bp, Human; identical to SEQ ID NO: 35540

SEQ ID NO: 165887 - DNA, 601 bp, Human
ttttgttttttgttttgttttgttttgttttgttttttcagtttctctgcaggtggatattgttcccagccagggggagatcagcgttggagagtccaaattcttcttatgccaaggcaagtgcctagtgctcagctgcattttagaacttgcttcagaaactcactgggtagagcaggagccctcaggccatgtgagctggctggtcaagccacacctagaattcttggcattgctctattacagggtcaatagtatggccatttaagagccagggcctcttccttccttttgcaaaaakctgcctcaacatagcaaatctgtcatctagacttcaccttgactacagaggaagtctaggagttttcttagaaaaatcagcacaacttccagaatagtgaatcatcccccatctcctattctgtatacattcagagttctgtaaatgacaatggagaacagcactggctcagaaacaatacttcggtggatctgtttaaggcttatttcttagaattccccagagcttgaaaatctaagtctaaaacttgcctgtaggtaaatagaatactggtatggcttttgttgtgaggacatatat

SEQ ID NO: 165888 - DNA, 601 bp, Human
ttgcctctgaaaccccatctgtaggtggcatctcgttaccttgttatttatatcatgcatccatcccagtggttggagtaatggtgggtgacagctaatggaacagtattgattgcacggtatttattgccattaaatgtgcttttttcctgttcttttcatcagcattctgtctgccgtaggaaagttggggtgggactgggagtagcagttcgagtgggagacaagaaaaggactgatgattcttactattcgttgtggaatggatgttccaccagttcattctacctataacctgtgyttcactggcatcatcctgcatgacaaggaacccttggtgaagatattcctttcattctgtagacccttttctgcacaaaatgtgataaatttagcactcaatgagcagatattggttgccaagcattggtaacctatgcttgggccagctgctctgcctgacgtctctgagggtgcccctcttatacaactgtacatcaggatcgagacttgcccaggactcaagtccaggtaccatggctctagtgaaaggggttctttgtgagagaagcagctgttttccctcactcttctgttcatc

SEQ ID NO: 165889 - DNA, 601 bp, Human
ggaaaaaggaaagagactcagccacctgcctgcagatgctctctgactgattcttggatgaacctgcctcttatctcttctagtccgattcatagtcctgtccaacaactacctgcagatccggggcatcaagaaaacagatgagggcacttatcgctgtgagggcagaatcctggcacggggggagatcaacttcaaggacattcaggtcattgtgaatggtgaggagagtccgttcttcctgatctctgcattgctacaaccttggttctccaaaatcattctctttaacttcctcttsggtctgtaaattaaatcctgtcctgactcaatcatccgtctgagctaaatcccctccccaccgtaacatctagatttctttttttttttttttttaatatacttgcctgttggatcttccttcaactacgagggattttagtgcagcaactgaatgtccttcaccgttctgcagcactaaaaactttccccctgcttacctattaatcctcattgtccttgatgttaccataattgtgaagttattccgctgcttaaatgttcaaagaaagtattaagtcaactcaggcctcagaatagt

SEQ ID NO: 165890 - DNA, 601 bp, Human
tgttcaaagaaagtattaagtcaactcaggcctcagaatagtcagaatcatggtccataggcttgttaatcttaacttgcagtgtcaaataaacacacccatggaattgatctgacatttacaagatgtttacaggaaattataatgtcagtactaagaaaataagtaaatcagggttgaattgttttgactattgacacatattttttttgccaaactctccccatctcattcctttggtaaaaaacagttttgtacaaggttgtttatcacagtcccagagaaatggcactctttgttrtagctgatgcattcgaattggtgttaaccatttaaccactgggagcagtaatgtccaactttttccagtacaaagagctcctttttaacatcaagtttcactgaacctggtagttattaagtttagtatgcattgactgagaaaatacataatgaagaatagtgactataaattgaataccatcttaacatgcataaaatgtattactatagcttctcaattaatgaaaaacaaaaatgcatgtttgtagaactgtctattcagtttgcagaagttatttagtacatacatgaatttcaa

SEQ ID NO: 165891 - DNA, 601 bp, Human
tcccattgactcagtctgcattctatggaacctaattaaaaataaacgtcttatttctgtggtcgaaatcatgctactttgcatttctacatgctctagggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttggtaggggcagtgggggcccaggtcactgctcygccacaattccccttcctctgcacattcagtccatcagtaagaccctggccactgtccctcagaacataacccaatgcaaccatttcttgccagttccaccacctagtccaagccctagtccaagccaccatcatcctcacctgagcagtgggacggtctcatagctggcctccccgactctccctattggtccacttcattcacttctgctcacagtagtcagaatgacctaagtaccactcatctgtttgaaagcctccagtggctccctatggcaaccagaataaaattcagactcc

SEQ ID NO: 165892 - DNA, 601 bp, Human
taatggccctcaagtctctccgcgtgtctgtttagaaaacacagataaactggtctactgtagacagcactggggaagtgccagtctgaggcgcagctctggtgcatggagcccccaggtcattaaaatgtgcacctgggaatcagggttgggacctgcttatccagcctgataaggagaactgttcataaacacagacctttgaaaatcaagactttatatgcaaatgtcctgctagttattcagtagtaaacagctgggtttagaaacaggctatcagttaggttcaagttaaccgtaygtatttgagagagaaagctaaacttcatgaaaaatattcttgaaagtcttttcttgaattcagactgatcttccccaatcactatggttttagtaagtttttccatattgtagaaaaagatagatgcatttgttaattaatcccttcatttaataaatacgtatggatcaccattgttgctggacagaggggctacagagatgaataggatatgatcccttgaccctgggaagcacaaagagggagataaatggataaacataaatgttataatagtgtcagtcagcaacatttgagtga

SEQ ID NO: 165893 - DNA, 601 bp, Human
gactttatatgcaaatgtcctgctagttattcagtagtaaacagctgggtttagaaacaggctatcagttaggttcaagttaaccgtacgtatttgagagagaaagctaaacttcatgaaaaatattcttgaaagtcttttcttgaattcagactgatcttccccaatcactatggttttagtaagtttttccatattgtagaaaaagatagatgcatttgttaattaatcccttcatttaataaatacgtatggatcaccattgttgctggacagaggggctacagagatgaataggatrtgatcccttgaccctgggaagcacaaagagggagataaatggataaacataaatgttataatagtgtcagtcagcaacatttgagtgactgctgtggactcagtcattgccaagtttacaagatgaataacatggactctgttctcatcagtagattcacaagctaatgtagatagtcaacgctggaatttgaaatgacaacacattattatggctgcaaaatagcaatatgcacagtgttttataggaaacaagttctctggtcctgtgtgatgtaagttagagaagtcattaaaatgt

SEQ ID NO: 165894 - DNA, 601 bp, Human
agagtcaggtctgcatctcctaaaacacctagactagggtcttgtacttagcagacagctaacctttgttggataggtgcatgccatcatttaaacccagaaagctcaataattagataaactcagagaaatgttttgtcttttcagcaaaacccaaaatcacatatgtagagaaccagactgccatggaattagaggagcaggtcactcttacctgtgaagcctccggagaccccattccctccatcacctggaggacttctacccggaacatcagcagcgaagaaaaggtatcatgctscccaggagtttcagggccttggaatgcagactcaaagcagattgagtctgctcatgcccagttctctttggggagctgggagatgggttatggtcaccagaggccacagccagatcccggggcctccctccccaaccctgcaggacatggcctgctcatcatccccttgtaatggaataggcacaattccttggataggttggtgggggcgtgatgtatgggcatgctcaagttagatgttctggggaggaggcaatggtgattgtcaatcccagagttatggagctgtgagggaacaaa

SEQ ID NO: 165895 - DNA, 601 bp, Human
tcactcttacctgtgaagcctccggagaccccattccctccatcacctggaggacttctacccggaacatcagcagcgaagaaaaggtatcatgctccccaggagtttcagggccttggaatgcagactcaaagcagattgagtctgctcatgcccagttctctttggggagctgggagatgggttatggtcaccagaggccacagccagatcccggggcctccctccccaaccctgcaggacatggcctgctcatcatccccttgtaatggaataggcacaattccttggataggttggygggggcgtgatgtatgggcatgctcaagttagatgttctggggaggaggcaatggtgattgtcaatcccagagttatggagctgtgagggaacaaagagaaggcaatatcctggtccaccaggtgacattgtcatcatatcaagggcaccctaggaaagatctcccagaaataaccaggctcaaaatgaacctattaattctttttcttgtgtttgtatactcatgctatatatgcacttatgcacaaatgcctggttgccattgtgtctgcctgtattcttggtcacatttggatacca

SEQ ID NO: 165896 - DNA, 601 bp, Human
taggaaaaatgaaaagcattctgtgaaccttgaatcttaggctgacagaatatcccacaagtaagagagaacttttgaagttctggattctttggaagctggagtttccttttcacgagaaaaaaattcctcattcagtacaaacccagggcccgcttttaaacactggaaaagatgactgcattaagcaatcagtctggtttatccagcgtgtgggcacatgaataatggaatacctaagaaaactatagaaatgcttcactttattttatatatgtgttcctgcagacttgtgtgtaasacaataaaatatgaatatcaaaacaacctagaacaatttttggaggattactaatcacactctgatttatttcataagtgtgtacatttgcatatcaggttgtcctaatgtgggtcacacattcaccaaattgttagggccgagatatttcctatctttccaccaggcacaaaagtagaaggttatgttactggaagctttgtgttactagcaactacttattctaaaagccacagaaccatagtgatttgggagagacacaaggataatcagatttgaaaaaacatacaactcaatgtg

SEQ ID NO: 165897 - DNA, 601 bp, Human
tgtgggtggaaaatccctctaacctctgtgtccctgggttggcttgcaaatgccaacttgtgaatggaatgccatgtttgatggagatggtacatgctggagtccacataccatctgtgcattctctgctgttaaggactggagccctccctcaaccacttccatttggtatcctcaaagcttcctgactcctggtctcaaggacttcatacttctcattcctagtgtacctctctgctccttgctttgttcctttttggcaataaaaatttgattttaacagaatgcatgcaaagagttrtaaaatgcatgagcattaaatggcattagtatatctatgataagctgccttataaaatccaaagaaggagacctattctctctctctctctctctttttttttttttttttttttttgagacagagtctcactctgttgcccaggctggagtgcagtggtgcgatctcgctcactgcaagctctgccttccgggttcacgccattctcctgccccagcctcccgaatagctgggactacaggcgcctgccaccacgcccagctaattttgtgtattttttttagtagagatggggtttca

SEQ ID NO: 165898 - DNA, 601 bp, Human
cactggagtctatctgtgtatcctcaaagggagaactgggcatctggcagataattccatcatcaaatctgtagtgagcctactgcaaaataagaattctctttagaaggctggtctgtggacatcattaaacaggagaaatttccacatggagaaatttcctgaaagaaactagataggaattaaaaaaaaaaagtatggctgttcacgcaactgttttctaagcttcccttcaaccatttctagactattctgagtaaagacttggaatatcccctgctttgttgtcgttaaggtcctgttcttgcgtacattcatttctctgcctcttttgttacaacatctcttccttatggaaatgttctcttgacttccagaagagtattgttcaatttccaagtttgtgtgtggtggccccaggacaagtctggtctgtgtcacaaagaattttagttcagttgctggttgatatcacagagatcaccagaaaggccaggggttgtccttaagttccctctgcctgcagtcctgctttgttttggacaagtaggagtgacaagcaggtcagcacagccctttagagatacctgcagggatggcc

SEQ ID NO: 165899 - DNA, 601 bp, Human
acattcatttctctgcctcttttgttacaacatctcttccttatggaaatgttctcttgacttccagaagagtattgttcaatttccaagtttgtgtgtggtggccccaggacaagtctggtctgtgtcacaaagaattttagttcagttgctggttgatatcacagagatcaccagaaaggccaggggttgtccttaagttccctctgcctgcagtcctgctttgttttggacaagtaggagtgacaagcaggtcagcacagccctttagagatacctgcagggatggccccatgctctygaggccactagtctagactcacgggtaaagacttgtgtatgatgtatgaaaatagccctggaggtaggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttcta

SEQ ID NO: 165900 - DNA, 601 bp, Human
cattcatttctctgcctcttttgttacaacatctcttccttatggaaatgttctcttgacttccagaagagtattgttcaatttccaagtttgtgtgtggtggccccaggacaagtctggtctgtgtcacaaagaattttagttcagttgctggttgatatcacagagatcaccagaaaggccaggggttgtccttaagttccctctgcctgcagtcctgctttgttttggacaagtaggagtgacaagcaggtcagcacagccctttagagatacctgcagggatggccccatgctcttraggccactagtctagactcacgggtaaagacttgtgtatgatgtatgaaaatagccctggaggtaggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctag

SEQ ID NO: 165901 - DNA, 601 bp, Human
gcatggggcatgttgggggagaagcatctggtgagatgggccaggaggacaggatacagtgacaggattcccaagagtgagcagaaatgacagagatgtgccttgtgactgagagttaatggtcttgggccaaactgggctcacctgagtctccatatgtgtcttccccacagacaccccctcttcaccatccatcgaccaggtggagccatactccagcacagcccaggtgcagtttgatgaaccagaggccacaggtggggtgcccatcctcaaatacaaagctgagtggagagcagtkggtgaagaagtatggcattccaagtggtatgatgccaaggaaggtgagttgggcgagttggtgtttccattgggatcatgagtgcctcagtactcagatgtccccacctgccatcctgggcatgttcctacagaatcaggaactgcacctccagaattaggtcaaagtcatatctgcctgtagagttgttgcccctattgccaccccaacccatgctctgtgcttcagagcctggttctcatgacccttccagtatggatgaaggcatctgtaccacattccaggcaggaaccttgtgta

SEQ ID NO: 165902 - DNA, 601 bp, Human
caattctatgcatatgcccagaaatagaattgctggaccaaatgataaatctacagttaattttttcaggaccctccctactgtttttcagagcggctgcaccattttaacaatagactcttttgtcatccttcccatattataacagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgtaagtaaagccagctgcccmccttttcccagcccaccttcttctccctgggggcagtggggaaccctgagctggcccatgtcattgttcagaccacagctttttgtctttcagatccctctgctcctggaggccccacctcctagttctctggttctcagtgacagctaacacacagtcccttcattctctctttctccaaggggttggggacactgtcctagtagccggtccagcttgttagaataacagtgaaggggaaggcaccaacacattattaaaggaagtggggagaaaaccaggagtgagttgtcaaaggat

SEQ ID NO: 165903 - DNA, 601 bp, Human
aacacattattaaaggaagtggggagaaaaccaggagtgagttgtcaaaggatctgggaaagttgcttttcgacaggccacagaagccctaagcaccctgtgacttgcaggaagagggtaaagatggtgacagttcacataatgcattgcgggatctttgatgcagcagagatattaagtcagagacaaatggaaactgctatagaatatgtgagcagcagcagaaacccagcaaagccaaggggaagaggtagccctggccttggccttttctgctcctctccctcccatagcaagagcrttcctcacggcctctttcaagagaattgcttccccctgattccactcagggatgtatctctaggttttcctcggccattccctctttcttttaactacgcctatcccactttgccctcccttcccaccagcagccaggctgtgggcaagccctgctcctgtcatacccctttgcagacagagatactaccctgggaagctcctgagtccacccagctaaagaagataccgtagaactaaatttctgagtgttcacagagttccctgggctctctgacccctggatttaaaatgcacctgg

SEQ ID NO: 165904 - DNA, 601 bp, Human
gctggtcctgctgaactggatatttgttttcagtcaaggtttgaggcttgtgcagctgttcctggcccagactttacctgaactgcagggtttggcaggtgcacagtctcaaggtttgacgttagagagagccctgctcctcgctagtgccctggccagctgttcacacacggtgttgttcttcccactttaactcacttcagctcctcatactgatgccccagggttgttgcttccatttttttttcattcagtatctgtgtgcctcaatgatcttttttccccaccttcatttttcttycttcagcggcatctgctagctcgtctacccctgttccattgtctccaccagatagtgagtatcattttcttcatccatctctctgcaggtcactttccaccagccacagtttgttttgcctaatgttatctccttcaccaggtgataattcaactcagttggtggaaagcagcgtcgggttttagaggagcagttgagaagagaaacaggcatagggcttctcagatccatgaggggcagccttccctgaaggagaggcgagggaaaagcattgttctggatagaaaaccctgcaggcag

SEQ ID NO: 165905 - DNA, 601 bp, Human
ttgttctggatagaaaaccctgcaggcaggatccccaaggctgccgccctggggccagccctgtcctcaggattctgagtgggctggatcaaagctcgtatttggagaagccaaaggaattgaccaagaaaaatgtctcctctgcagggtcatagaaaatgtgttggagtgttttgtttttacccttcattttaattggcacagttggatacagacattgaaattagatagggaggcctgtagctttcgctttatccataaatgcatacttttcttgtaaatatttgtgggaaaataaacmgtgtctggcagtgtctggcagatgtgcctggcagtaggcgcttaggcaaatcgtttaacccttcacaagtgagccttgtttatctcctctgtaaaataggatgagtagtcacccacgtcccgccaccctaaagaaaatcacaaacattttcatgtttatcatgctctgctttacccacatgggatcattaccaccaagccagcagtaatgtcagctggtcgctctcagatttcatcatcctggctaagccttgctcatttctgatctaattaatgttgctatcctgtccttttgtgtgcc

SEQ ID NO: 165906 - DNA, 601 bp, Human
ccagttacttgggaggctgaggcaggagaattgtttgaacccaggagatggaggttgtaatgagacaagatcgcaccattgcactctagcctgagtgacagagcaagactccatctcaaaataataaataatatgtatattaatattgatagagaagagagagaatacctccttcaccatctttataatgatgcctacatatgtataatatatactcacccatgtatgtatacatatatagctatgagtttaatttatctccattctctccttcacctttctttgccttttctgtctgtcrtgtttccatagcaacttggcctcttcctgcccttgcaaccacagaaccagctagtgagtacagggctgagttgctctcggccagacctctgatcgcttgttgtagagccgacttctagattacagcgctgcctgttgttttcccttttattaaaagcaacagttgtgaatgcatgaaggctcctagcctggtgtggtttcctaagcatgccgtctgcttggccaagagagcaaaccaagcatcagcaaaagaacggggttgattattggaagaatactccgtgcatgaggaggcttttcc

SEQ ID NO: 165907 - DNA, 601 bp, Human
agaaccagctagtgagtacagggctgagttgctctcggccagacctctgatcgcttgttgtagagccgacttctagattacagcgctgcctgttgttttcccttttattaaaagcaacagttgtgaatgcatgaaggctcctagcctggtgtggtttcctaagcatgccgtctgcttggccaagagagcaaaccaagcatcagcaaaagaacggggttgattattggaagaatactccgtgcatgaggaggcttttccaaatcgactctctagttaaaaatagccaaggattaggcaaacsctgaggacacaaaagaacagcatctccttcccggctttcgctttgctgtccctccttctgaaatacacacgctcatgcgcgtgttaatttagcagtagcaaaaagactgagagcgagggaaggaataggagaaaatggctgcttgaggaaagggagagggtgatgccgagaaggaaggagccgctgcttcctgacagcatgcccggctttgtctccgcgtacgcagagcacaggggaaggagagagctccttcctgctgtctcctttcaggctcccgcctcagtgctagaaaaatgatgg

SEQ ID NO: 165908 - DNA, 601 bp, Human
atgcgcgtgttaatttagcagtagcaaaaagactgagagcgagggaaggaataggagaaaatggctgcttgaggaaagggagagggtgatgccgagaaggaaggagccgctgcttcctgacagcatgcccggctttgtctccgcgtacgcagagcacaggggaaggagagagctccttcctgctgtctcctttcaggctcccgcctcagtgctagaaaaatgatgggcagaaaaagcctaatccaggctccccttgggttgagagtccagatgaaagtgctggaatttatctcttgacaayagagtcaagagccagattgtatcctcttttttcatcgtagaaaacattgcacagaatcactgctgtaacatgttccaagctggtcttcataatgctctaatgaagtaagatgtgtgtggaggacctgaatctcctgaagaatccatatgagtatgcgtgcatgttcatagtgttcaagcatcaaagctgtgtgggagttttagattttataatatttctgcttgcacagaaaaaaaatggcatacatcccatcaagcagaacaagaaggcagaaagcaggtatgcaaagtataactccag

SEQ ID NO: 165909 - DNA, 601 bp, Human
cagaaacccaaaataccttttaacaagtcgagatcactcagtcacaacataggaccaaaaggaatgcttaagaaaagtgttttttttttttcattgtaaatctcaaatttatgacttatcagtgcaaccacgattctaaagatataactttaaccacaacaggttgggtgccgtggctcaagcctataatcccagcactttgggaggctgaggtggaaggatcacttgagcccagcggggccaacagggcgaaacccccatctctacaaaaaatagaaaaattagctgggtatagtagcasacgcctgcagtcccagccattcaggaggctgaggcagaaagattgcttgagcccgggaggtcaaggctggagtgagctatcttcatgccactgcactgcagcctgggtgatgaaacgagaccgtttcaaaacaaaaaactttaaccacaaatggcccaaacatttgcttaatgtcaaactctcagcacgttgggccaaaggtacagtttctgctgtttagtgtcaacacagccattgtctcaaccatcagaaggaaacccattccctagtctgcactggcctcttcctttatatgggtct

SEQ ID NO: 165910 - DNA, 601 bp, Human
gaaagattgcttgagcccgggaggtcaaggctggagtgagctatcttcatgccactgcactgcagcctgggtgatgaaacgagaccgtttcaaaacaaaaaactttaaccacaaatggcccaaacatttgcttaatgtcaaactctcagcacgttgggccaaaggtacagtttctgctgtttagtgtcaacacagccattgtctcaaccatcagaaggaaacccattccctagtctgcactggcctcttcctttatatgggtcttgacttcagggaggctcaccgaggtctcaggaataayatgggtttgtggagaaagaagtgagataagatcctcaaagccaccatctctggcatgcatccacccagcctcattcagcccatactcccctcctccttatgccataggaaacatgaaatgactcttcttaatttaatacaatcttttgttcttctagggcacacagtcttcaccttaagactctcgggacttttccttgatgacccatattctgtttcattgcccttgtttcccaaggatgctgagacatttctggaatctgtggataataacttgcttttttcttttcctttaacagtc

SEQ ID NO: 165911 - DNA, 601 bp, Human
caaaatacggtattttcatgatttcccaaaggttgaccatcagcaagactggatatttttcagacttaagatgactgttcagtagctgatgttctggaaaaagatctgggccttcaccatgaaatcttaaatgtgagcagttactggatgttgaatttgaaacctattcatttctttttttaaaacaagcttggtcatttctgtgcaatgctataattcggaacgaaacaaagcacaatgttaataaggtagacactaattcattcctctgaagagagatctcttccagacattttaagcyagggcaagaaatgtttaaagatgttttctgcagttgccgtagaaacactccttagcagtcatcttggctgttggtaaaaaatgtggccggtaccaaaaaaaaaaaaaaaaaatcgctgacagccttagagaattacaaagctatgattacgccctcctggaaccatgtcctcatccatgacagaccctctcctgccatctgcaagggggcaagctgaagacttattcaggtgagccccgcacgcagcaggaattgtcctttaacaataaaatttaagagaatgaagaggtcagggccaat

SEQ ID NO: 165912 - DNA, 601 bp, Human
ggaaaaagatctgggccttcaccatgaaatcttaaatgtgagcagttactggatgttgaatttgaaacctattcatttctttttttaaaacaagcttggtcatttctgtgcaatgctataattcggaacgaaacaaagcacaatgttaataaggtagacactaattcattcctctgaagagagatctcttccagacattttaagctagggcaagaaatgtttaaagatgttttctgcagttgccgtagaaacactccttagcagtcatcttggctgttggtaaaaaatgtggccggtaccaaaaaaaaaaaaaaaaaatcgctgacagccttagagaattacaaagctatgattacgccctcctggaaccatgtcctcatccatgacagaccctctcctgccatctgcaagggggcaagctgaagacttattcaggtgagccccgcacgcagcaggaattgtcctttaacaataaaatttaagagaatgaagaggtcagggccaataaaatccatggaggagagcaacaaagcttagttaaggacagttatcacctcctctccctgggtattagcaaagatttaagctgaattgggcctca

SEQ ID NO: 165913 - DNA, 601 bp, Human
tccttcttagattgaaaacatcactaaccaccccttccactccctcctttattttttcacagctgtgtgtctggattgccacgatctctggcaggtcgacacagacttttcaccagggtttctgctctaattgcctttatctctaaggattccctgcactggaggttcctagggtagagagtcagtgggaaggggctgaagaaaaaggcagtgaggtgtgtcagcccgaatcctgtgggcagggactgtgggcagggactgtgggctgctgctggccttggaaactgccagttcccttagrgtcaccagtatgggggctgaaactccccaggagccacattcttcttcataaccaatctaatgtccatgaaatagagttgaagatgggcacgagcccccttgtggccttggaggcaggagccgagttaactgttgatgatagcagttatttctgtcataacttcctcagcctggatcagccccataaccacaagccataccttcctggtcatattttctttttaggatgatgaaacaaagataattgatcaattaatctgttggtgttttcatgacacctgcgagaagggaactggtattt

SEQ ID NO: 165914 - DNA, 601 bp, Human
cccaacacatactctcacattcataaattcctcaggaaactggtgctggaaaggatttacagaccagatgccttagtgagtgtggctgcggggagctcagcatccttgctctgcaagctgggaaccggccgtgcccacactcactcattgtgtatcccgaggctccctggagctaggaactaggatggcaaagattctggtcactcaggcacaagcaaggccttaaagctgaagagaaaagggttcagggaaaaacaaacaaaactttaccccaaaagcttgatccagcaggaacaatgcytaagacaaattaatacccactcttacactgcccggctgttcttcgggactgtccgaaagtcactcggcatccctagaatagccaggtaggttaccaaaagaggcgccagggagagacatgaggatccaagaatgtatgcaacatagatcacatccgattcttttgtttgtcgtcgagggctaagcgctttgtttcaggaaagagaatcagtggtctaataacgctaaatcctgattccctcagataatttgctgatcccctaaggaccagccacatttctaacctctggatgtaattgta

SEQ ID NO: 165915 - DNA, 601 bp, Human
aggaaaagtaaaagattgtaatgcaagccccacatttatcacaggtttacgctcagacacctgaaactttgtgcagatctctatgagggagaaaacaaagtagatgaatagagaacacagatggagggctttttgttttgttttgtttcttttgaggctgagtctcgctgtcacccaggctggagtgcagtggtgcgatctctgctcactgcaacctccacctcccatgctcaagcaattctcctgcctcagcctcctgcgtagctgggattacagacgcatgccaccatgcccagataattttttttatttttttagtagagatggggtttcaccatgtaggccaggctggtcttgaactcctgacctcaggtgatccacccacctcagcctcccaaagtgctgggattacaggcgtgagccattgtgcccagccccagatagaggctttcttgaggatgcctgtttggcaccccagcctttcattcagaagacacagctaactcttggtgctcgggctcctttgagtgagaaatagaatattgttttcctgctaaaattcaccaatgctgtccaagtaccctggatttgctataatttt

SEQ ID NO: 165916 - DNA, 601 bp, Human
tcatcttttaaaagaattaatcataacttagttttttcatttggcaaacaaaatggtgtcttatttacctttgagacttcagtgcctaatagactacctgggacctagtagatactcagtacacatctgttgaataaatcgtaggtaaagcactctaaataataaacctaaatattatttcattttatttttgagacaaggtctcactctgtcacccaggctggagtgcagtggcatgatcttggctcactgcaacctctgcctccggggttcaagtggttctcgtgcctcagcctcttcrgtagctgggattacaggcacatgccactatgcccagcttttttttttttttttttttttttttttttttggtagagacagagtttcactatgttggccaggctggtcacaaaatcctaaccacaagtgatccacctgcctcagcctcccgaagtcctagggttacaggtgtgagccactgtgaccagccaatattattatttaatataaaatgctctaaattctaagagaaaataatacacacatatcagagtactgtgatagactcagataaaatgatacaaattatagtgttctaact

SEQ ID NO: 165917 - DNA, 601 bp, Human
gaaagtcgtgaattttgtgttctgtttcccacaatgtcatgagaaacagcccaggtgtagttggtagtccgtgctagtgcagtggctgtcactgtttcacatgacaacagagctggaaggagccctaaatagcatccaattcagggcccatattttgtaaatgtggaatgaaacttgatcgaggcaacagaccccccatgatgcggagttcagagacagtgttttgcaggattgattcagccttgaaaactcacacagctcaatttcaagaggaactaattaggaacgtgcagccagggargccccagtggactgatccctaaaagggggccttgggagaaggacacagtcctcgactagtgggcatgttggaagggccactgatgctgcctataaaaatcccctccaggctagggcaggtagaccattcagcacagagtcagtgtcatgattctaagtgaacaaagttaaaataatttgttcatttgcagtaggtctagggtcatcaaccattccagtttgcctgggactgaagggtttcccaggatgttgaacttgcagtgctaaaacctggaatcttccagactaaccgggatgagtt

SEQ ID NO: 165918 - DNA, 601 bp, Human
ggtgtagttggtagtccgtgctagtgcagtggctgtcactgtttcacatgacaacagagctggaaggagccctaaatagcatccaattcagggcccatattttgtaaatgtggaatgaaacttgatcgaggcaacagaccccccatgatgcggagttcagagacagtgttttgcaggattgattcagccttgaaaactcacacagctcaatttcaagaggaactaattaggaacgtgcagccagggaggccccagtggactgatccctaaaagggggccttgggagaaggacacagtcctygactagtgggcatgttggaagggccactgatgctgcctataaaaatcccctccaggctagggcaggtagaccattcagcacagagtcagtgtcatgattctaagtgaacaaagttaaaataatttgttcatttgcagtaggtctagggtcatcaaccattccagtttgcctgggactgaagggtttcccaggatgttgaacttgcagtgctaaaacctggaatcttccagactaaccgggatgagttggtcaccccaatttaatcagagaatacaatttgtaaagttctcctgtgtctcc

SEQ ID NO: 165919 - DNA, 601 bp, Human
acctaattttttttctttttatctatttttttctctgtttctgtctctaccttccctttccttctgtccccctccccttcctgtgtctgtcgtcacacttgtcaccttggacgtcactgggacatccccactgccacatttgtttttaaacaaccacattatctctggggacccattgcttgacacctgcagcaaccttgggaggcaattctgcatcctacacctttgtctcattgcttttctctgcagtgactcttcttttgctctgttaggaacttgaacacaaaaattaaatttgctkaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcatttt

SEQ ID NO: 165920 - DNA, 601 bp, Human
acggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccagragggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctca

SEQ ID NO: 165921 - DNA, 601 bp, Human
gaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagccttyccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcacct

SEQ ID NO: 165922 - DNA, 601 bp, Human
tcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgaggsctttatgaagtttacacctttgcattattaaaggaaataacagttcatgtgaactcaccagcgtggcttgattttattcaatagttgtgtctgacaaagcagcaaagaccctttccctccgcctctcatgtacctggatagactattacctagagaaatagtagcctggtgaatgaaatactttttcttcctaacggggagcaatctctttttcccaggcatcctaagagctgttaagaggcattgctgccttggagtccccagcaggcagtgggaggggaaaatgcctttgcagaactg

SEQ ID NO: 165923 - DNA, 601 bp, Human
gcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaactcaccagcgtggcttgattttattcaatagttgtgtctgacaaagcagcaaagaccctttccctccgcctcwcatgtacctggatagactattacctagagaaatagtagcctggtgaatgaaatactttttcttcctaacggggagcaatctctttttcccaggcatcctaagagctgttaagaggcattgctgccttggagtccccagcaggcagtgggaggggaaaatgcctttgcagaactggggaggtggtcactatggggatggggccacactctgagccaacagatgcacaactctgtggcaaggtcacctgatgacacagcagcctttatactatccctaacagaggctgcacagagtgagctt

SEQ ID NO: 165924 - DNA, 601 bp, Human
atttttggactatttatacagcaggtttggatcatgtttttctactaataagaatgctaacattgttgtgtagataatcagtgagggctttatgaagtttacacctttgcattattaaaggaaataacagttcatgtgaactcaccagcgtggcttgattttattcaatagttgtgtctgacaaagcagcaaagaccctttccctccgcctctcatgtacctggatagactattacctagagaaatagtagcctggtgaatgaaatactttttcttcctaacggggagcaatctctttttyccaggcatcctaagagctgttaagaggcattgctgccttggagtccccagcaggcagtgggaggggaaaatgcctttgcagaactggggaggtggtcactatggggatggggccacactctgagccaacagatgcacaactctgtggcaaggtcacctgatgacacagcagcctttatactatccctaacagaggctgcacagagtgagcttgtggagagggaatctgagagaagattctctttgcaaactgtattctattcataatcacacttaactcagacgcatcctgcaagcccct

SEQ ID NO: 165925 - DNA, 601 bp, Human
gagcatctcacctgcttgaggagtttagactcagtgttggcatacagtatggtcgcttttcctttggggcatactctttgttttctcttgatccactcaataccttaggtcaagtttgttttcagggtcactgggtgagacagcacagtgcaccctggggtggcaaatcatgggatcacgtgctcctctttgtaatgcaggggagggaagacctaggagcgtggtcctcataagaatcacctgggctgcttgttcaactcctgtttcctgagcctcatacccagtgattcagatcccataraagtggggagccccagattctgaattgttaacaaacaccctaggaatttgctacaggtggagatatattgagtttaaaggtatttgtcatgcaaaaataaaatcacaaggatcagtgattaaatatgggacctaccgagcattttggtcttccaggaaaaagtctttctcagtccacactctggagactggcattagggaacctgtaccgtgtgccaggcagtgtagaatgtatgacttggaatgacaggctcttgtggttgaagagacactctccacccatgctcctgcccagtgtggg

SEQ ID NO: 165926 - DNA, 601 bp, Human
ctgcttggctaagaaatgcctgacctcaggcatttctggttctatttcggtggctgtgggtacccttagaaggctcctgtataagtagggatccctggatccctagcccctgttctcaagttatacacatattctggaaatggcttaaggtggcaaaatctcactgaaaggcttagcagagtctgcttaggatttcttgaaattctagggttttgtgttttccccctgaaaggataagggaagctggggacctggtaaagttctctgcccctcctctgttcagaaacctcggggacccacrgagccccagaccagttgtggttgtaatgcctgcctagctgtcaaggatcttatgggcttaaagggaatggagtttcagggaaccacaaaatctgtgactggaagaacccacagctcctatgagccattctgagtactcgtgatctgccttattcgtgacttttcccatcggtgccctggggagccctgcaggacagctgggcccagttcctctgggacctgggaagcctagagcaggtggatgctgaacagaagcctgcccctccttgaatggagatccagggcagggatcaggaagccc

SEQ ID NO: 165927 - DNA, 601 bp, Human
agcaggctaagaaggccaaggtgcccttatcagccaccctggggcccccagtcggtgtgttattcagtgccaggctgagtccctaccagaaaggcactgatgtgcaggaagaaaagaggtaggccccaggcccgtggcaggggagggtgcagttcagaggtcccctcacactgtggctcagatgctcaccctcccctcccaaccccggcccccagcccactcttgcttctcctgctcttagagtggctgggaagactcggggctccccagcatcaaatggctgctgggtctcaaagttcargagaaagtccttaacctttcaggtttgtaagtgtcttgccaaaattcagtggcaccagctgaggctggggtctgtgcctgtccccatgcatcctcagacccgactccctttcctggaactgatggaggcagagtcagacctagatttttatagaggctcctatggctgctccccagataagctgccatgctgccaccatgggctgcaaggggctctcgccaggagccctgaatctcagcatcgggagggaaaaggactctgatagccctgcccactcagctgccctcaactctcgcatag

SEQ ID NO: 165928 - DNA, 601 bp, Human
aagaaggccaaggtgcccttatcagccaccctggggcccccagtcggtgtgttattcagtgccaggctgagtccctaccagaaaggcactgatgtgcaggaagaaaagaggtaggccccaggcccgtggcaggggagggtgcagttcagaggtcccctcacactgtggctcagatgctcaccctcccctcccaaccccggcccccagcccactcttgcttctcctgctcttagagtggctgggaagactcggggctccccagcatcaaatggctgctgggtctcaaagttcaggagaaagkccttaacctttcaggtttgtaagtgtcttgccaaaattcagtggcaccagctgaggctggggtctgtgcctgtccccatgcatcctcagacccgactccctttcctggaactgatggaggcagagtcagacctagatttttatagaggctcctatggctgctccccagataagctgccatgctgccaccatgggctgcaaggggctctcgccaggagccctgaatctcagcatcgggagggaaaaggactctgatagccctgcccactcagctgccctcaactctcgcatagccaccagg

SEQ ID NO: 165929 - DNA, 601 bp, Human
acaaacagaaaacataaaccatgtcacccaccatcttgtgctttgaaatatgaaagtcaaaggaaaactaatttgggaagagagatgaagtgctttgaaggagagatgaaacagcaaagttgaaagattaatgctgcatagacaaattgaaatctaaagtgaaagtttagacaacagtaatcaaaatgaatgataacacgaaaagccagcaggaagaaaacatttgagccaacaatccagtctggttcatccggataagatggttatctggcatttaatgctgtttcctacaccatgaacrtaagcatttactgtcatactaagaaaaagaaaagtcatccgaatttatcgctatttttacatgtagttaaattaattgttgtcatatttccaagtgaagtaacataggtttggcttttgcagtcagttcctcaagattcacaggcttggaatattttttaacaatttaaaggcccaagatttcttacagccccaagaacttttccctctctactaagcacaaatctgaacaaataattacacaccaccaacgtaaaactaggagatcttattttggtacggtctttgtgtaattttaaaa

SEQ ID NO: 165930 - DNA, 601 bp, Human
tgtatcacaatgggttatctgaggtttgattgttttgcacttttcattagaatcagaatgtgaaatttcaggttgatttccttcatgccatcaacccaaagtctccacaaccctggcagaatttctattcttagtttcacgtgaccagctacatgatgcagtgtgaggaatcaaggttcacctagcgagtcatacagcaaaagaggacacattgcaaaatgtattgcaataaaaactcaactagttgataataaaatagcatcagctgtcctccaaagaaagttgattgatttttttttttaatttaaagctgaacaaaagagaatgatcaaggttcatggaaaaggtgacactgcaaattcattttcattatctgtgtcctatccctaagttactcggtacacacataggatgggaatactcacttgaataccatgtaattcacataaggcatgaggcacttttccagttcataacttagaagtcaccaagccttctatgtctcccaaagtttctacattttaaagggttgcataggtgatccatctgctttggggcgcccctttgcatcctctctgagacctccacttggccaactatt

SEQ ID NO: 165931 - DNA, 601 bp, Human
caaaatgtgattatcagagctgagtacagagaaataaaagctgtcacggtgaatgaccttttgttgtacttgcgagatggggaggtgtataaatttcataaatgtgtttgaaatactctggctttgtatcacaatgggttatctgaggtttgattgttttgcacttttcattagaatcagaatgtgaaatttcaggttgatttccttcatgccatcaacccaaagtctccacaaccctggcagaatttctattcttagtttcacgtgaccagctacatgatgcagtgtgaggaatcaaggktcacctagcgagtcatacagcaaaagaggacacattgcaaaatgtattgcaataaaaactcaactagttgataataaaatagcatcagctgtcctccaaagaaagttgattgatttttttttttaatttaaagctgaacaaaagagaatgatcaaggttcatggaaaaggtgacactgcaaattcattttcattatctgtgtcctatccctaagttactcggtacacacataggatgggaatactcacttgaataccatgtaattcacataaggcatgaggcacttttccagttcataac

SEQ ID NO: 165932 - DNA, 601 bp, Human
aatcatgagggcttctaagtgtcgaaattgtttaatcatcttccatcattgataatttcagaaaaaaaagctacaacaacgtgaagaccatagttgagaaggctactttgaataaatgtgtaagagaaacaaattactgttcttcgttgaattaatcccaatcaattccagccatgcaaaatgtagcaagttgacatttaccctgttttgttataaccaccgtaagaaattttgttctgggtggttccatttacttgtccttttaaacatttttttctactgccacagtaatattagtctsaagtcttacccaaaaatatctccaagcaactgctgggtcacatgagtggtccatgtccccagaactccaaaatgtgattatcagagctgagtacagagaaataaaagctgtcacggtgaatgaccttttgttgtacttgcgagatggggaggtgtataaatttcataaatgtgtttgaaatactctggctttgtatcacaatgggttatctgaggtttgattgttttgcacttttcattagaatcagaatgtgaaatttcaggttgatttccttcatgccatcaacccaaagtctccaca

SEQ ID NO: 165933 - DNA, 601 bp, Human
acagttaaaatatataaagcaaaaacaccttattcacctattgtggatactagataaattattttgtgacatttatgcctatgagaacacaatgtcactggtaacttcatatcacttctcaaatattaaagtgaaagaatgacatcacttttacccatctgttatttaaaagaaaatgatgccatcttcagtctcaataggtaacgcagcagaaaagagtttccttttctgaaatcatgagggcttctaagtgtcgaaattgtttaatcatcttccatcattgataatttcagaaaaaaaagctacaacaacgtgaagaccatagttgagaaggctactttgaataaatgtgtaagagaaacaaattactgttcttcgttgaattaatcccaatcaattccagccatgcaaaatgtagcaagttgacatttaccctgttttgttataaccaccgtaagaaattttgttctgggtggttccatttacttgtccttttaaacatttttttctactgccacagtaatattagtctgaagtcttacccaaaaatatctccaagcaactgctgggtcacatgagtggtccatgtccccagaactcc

SEQ ID NO: 165934 - DNA, 601 bp, Human
aatctgttcacaggaattttggcccaccctcacatctaacaagggcctcaaatttaacttataaaaaaatcaaatgatatatacactcctcacaaagtagctgccctgttgaaggaagacacccatgcctcacccagctttataactgcatgctgtttctgaatcacactaactggacatagtggattcatgttttgtaagttgtgtaatcctataatactgcattccaattttctccacattaattttttactctaaacagttaaaatatataaagcaaaaacaccttattcacctattrtggatactagataaattattttgtgacatttatgcctatgagaacacaatgtcactggtaacttcatatcacttctcaaatattaaagtgaaagaatgacatcacttttacccatctgttatttaaaagaaaatgatgccatcttcagtctcaataggtaacgcagcagaaaagagtttccttttctgaaatcatgagggcttctaagtgtcgaaattgtttaatcatcttccatcattgataatttcagaaaaaaaagctacaacaacgtgaagaccatagttgagaaggctactttga

SEQ ID NO: 165935 - DNA, 601 bp, Human
tgcccaaccccactccaaatttaagtaaatttcccacaatcatacataaaatagcacctcactatattctcggactgtgctttcctgggcctccactttggaaaaagaattggttcaactggcaaacagttgaaccaattgaataataaaccgttttcaaaggatagaaaatgagatgccagagtaaaggaagcggggtaacggggagaatctgttcacaggaattttggcccaccctcacatctaacaagggcctcaaatttaacttataaaaaaatcaaatgatatatacactcctcasaaagtagctgccctgttgaaggaagacacccatgcctcacccagctttataactgcatgctgtttctgaatcacactaactggacatagtggattcatgttttgtaagttgtgtaatcctataatactgcattccaattttctccacattaattttttactctaaacagttaaaatatataaagcaaaaacaccttattcacctattgtggatactagataaattattttgtgacatttatgcctatgagaacacaatgtcactggtaacttcatatcacttctcaaatattaaagtgaa

SEQ ID NO: 165936 - DNA, 601 bp, Human
taaaataaaaggctttagagtttcagaatcataaccaaaactttgacattacattttagttaaaagaaaaaatataattggattttttccaaacaagcaaatgacttcataaagctaatggaaaagaggcaattttactgtttgtttggttagaaagttaacaattagaggataatgaatttcccaagcaattatttattaaagtataactaatacataatagtattcactcattttagtctgcagttttgtgaattttgacaaatgcatacagtggtgtaactgccatgacaatcaagawctagaaaaagttcaatcattcccaaaaaagtccccattttcttttgcagagaaactctccccagttcaatcccctgacaaccactgatgcattttttctttgtcctgataattttgctttgcaagaatatcatgtaaacaaaatcattcagtatgtagccttttgagtttggcttctttcacttaacataacgcattagagattttctcatgttgttgtacgtgtcaatagtttgttccttttggttgatgaataatattccatcatacaggggtactatcatttgtccagtcattccca

SEQ ID NO: 165937 - DNA, 601 bp, Human
cctaaaacagaagtcgacagatctgtttcagcaacattccggagcatccttggatacagcttccatctagaattaaaaaataaaataaaataaaaggctttagagtttcagaatcataaccaaaactttgacattacattttagttaaaagaaaaaatataattggattttttccaaacaagcaaatgacttcataaagctaatggaaaagaggcaattttactgtttgtttggttagaaagttaacaattagaggataatgaatttcccaagcaattatttattaaagtataactaatayataatagtattcactcattttagtctgcagttttgtgaattttgacaaatgcatacagtggtgtaactgccatgacaatcaagatctagaaaaagttcaatcattcccaaaaaagtccccattttcttttgcagagaaactctccccagttcaatcccctgacaaccactgatgcattttttctttgtcctgataattttgctttgcaagaatatcatgtaaacaaaatcattcagtatgtagccttttgagtttggcttctttcacttaacataacgcattagagattttctcatgttg

SEQ ID NO: 165938 - DNA, 601 bp, Human
aaacctcattgtgccattctgatatccctgacagaattttatgtcagacatttcaagaagggaagtgaattcacaagatccttaattcttaaaactaaaatgttttaaaatattatatagtcgtgttctttttctgctctgcttagcatcaaaataattcatttccaacttttatattagtttctggagcacaatttggggagattttttactctgcacagcctttcaaatgttcacagttgctagagaactggaaagttaataaattagccctaataagagatttctttacatcatatttgattttctcatcactccctcctaagacagctggaactgctctattgggaatataactcatccataaaaaagaatcatgacccaaaaccacggaagaaaacacaaccaaccacgttgctccatttgcaatttggctgtgagaaccactttggtttgggggaagcaggagggttttgagataaggtagccacagggctgaattccaattctgtaactacctagctgtgactttgggcaagtctacctgtcagagatccatttcctgagacagtactattaatacccataatataaccaacag

SEQ ID NO: 165939 - DNA, 601 bp, Human
atagatatttacccatttagtatttccctttttttttcttctctctacttatgtttcaggattaccatagacaaaaggctgaggccccaaagccacttatttgtatgtggtcctagaattaaggaagctgctaagtctgtccagcaaaacctcattgtgccattctgatatccctgacagaattttatgtcagacatttcaagaagggaagtgaattcacaagatccttaattcttaaaactaaaatgttttaaaatattatatagtcgtgttctttttctgctctgcttagcatcaaaakaattcatttccaacttttatattagtttctggagcacaatttggggagattttttactctgcacagcctttcaaatgttcacagttgctagagaactggaaagttaataaattagccctaataagagatttctttacatcatatttgattttctcatcactccctcctaagacagctggaactgctctattgggaatataactcatccataaaaaagaatcatgacccaaaaccacggaagaaaacacaaccaaccacgttgctccatttgcaatttggctgtgagaaccactttggttt

SEQ ID NO: 165940 - DNA, 601 bp, Human
tgagccaaaaatcagaagagtataaagtcaggagtaatctcatcacttataaataaacatttgtaaattgtgatctttgaaactaaatgtattttaggacctgactattgtttgcaactgatttctcacaattttaaattaaaatatcattctacattattgcactcttcctatagtataatttttaaatttgatgtcatttttatgcatcatattttttgcaaactatctccaattataagatgtttgggtatttttttcaaattattttcctgctaaaaataagaagcatgaaaatccytgcagaaatgatttttttcctcaaaaatcataattatttccttggaattcctagaagagaatttttaacatcacatggaatttacatttttagagctttgatatacagtgccagattattttctaggaagattattccactttatacttttctcaacactgtttgaaatgcacattttctccctaacctaatcatactgcctgatcttaaaataaaaattcgatatacggaaaataaaatagatggtcataatttccatgtctttgcttattaatgaaattgaatatttttcatatgttt

SEQ ID NO: 165941 - DNA, 601 bp, Human
tctaattgttatcatttcctccttacaaaataattcaaagaagagtttataaggttgagccaaaaatcagaagagtataaagtcaggagtaatctcatcacttataaataaacatttgtaaattgtgatctttgaaactaaatgtattttaggacctgactattgtttgcaactgatttctcacaattttaaattaaaatatcattctacattattgcactcttcctatagtataatttttaaatttgatgtcatttttatgcatcatattttttgcaaactatctccaattataagatgkttgggtatttttttcaaattattttcctgctaaaaataagaagcatgaaaatccttgcagaaatgatttttttcctcaaaaatcataattatttccttggaattcctagaagagaatttttaacatcacatggaatttacatttttagagctttgatatacagtgccagattattttctaggaagattattccactttatacttttctcaacactgtttgaaatgcacattttctccctaacctaatcatactgcctgatcttaaaataaaaattcgatatacggaaaataaaatagatg

SEQ ID NO: 165942 - DNA, 601 bp, Human
tgattgtaagtttcctgaggcctccccagccatgtagaactgtgagtcagttaaacctctttccttagtaaattacccagtctcgaagagtatctttaaatcagtgtgagaaggaactaatacatgtggtaaaaataatttgctggctccagggtgccttaccaagtgagctctgctttttgctttctctgcttcctttctttatttccattctcttcatggtcccttgtccctttatctctactcttttaaatctaattgttatcatttcctccttacaaaataattcaaagaagagttkataaggttgagccaaaaatcagaagagtataaagtcaggagtaatctcatcacttataaataaacatttgtaaattgtgatctttgaaactaaatgtattttaggacctgactattgtttgcaactgatttctcacaattttaaattaaaatatcattctacattattgcactcttcctatagtataatttttaaatttgatgtcatttttatgcatcatattttttgcaaactatctccaattataagatgtttgggtatttttttcaaattattttcctgctaaaaataagaagcatg

SEQ ID NO: 165943 - DNA, 601 bp, Human
gctttgtttctccatccaaatctcatcttgaattataatcccaggtgttgagggaaagacctagtgggaggtgattggatcatgggggtggtttcccccatgctgttctcatgatagtgggtgagttctcatgagatcagatggttttataagtatctggcatttccctgcttgcacttctctctcctgccaccatgggaagaaggtcgttccttcccctttgccttccaccatgattgtaagtttcctgaggcctccccagccatgtagaactgtgagtcagttaaacctctttccttartaaattacccagtctcgaagagtatctttaaatcagtgtgagaaggaactaatacatgtggtaaaaataatttgctggctccagggtgccttaccaagtgagctctgctttttgctttctctgcttcctttctttatttccattctcttcatggtcccttgtccctttatctctactcttttaaatctaattgttatcatttcctccttacaaaataattcaaagaagagtttataaggttgagccaaaaatcagaagagtataaagtcaggagtaatctcatcacttataaataaacat

SEQ ID NO: 165944 - DNA, 601 bp, Human
ttcttatggttacttctggaggaaatagtcctacttacactgtcaaatcatagtttctaaggaagctttcttttcttctttcttctcctctttcttctcagcccaactccaccaagaataaagactggtcttggaaccatcaaatgtgacttggagaataagtctgtcattgacgagctatgaaaaactgttttctctggaactttagctacttgcccacaaaacagggacagaaacacctgtcaaatatcaaataaagcaatatgtgttggtatggttaggctttgtttctccatccaartctcatcttgaattataatcccaggtgttgagggaaagacctagtgggaggtgattggatcatgggggtggtttcccccatgctgttctcatgatagtgggtgagttctcatgagatcagatggttttataagtatctggcatttccctgcttgcacttctctctcctgccaccatgggaagaaggtcgttccttcccctttgccttccaccatgattgtaagtttcctgaggcctccccagccatgtagaactgtgagtcagttaaacctctttccttagtaaattacccagtctcgaa

SEQ ID NO: 165945 - DNA, 601 bp, Human
caccttatccaaatgtctattgtgtaacttatcttcctgaggggtctgctttgcatgctcctaaaactataattacttctaggggatcataatgggcttctcctcatgacacttcataggagtttctgaaattaaagctcttgcaaagtggtgaggagcccagattctggagacagaatacctctgtctgaatcccatctctatcacttatgaattgtgcatccctaggcaaggttattcacctggcgtgtacctcagtttctcctgtgtaaaataggtttaataatatgatcgatttatwtgggccgctctgagccttcaatgctataatactcgtaatatacttaaaatagtgtctggaacatgataattgctttataagtgttaaataaatctaaggggataagactgtaataggcatttaatatcttcttatggttacttctggaggaaatagtcctacttacactgtcaaatcatagtttctaaggaagctttcttttcttctttcttctcctctttcttctcagcccaactccaccaagaataaagactggtcttggaaccatcaaatgtgacttggagaataagtctgtcattg

SEQ ID NO: 165946 - DNA, 601 bp, Human
aaagaatgggaaggaagccaataaaagagggtgtgttcatgggcaggcaacctcagggggcaactgggactcaatccttccaaggaacactgggtgaccatattagaaaatgcttcagttacctgagcaaagagagctgaggtatttatccacctactgctgtacatcattagctagggaaccctctctcccattcccctacttcaaacacacctatccatgggctcatgttgcaacagataatgtcaggcaaaaagtggtaggtctgatggaaatgggaagtaagaagggaatacatgcrgagcacaagcaccatctactccagccattcatcctttccttgcaagtaacccactgtcccacaacataaacacaccagccaaagaacacctgctatgagctgatgaccatcagctttctggatacacctaaatattaaatagactaataacctatagatagtctttaaaacataggtgaaaacttagaaaccctggagagaggtttctagtataaatacagaatagaaactctgatgttgctgccctgataggaacccaatggaggaccctatgtttttgagggcaacatgtgtacactt

SEQ ID NO: 165947 - DNA, 601 bp, Human
gcccccttctgatggaacatgcaatctcagactcactgcagtctccacacaggagcttgcactgttttttgtttgtttgtttgtttgtttgtttgtttgtttgtttcaatttcatcttttttggacatttacattacaagcctggctcctaaaagtacctttttttccctgaggtttctgcataaagcttaaaataaaaatatttttcacaaagaaaaagaacaatttttatttccactagatgtaaatggaatatacttttctgaaagtgagtttttgtgtgtgaaagataaagatttcrgagactttgggctctgaggggcaaataaagatagtgtgtaagcatttctagcatttatttcatgaatcctcacaagaaatcctcaggtgagagctcttattcatccagggttgccagattgagcaaacatacaggacacctatgatttgttgtttatctgaaattcaaacataatgggccctctgtgttttatttgataaccttgtattcatcatcattttgaaaatgaaaaaagtatagcttcattggtcactctacaaacatgcagcagtgtaaaaaagtagagttcagacagggcgc

SEQ ID NO: 165948 - DNA, 601 bp, Human
aacaataaaacataggatgtttgcaataaatattttaagatgatagcatagtgcttgccttaggattcttgctacagttaatgacgtttggaaataccagtaacagagcaggatattataggtagcactgcctaagtgattaataatctgagcaaagcattaacctctctaagcctcgatttccacacccacaggagttggagaaagtttctcagggttttgcactcacatattttaagatggtggtaaagatagatgaataaataataaagtcaaattgcgtggcacatactaattgctstataaatgctggtgatcatcatttttcacaagactttgaagtatcactttctgagtttatgcaacatttattaaagacgtttgtgtttttagcaatagtcagagatagttacatatcttgttcctctcctatagaccaagaatgtactttgaaaaatggaaattaaaagcattcaaatgctcactgcctcatctaaaccctccaaggctgacatagtgcagtggaaagaagtgggctgacataaagtgcgtctaaaccctccagggctgacataaagtgtagatttcagtagagtaagaa

SEQ ID NO: 165949 - DNA, 601 bp, Human
gtgttagcatttatgtttattattgctatttccttccatatgttaaatattcatagaaataattttgtatccttctttaaagaatataaagaaaaaaattcaaaaaaataaataaaaatgatctgctagagtttcaaacggatgtgccattataagtagaggcacttataaaacagcttaaatattataagatttacaactattaaaatgttgattaagtaatccattgaatcaaattttttattcgtaacacagtgcatgaaaaactgccctccattcagtatttttcagttatttttttccactttaaaagacttcttagaattttatcttttgtttgattgtaattcatgacccattgtttatgctcccaaattttgcaaaaagcgaatgatttcccaattaatttcacttctgtggcttattttatcttctcaaagttaaaaagataaaacaataaaacataggatgtttgcaataaatattttaagatgatagcatagtgcttgccttaggattcttgctacagttaatgacgtttggaaataccagtaacagagcaggatattataggtagcactgcctaagtgattaataatct

SEQ ID NO: 165950 - DNA, 601 bp, Human
cctaatgataccacctattttatatgtgttagcatttatgtttattattgctatttccttccatatgttaaatattcatagaaataattttgtatccttctttaaagaatataaagaaaaaaattcaaaaaaataaataaaaatgatctgctagagtttcaaacggatgtgccattataagtagaggcacttataaaacagcttaaatattataagatttacaactattaaaatgttgattaagtaatccattgaatcaaattttttattcgtaacacagtgcatgaaaaactgccctccwttcagtatttttcagttatttttttccactttaaaagacttcttagaattttatcttttgtttgattgtaattcatgacccattgtttatgctcccaaattttgcaaaaagcgaatgatttcccaattaatttcacttctgtggcttattttatcttctcaaagttaaaaagataaaacaataaaacataggatgtttgcaataaatattttaagatgatagcatagtgcttgccttaggattcttgctacagttaatgacgtttggaaataccagtaacagagcaggatattataggta

SEQ ID NO: 165951 - DNA, 601 bp, Human
tcttttctctttctttttgatttctcatgtttaaagggagaaaaaaaatctcaagtagctccatgaaagatgaaggaaaattttattatagctactgtgcataaaacctgagaggtttccatggcaatgttcttaaagcaccaaatggtatagtaagcattttattaattggatatttgagaagtcagagatgttctacttatcctggaagactaaaatttagcctaatgataccacctattttatatgtgttagcatttatgtttattattgctatttccttccatatgttaaatattcrtagaaataattttgtatccttctttaaagaatataaagaaaaaaattcaaaaaaataaataaaaatgatctgctagagtttcaaacggatgtgccattataagtagaggcacttataaaacagcttaaatattataagatttacaactattaaaatgttgattaagtaatccattgaatcaaattttttattcgtaacacagtgcatgaaaaactgccctccattcagtatttttcagttatttttttccactttaaaagacttcttagaattttatcttttgtttgattgtaattcatg

SEQ ID NO: 165952 - DNA, 601 bp, Human
aatgcagtcatctggggtctgtgtggctctttgtgttactctgcaatctgttccacctgcatcttaataggtggtcaagtcatagctgagtcccaaaacttcactttggaatgttctggccttttaggctcaaaaagaaagtgtttagatttaatggttttatggcccatcaaatccagtgtggtagcctctaattgcatccaggggctggaatttcttttaaaactttttttttttttgacagtttaataagaatttgctaatatgctgaacattcctggaacgcattaggtaggttttmatttttcttgatatgaggtcccagcactccctcatgtggcacttgcccacataacaagtcagaagcaaaaggataaatgaatatttaatccttcttttctctttctttttgatttctcatgtttaaagggagaaaaaaaatctcaagtagctccatgaaagatgaaggaaaattttattatagctactgtgcataaaacctgagaggtttccatggcaatgttcttaaagcaccaaatggtatagtaagcattttattaattggatatttgagaagtcagagatgttctacttatcctgg

SEQ ID NO: 165953 - DNA, 601 bp, Human
gttgatcacttaatcttggaaaatccagaaaattcaacagctaaaactctcacctacaccctaatgcagtcatctggggtctgtgtggctctttgtgttactctgcaatctgttccacctgcatcttaataggtggtcaagtcatagctgagtcccaaaacttcactttggaatgttctggccttttaggctcaaaaagaaagtgtttagatttaatggttttatggcccatcaaatccagtgtggtagcctctaattgcatccaggggctggaatttcttttaaaactttttttttttttgacagtttaataagaatttgctaatatgctgaacattcctggaacgcattaggtaggttttaatttttcttgatatgaggtcccagcactccctcatgtggcacttgcccacataacaagtcagaagcaaaaggataaatgaatatttaatccttcttttctctttctttttgatttctcatgtttaaagggagaaaaaaaatctcaagtagctccatgaaagatgaaggaaaattttattatagctactgtgcataaaacctgagaggtttccatggcaatgttcttaaagcaccaaat

SEQ ID NO: 165954 - DNA, 601 bp, Human
aacatatatctagtcggtcgcctagcacaacacataaatatataaatcaataaagctttcaaaaaatacatcgtttgggtttagagcaaaggaaatgacaattcttcctgttgaatggtctttcactcattgttaaggttgatcacttaatcttggaaaatccagaaaattcaacagctaaaactctcacctacaccctaatgcagtcatctggggtctgtgtggctctttgtgttactctgcaatctgttccacctgcatcttaataggtggtcaagtcatagctgagtcccaaaacttmactttggaatgttctggccttttaggctcaaaaagaaagtgtttagatttaatggttttatggcccatcaaatccagtgtggtagcctctaattgcatccaggggctggaatttcttttaaaactttttttttttttgacagtttaataagaatttgctaatatgctgaacattcctggaacgcattaggtaggttttaatttttcttgatatgaggtcccagcactccctcatgtggcacttgcccacataacaagtcagaagcaaaaggataaatgaatatttaatccttcttttctc

SEQ ID NO: 165955 - DNA, 601 bp, Human
actgaattgtcaagtcctggcataaatggcagatcatatggagaccataacacagtgataggcctttaaataatggttttaaggagtattgagtttgcacacaacaacttcaaccaacctcccagtgtttaacaacttcagtgttgggatacacatgtgagcctctgacttttttcactgtcacattttaatgtcatcaggcacattaataattctgagaagaagcaatctcatgctctcaagaaagccacccaatagcttaaattttggtgcaaaatcgtagaaatcactccattcgatgactgtctttaatatggctagattctaattttttaataggtgttttaatcaacaatcttgtttcattgcaaagtgattttaacactgaagccactatttatatgaaaatactttagcaatgaattatacattttagtatatgtatatatatcaaatgtccataatcttttaatacatatataagcatatgtaatacggatgtgtgtttgtgtgtgtgtgtgtgagtgcttacacacagaaagagcatgtcactgactttttattgttagaaaagcaagtctaaaacataaaatttggttac

SEQ ID NO: 165956 - DNA, 601 bp, Human
ccaaattatggttttaaggaaaaagaggaaagaggaagcaaaaaagtgtaatatgttcaaagggcctaaagtgttggggttttcttaggtgcatttgattaaaaagctcctacaaaacttagtcatcaaaacagctgcactgaaaataattttgttgagaaaacgcattttgtcatctgcacaggaagtcattacgtaatggggaaaatatgcgatgaccaagtaccaagcagttgtgtggttctaaactcagggcctgtcatagtgaagtgtttgtataactgtgcaccataatgtccaytgagtgtgtcatcctatcttcacaggggaactaccatcataaaggtcttcacagaggatctaccatcacatagacgcagtcaacattgttttatgaatgtctaaaattacaattgagattaaccagaaaaataaagttctgaagtcagtgatctaaaagaacaaaccttcaactacaattatgcttgaaatacttaaaagttgtcaaacagatcttaatttacaatttatggaactgaaccaatttaaacactgccaagaaagaccaagaaaccagacttaatcgttgccgtgctttcat

SEQ ID NO: 165957 - DNA, 601 bp, Human
aataatttctttgaaaataattctcttttatgggaaggcagaatcaaatttccaaattatggttttaaggaaaaagaggaaagaggaagcaaaaaagtgtaatatgttcaaagggcctaaagtgttggggttttcttaggtgcatttgattaaaaagctcctacaaaacttagtcatcaaaacagctgcactgaaaataattttgttgagaaaacgcattttgtcatctgcacaggaagtcattacgtaatggggaaaatatgcgatgaccaagtaccaagcagttgtgtggttctaaacycagggcctgtcatagtgaagtgtttgtataactgtgcaccataatgtccattgagtgtgtcatcctatcttcacaggggaactaccatcataaaggtcttcacagaggatctaccatcacatagacgcagtcaacattgttttatgaatgtctaaaattacaattgagattaaccagaaaaataaagttctgaagtcagtgatctaaaagaacaaaccttcaactacaattatgcttgaaatacttaaaagttgtcaaacagatcttaatttacaatttatggaactgaaccaatttaaa

SEQ ID NO: 165958 - DNA, 601 bp, Human
aatgagattaatatccttgtttactatcatccattccccccactccatctcaaaaaatgggctacggccagtggcatgatttctgttttatagaataaaagttaatctcagacccacccataataaagatttctattagagttaaatcacatgtcctagggtggaaaaatgccacaagggtctgcaataacctgacataaggtaagtgtagctcgacctttctaaactgccattcaatagagggttggctaaatttcctatactatggaacctacaatcaatggctgagatttaaaagaastcatcaagtatgaatgcagctacctctggggatgctaatcctgaactccaaagtacagtgatttaaatgagctaggacaggtaaacagctttggaaaacagcaaaaactggcagtgttctccctctggctgggaaatgcaattgttcttctagagcttggcagagttttgttttgtttgtttgtcacatcaagtcttaatgaaaacatttatttctgatccaggtaatctggatgtgaagaagcaaaaataggaaatccattgtgtacataaattttaggggcctgcatactaagcctgc

SEQ ID NO: 165959 - DNA, 601 bp, Human
aaatcataatgaagtatcacctccaactgttagaatggttattatcaaaaacaccaatgataacaagtgttggtgaagatgcaaagaaaagggaacccttgtggagaaaagggaacccattgatgtcaggaatgtaagttagtacagacattttgaaaaacagtttggagattcttctacaatgattttgatgctcaagagacccattcctcttttcccttgcaaatatagtgtccaatgctcaatacctttatggagaaagctcctaaaggagagtggaatcttctccaattccaagaaytccctgtgaggacatatatagggagagaatatctaaggagataatttctgcattcccaaggtacacattactttggagagcctggaacaaataatccaagaagtgaaacaagaacatgcttttccctatccccaccctaacctgttcacaaatttccatggggggagctgcagagtgagtctaaggggctggcagcacttgcatagtccaaacatcaatcagtaatacttggaagaaaaattgtaaagttcccagtgtaagtttttggtttctctactcttccatttgcaatgtaactat

SEQ ID NO: 165960 - DNA, 601 bp, Human
tacaacagtggggttgggagggggaaaagggctgaaaaaaactacctgtttggaattgtggtcactacctaggtgatggattcatttgcactccaaacctcagcatcatgcaatatacctttgtaacaaacctgcacatggctccctgattctaaaataaaagttgaaaaaagaaaaaaaattggcaaaggatctgaacagacatttctcaaaagaagagatataaatggccaatagatatatgaaagaagctcagtatcactaattatcagggaaatttaaattaaaatcataatgaagwatcacctccaactgttagaatggttattatcaaaaacaccaatgataacaagtgttggtgaagatgcaaagaaaagggaacccttgtggagaaaagggaacccattgatgtcaggaatgtaagttagtacagacattttgaaaaacagtttggagattcttctacaatgattttgatgctcaagagacccattcctcttttcccttgcaaatatagtgtccaatgctcaatacctttatggagaaagctcctaaaggagagtggaatcttctccaattccaagaactccctgtgaggaca

SEQ ID NO: 165961 - DNA, 601 bp, Human
ttccttcctctcccagcctctggtagccacctttttatgatctgtttctgtgagacctacctttttagattccacatataagtaagatcatatagtatctgtctatccatgttgttacagaatttcccactttttaaaggctgaatagtattcctttgtgtacatacacctcattctttatccattcatctgtcaatggatacttaggttgatggcatatcatgactattatgaataatgctataacgaacatagaagtgcagatatctcttcaacatgctgatttcaattcctctcaatwaatatccagaagtagaatttctggatcatatggcaattctatttttagttttttaaggaattgtatgaaactaaaatgtttctgcacagcaaagaaaacaattaacagaatcaagagacaacacaggtattgggagaaaatatttgtaaagtgtatatctaatgagtgctaatatccaaaaaaaaaaaataaggaactcaaacaactcaatagccagaaaacaaataacccaattaaaaaataggcaaaggacagcaagagaaacaatcaaaggagtaaacaggcaacctacaaaattgg

SEQ ID NO: 165962 - DNA, 601 bp, Human
agtaattttaagatatacaatacattactattaactgtggacaccatgcagtacaatagatcactaaaacctattactccagtcgcactgaaactttgtacaactttgatcaatatgtcactttcctcattcttttccttcctctcccagcctctggtagccacctttttatgatctgtttctgtgagacctacctttttagattccacatataagtaagatcatatagtatctgtctatccatgttgttacagaatttcccactttttaaaggctgaatagtattcctttgtgtacatamacctcattctttatccattcatctgtcaatggatacttaggttgatggcatatcatgactattatgaataatgctataacgaacatagaagtgcagatatctcttcaacatgctgatttcaattcctctcaattaatatccagaagtagaatttctggatcatatggcaattctatttttagttttttaaggaattgtatgaaactaaaatgtttctgcacagcaaagaaaacaattaacagaatcaagagacaacacaggtattgggagaaaatatttgtaaagtgtatatctaatgag

SEQ ID NO: 165963 - DNA, 601 bp, Human
actgtgccattgctataaggaaattgcatatgacacacacacacacatacaatcactaaaagggacactggccaggtctcaggtattgaagcatcaaagataaggctacctatataaactgggagataaaactttcatttcagaacaacaacagggtagaatggattgaaagcctgtcctagagtcccagtcttgccatccatgaagtacgttctatctgcacaattgctatagccacagctgttctgcctacttcatagcattgcaagatcatctactggggcaatgtttctgaacgttytctgtgtaatctctgaagccatgcaattgtaaagggtaaggtgagaggatgcctaatgcatttggaaaaataagttctggatagctttgtatgtatttctaattttgccaaggacctgaatttcttaatgtcattatttgttaatcttctccacagccagctttcctttgcaattatttttaatttatttatatttatttttaattggaaaatagtaattgcacatgtttatggggtacaaagtgatgttttgatctatgtatacattgcagacaaatttagacaagctaatgaccatat

SEQ ID NO: 165964 - DNA, 601 bp, Human
tagagaccagcagctgagtatctcttccaattgctcaaagtcctttgctaaataattcaaatattacctttgcctgagagacaatgataaaccctttgagttcacactgctcattttggggtaatacttacaagcttcaaaattttataaatggcgtagcatggtcagacttcatcaaaaagttctgactatcgttatcctagcctatggcttgaaagcacaaatgttttaagcccttttactcaccttatccattgtccacaatgaaattctgactccctgctcccaaagcagacactgwctcattgcattttgcaaaggacaggggttggatttcattcttgctcccaatgtgtggctatgtattagactgtaacggaagattccaatgatatgtgttgcagttttaagatgcctggcaaaatggagctcacagctgaggtcatattaacataaaggcaaaacctggctcttgcctagaatgaagttccctaatgttgatccaaatctaaaaatcttggcttttgtaatagacggtatatcctaaagatgaaatacctaggagcctacaccatcaagtaacactgatcttgtatgaaat

SEQ ID NO: 165965 - DNA, 601 bp, Human
catttctttccacactttgtatattgttcctgaagaacaaaataaatccaatagtcaaaggtgtctgtaaatacgggcaaaaaatattaagaacctgaacatccagccttaggggattggttaaattgtaggtcatatataaaatgaaatgaacacacccattaaaattaatattattgctgggcacagtggctcacgcctgtaatcccagcactttgggaggctgaggcgggtggatcacctgaggtcaggagttcgagaccagcctgaccaacgtggtgaaaccccatctctactaaamaaacacaaaattaaccgggcgtggtcatgggcgcctgtagtcccagctactcaggaggctgaggcaggagaatcgcttgaacctaggaggaagaggttgaagtgagctgagattgcagcattgcgctctagcctgggtgacaagagtgaaactacatctcaaaaaaaaataatattattatgataatcaattttctgcatcaatatgctaaaccatggtgcccagatatttggtgaaacatgtctgaatgctgctatgaaggtgttttttagatgagattaacattttaattagtagact

SEQ ID NO: 165966 - DNA, 601 bp, Human
gattttgatcccttttaaaatacttataggcctgaggtacattatacattcatatgaaaaatccaagagcacattttggtggaaactaaaggaaggaaaatctgatggggaaaagaggtgtatagcttaaggaggtttgagtctttcccagagacttccactcagtttccagctttgactcaagatgattgtaatcccaaaatacaaccaggaaagagataataattcacagcttgtggacagggtgaatgaatgacctgatgaaacctttatagttcaacatcagattatgtgatatatkgtttttgctaagatgaatgatttgagtgaatgaatcaatgaatcttgacccatggatgaaccacagtgaaaggaatattgctgaaagaagaagtagacagtgagggatcaaagatgtggcttttttaaaccttcattattttctttcttcaatcttcttagccttagctgtcccatgtaccattaaaaataaaaggtaaaggtggctctttgactttaacaaagaaatagggcaccaggatgataataataaactgctgcttgggcaaaattcagtatcttccatctgtatagcaattca

SEQ ID NO: 165967 - DNA, 601 bp, Human
acatgtggcttctttcgtcttttatcttttttcaattttgctagccctagttttttgtttttttttttttttccaaatacaattcaaacatagagtaagcaagggcctctgtggcatgagatctgggaacacaggaagacattcctcatcatcttacatattctgatggattctgtaggagtccatcataaaaatgtcctccattaaaactaagattttgatcccttttaaaatacttataggcctgaggtacattatacattcatatgaaaaatccaagagcacattttggtggaaactraaggaaggaaaatctgatggggaaaagaggtgtatagcttaaggaggtttgagtctttcccagagacttccactcagtttccagctttgactcaagatgattgtaatcccaaaatacaaccaggaaagagataataattcacagcttgtggacagggtgaatgaatgacctgatgaaacctttatagttcaacatcagattatgtgatatatggtttttgctaagatgaatgatttgagtgaatgaatcaatgaatcttgacccatggatgaaccacagtgaaaggaatattgctgaaag

SEQ ID NO: 165968 - DNA, 601 bp, Human
ctgcagcagctttcgtggtgagattcactccacagtcactgaaatagatatgaaattccaggggaatattaatttgattttggatcttttcattttttaatattttagaagagtaaacacagtatgtttacatgtggcttctttcgtcttttatcttttttcaattttgctagccctagttttttgtttttttttttttttccaaatacaattcaaacatagagtaagcaagggcctctgtggcatgagatctgggaacacaggaagacattcctcatcatcttacatattctgatggatkctgtaggagtccatcataaaaatgtcctccattaaaactaagattttgatcccttttaaaatacttataggcctgaggtacattatacattcatatgaaaaatccaagagcacattttggtggaaactaaaggaaggaaaatctgatggggaaaagaggtgtatagcttaaggaggtttgagtctttcccagagacttccactcagtttccagctttgactcaagatgattgtaatcccaaaatacaaccaggaaagagataataattcacagcttgtggacagggtgaatgaatgacct

SEQ ID NO: 165969 - DNA, 601 bp, Human
acagctaattcacacatggctcaacagcaagattttatgcacagtagtttattctcacataggcacaaacacagtaaaactatgtgaaacttatacaagactgcagcagctttcgtggtgagattcactccacagtcactgaaatagatatgaaattccaggggaatattaatttgattttggatcttttcattttttaatattttagaagagtaaacacagtatgtttacatgtggcttctttcgtcttttatcttttttcaattttgctagccctagttttttgtttttttttttttttccaaatacaattcaaacatagagtaagcaagggcctctgtggcatgagatctgggaacacaggaagacattcctcatcatcttacatattctgatggattctgtaggagtccatcataaaaatgtcctccattaaaactaagattttgatcccttttaaaatacttataggcctgaggtacattatacattcatatgaaaaatccaagagcacattttggtggaaactaaaggaaggaaaatctgatggggaaaagaggtgtatagcttaaggaggtttgagtctttcccagagacttcc

SEQ ID NO: 165970 - DNA, 601 bp, Human
agagcactttctttttctgtcattggtctaatcctggtgccacatacagaaatgatatcctaaaccagcctggtagtaacagggaggtaacatcacacagctaattcacacatggctcaacagcaagattttatgcacagtagtttattctcacataggcacaaacacagtaaaactatgtgaaacttatacaagactgcagcagctttcgtggtgagattcactccacagtcactgaaatagatatgaaattccaggggaatattaatttgattttggatcttttcattttttaatattktagaagagtaaacacagtatgtttacatgtggcttctttcgtcttttatcttttttcaattttgctagccctagttttttgtttttttttttttttccaaatacaattcaaacatagagtaagcaagggcctctgtggcatgagatctgggaacacaggaagacattcctcatcatcttacatattctgatggattctgtaggagtccatcataaaaatgtcctccattaaaactaagattttgatcccttttaaaatacttataggcctgaggtacattatacattcatatgaaaaatc

SEQ ID NO: 165971 - DNA, 601 bp, Human
cctctggatttcctgcctcccttgcctgccaaacttcacttatgaaaagccaggcttcactttctatgagtcaggtcagttgcagaaagaaaccgatttcatatcaggctataacagatgagcttttggggtgtatttggcctcaggcggaagcctggacctcccgttagcatgctctgcctttaagagctgaatgtgggccactgaggaactgaccagaaggcactggcctactccgaagtccactaggacaaacaacaccaatgtgcactctgaggggctggggtacacccagctgcgkggtgtttcccgtgttccctataacctggatgtgttgctcattatttgatcatcttcagaccggagatgtgacaagctaggaagccgcagccagttctatgcacaccgacagctgaaaagagtctttgtttcatggcccgtcacatcatctgggaaggagcccaggagcaaaagaaaaggggggaaagcaaatcaaccttcctgccactcactgagtagccccagcagtgaagaagcaagaggtacctgccagaattaacaactgtgtcatctgcaccccatctaagtagatgcctctgtg

SEQ ID NO: 165972 - DNA, 601 bp, Human
ctgaactcttgctgggcccagatgccaagagacgggaccctcccccacacttgggcagaggaagtaacaagggctggaaggagccatgctttacaggctcattctcctctggatttcctgcctcccttgcctgccaaacttcacttatgaaaagccaggcttcactttctatgagtcaggtcagttgcagaaagaaaccgatttcatatcaggctataacagatgagcttttggggtgtatttggcctcaggcggaagcctggacctcccgttagcatgctctgcctttaagagctgaatrtgggccactgaggaactgaccagaaggcactggcctactccgaagtccactaggacaaacaacaccaatgtgcactctgaggggctggggtacacccagctgcggggtgtttcccgtgttccctataacctggatgtgttgctcattatttgatcatcttcagaccggagatgtgacaagctaggaagccgcagccagttctatgcacaccgacagctgaaaagagtctttgtttcatggcccgtcacatcatctgggaaggagcccaggagcaaaagaaaaggggggaaagcaaatcaa

SEQ ID NO: 165973 - DNA, 601 bp, Human
tctctttaaactgccttggcactgcactgaagggccaaatcttaattcagggtaaatgaaccatctccatggggatatggagaaagaaaaagttcctgccccaaagcctcaggaatcagtctactgaactggcttcattccttgcttcttccaagagcagatgagaagtctccttactccctctcagtttcaggaacccccttgccattaataatgtatacacatacatgtgttttgcatatggaccaagcagagactaccaaacctctgaactcttgctgggcccagatgccaagagacrggaccctcccccacacttgggcagaggaagtaacaagggctggaaggagccatgctttacaggctcattctcctctggatttcctgcctcccttgcctgccaaacttcacttatgaaaagccaggcttcactttctatgagtcaggtcagttgcagaaagaaaccgatttcatatcaggctataacagatgagcttttggggtgtatttggcctcaggcggaagcctggacctcccgttagcatgctctgcctttaagagctgaatgtgggccactgaggaactgaccagaaggcactgg

SEQ ID NO: 165974 - DNA, 601 bp, Human
gagtgcaagagtgggtgaggatgtgagtgctacgcagtgaggcagaggtcatggagacctattcacattgagtctactttaaagcaggccactttaatcatgagagacctgagaagacagtggcaggctgatctgttttagtgtgatatattctggctgctgcgatcaataaatcatttctgggcttaagaaaacatgtcactggcaaatcatagaaaggataagtgtcatgatttaccttgatcttagtcaatgatcagaaattacttttcttctctttaaactgccttggcactgcacygaagggccaaatcttaattcagggtaaatgaaccatctccatggggatatggagaaagaaaaagttcctgccccaaagcctcaggaatcagtctactgaactggcttcattccttgcttcttccaagagcagatgagaagtctccttactccctctcagtttcaggaacccccttgccattaataatgtatacacatacatgtgttttgcatatggaccaagcagagactaccaaacctctgaactcttgctgggcccagatgccaagagacgggaccctcccccacacttgggcagagg

SEQ ID NO: 165975 - DNA, 601 bp, Human
catgggccaccagcctttaattctgtggttcggaaaacacttgtgttgagaacacagccctggtaatttcttcctcaatgtggctgctagaagaaggttcagggaatgaattttgagttcaaatcccggttcagcctcttactagttatgttacattgggaaaatcttgtatgttctagtatattttatcgattgagtcaacaattacttattaagcatctactacatgccagtgttttcaatgtttaagatatataaataaataaaacagttaagaatccctgcccatggtaagcataakcaataaattacaaagtgtagcagaacataagcactatacaaagccaagaaaaaagtagagcagattaagagagatgtgagttttcagagactcaaaatgaaactttaagtatgtatggtaaccagcgttggcaaaattgagaagctaccttgagaaagaaattagtagaactgtgtttgtggttatttgttacaacagcaataaaaataacatgaaggtattatattacagttccaaatgtcagaagtctaaaataagtctcactggactaaactcaagatatcaatagggctgtatttc

SEQ ID NO: 165976 - DNA, 601 bp, Human
tatatatgcttaaagtggcttctgataaccaaagtattccatttcataagaaaaaaaggggtgagatcaaaataataacactattacttagggcttaattctccaaatcctgatctgtttaatgacgcaaaggtgagaaacaagatttcttctttgtaaggtactcattatctcttgagtgacactcaaatatactttttaatatagaagttgttttagctgttagtaatttagcatcataaaaatagtaacaactgctaatgtaagttaaacattattaaataaccaatagtaacactawtaatcatgaatattgagtaatacataatattatttattataagtattgataatgcaacattaaagataaagccacataattccgtcttgggaaacaaaaaaataacatgaccagtagaagctacagcatcaacacaatatgaaaagaaagagattgaaagaggggctcataaatacagacactgatacatgggccaccagcctttaattctgtggttcggaaaacacttgtgttgagaacacagccctggtaatttcttcctcaatgtggctgctagaagaaggttcagggaatgaattt

SEQ ID NO: 165977 - DNA, 601 bp, Human
ttgacagagacccacgatggagtgttttaccaaaggctccaaaagaaacctccatgaatgctatttttattcggattatgacatatatatatatatatatgtatatatatatatatatatatatatgcttaaagtggcttctgataaccaaagtattccatttcataagaaaaaaaggggtgagatcaaaataataacactattacttagggcttaattctccaaatcctgatctgtttaatgacgcaaaggtgagaaacaagatttcttctttgtaaggtactcattatctcttgagtgrcactcaaatatactttttaatatagaagttgttttagctgttagtaatttagcatcataaaaatagtaacaactgctaatgtaagttaaacattattaaataaccaatagtaacactaataatcatgaatattgagtaatacataatattatttattataagtattgataatgcaacattaaagataaagccacataattccgtcttgggaaacaaaaaaataacatgaccagtagaagctacagcatcaacacaatatgaaaagaaagagattgaaagaggggctcataaatacagaca

SEQ ID NO: 165978 - DNA, 601 bp, Human
gctgggcgcaatggctcatgcctgtaatcccagcactttgggaggccgaggtgggcagatcacctgaggtcaggagttcaagaccagtctggccagcatgatgaaacccagtctctactaaaaattcaaaaaaattagccggacatagtggtgggcacgtgtaatctcagctacttgggaggctgaggcacgagaatcgcttgaacccgggaggcgaggttgcagtgagcaactccagccactgcactccagcctgggtgacagagcaagactctgtctcaaaataaaaaaaaaaaaaaaattatatattatactagaagaatctaggcacactatttaaaaattatttttaacaatcatgacttcctttaatagaaaactatgattttttacactttagagtattttagctaacacagctggttatgtagcttaggtggcatatattgtcataaagatatgaacattcctatcccatataactcaattcaagctattaacaaggctttctcaataaggattgaatagttagtcctatagtttcacggactcagatggccatttaagatcatagaaaatttcattgagtcatatggatgcc

SEQ ID NO: 165979 - DNA, 601 bp, Human
tctctgccagtggttttttcttgctcctgggcctgagtcacaacccacacagcagactggaggcattagggatgttgaagtgtaaataccccagctccctcaccgctaggtagactaactctgagataaattctgcctaagttcccagaattttccagcagggttaagcttcagttgccccgactgtagctgtcttggtattatgccctttgttcaatgccttccctcctttgcctcactttcctactcctctagcagtattcccttcaccttccctattaactacttgcactgaaatcayaggctcacagcctgcttctaggagaacccaacctgagacaaagtaccactgagttgcttccttcccgtatgactatttttgttgacccagcttagcccagtatttctctaactcacctctaagattctgaagctggcttcccctgtgcctgaggtcttttctcttggcctaatatcctggctagattttggcagttccccactctaggggcaatgtcttttcagcctgcacctctgactcctagctggatggatgacttcaggatacacaatagaatcattcctgtgacttatctgccca

SEQ ID NO: 165980 - DNA, 601 bp, Human
aaccgcagtaacaggtgttaacatgactgtctgttgcccctgtagactccttcttgcctgctattgcagtagtgatggtggtggtgggcatgggagaagtgggaactgtttcccagcagatgagttgtcacctcttgcctttccctcccccttttagttgttctctctgaacttctcggtctgctgactcaaacttctctaatcttccagacaagtttgacaacgacaagagcttttcaattatcaataccttcatttctctgccagtggttttttcttgctcctgggcctgagtcacaayccacacagcagactggaggcattagggatgttgaagtgtaaataccccagctccctcaccgctaggtagactaactctgagataaattctgcctaagttcccagaattttccagcagggttaagcttcagttgccccgactgtagctgtcttggtattatgccctttgttcaatgccttccctcctttgcctcactttcctactcctctagcagtattcccttcaccttccctattaactacttgcactgaaatcataggctcacagcctgcttctaggagaacccaacctgagacaaag

SEQ ID NO: 165981 - DNA, 601 bp, Human
ggttttgtatgccaaaattatcacaatttttctttaaaagactcttagaaagtaacattgatactctatgattcccatagaaaataaaaacagaggtacaaaatgaattgcctcaaatatagaactagctaatagcagtatttgagctccaaactgggtcccttgacttcattcctaacactattctctttgctcagatctcagtttcctcctggttattgcacctgacctcaggaaaccttccaatgcccttgtagaaaattctagaagaggttggaaccgcagtaacaggtgttaacaygactgtctgttgcccctgtagactccttcttgcctgctattgcagtagtgatggtggtggtgggcatgggagaagtgggaactgtttcccagcagatgagttgtcacctcttgcctttccctcccccttttagttgttctctctgaacttctcggtctgctgactcaaacttctctaatcttccagacaagtttgacaacgacaagagcttttcaattatcaataccttcatttctctgccagtggttttttcttgctcctgggcctgagtcacaacccacacagcagactggaggcatt

SEQ ID NO: 165982 - DNA, 601 bp, Human
ggttgtcttggtaatggtggtgttgatggtggttgtggttatggcgctggtggtggtggtggtcatagtggtgatgggagtggtgatggtggtggtgatgatagcagtggtggtggtggcagtggtggtggttgttcctggtaatggtggtgttgatggaggttgtggctatggtggtagttgtggtggtggtggtggtcatggtggtaatgggagtggtgataatggtgatgggagtggtgatggtgatagcagtggtggtgggtggcagcagtgctggtggttgtcctggtaatggagrttgtggtagcggtggtggtggtggtggtggtggtggtggtggtggtggtggtggcagtggtcctagctaaagtgataacagaatgaagatctagaaaccaaaatatttttcaacataacatgtgatagtaaatctaattcaattgatttgcacatatcttaaggaataaagttgtagaaaatgatatacactggaaatcctagattgaaaaggtggttaaaaaataaaatgacctccttctttgttccttatttgaaacaattatggaacaagactaaaattctattcttccttagtgtt

SEQ ID NO: 165983 - DNA, 601 bp, Human
ctctaattagatagacttatagttttcatcaagaagttcagtaaataaatatttgggctatctactatgtgtaaaatgtcacaaaaatatttagaaacaaaccagaaatccatatggatgagaagaaaagagaggtggtgatgatggtggtagtggtggtcatggtggtcatggtggtgataggagtggtggaggtggtagtggtgatactggtggtggtggtggaggtggtggtggttgtcttggtaatggtggtgttgatggtggttgtggttatggcgctggtggtggtggtggtcayagtggtgatgggagtggtgatggtggtggtgatgatagcagtggtggtggtggcagtggtggtggttgttcctggtaatggtggtgttgatggaggttgtggctatggtggtagttgtggtggtggtggtggtcatggtggtaatgggagtggtgataatggtgatgggagtggtgatggtgatagcagtggtggtgggtggcagcagtgctggtggttgtcctggtaatggagattgtggtagcggtggtggtggtggtggtggtggtggtggtggtggtggtggtggcagtggtccta

SEQ ID NO: 165984 - DNA, 601 bp, Human
gaaaaaggaaaatgaaagaggatgggtgactctcagtcaatccatgtgatttctgcatgaggacctgtgaaatggagaaaattggatttcccagaactggccctgccactgctcccttccgatccagattgagcatatgtgttacttggtgcaattgttgtcatagagatgattcttgtttgttaaataaaagaaccaaatagttacagaaaagtagacgatgtaaactgtacatgtataaataagttatttccctttaaatgtcaaatgtcccatctctccttatcttttttttttttttgagctttctctaattagatagacttatagttttcatcaagaagttcagtaaataaatatttgggctatctactatgtgtaaaatgtcacaaaaatatttagaaacaaaccagaaatccatatggatgagaagaaaagagaggtggtgatgatggtggtagtggtggtcatggtggtcatggtggtgataggagtggtggaggtggtagtggtgatactggtggtggtggtggaggtggtggtggttgtcttggtaatggtggtgttgatggtggttgtggttatggcgctggtggtggtg

SEQ ID NO: 165985 - DNA, 601 bp, Human
taaaatgctatcaaatagcttctcatggtacagagaaatctttcctgaaaggaaaagttaatcgatgcatcaaacttcattgtcttattttaagaagttaccacagccaccttaaaccttcagcaaccactaccctgatcagtcagcaaccatcaacacctaggaaagaccctccaccagcaaaaagactacaactcgctgaagactcaggtgatcattagcattttttaggagtaacgtattttttaattaaggtatatacattgttttttaggcataatgctgttgcacaaaatagacyacagtatagcaaaaacataactttcatatgcactgggaagacaaaaaaattatgtgacttgctttattgtggtggtccagaactgaatccacaatgtctcttaggtatgcctgtatatgaagagctgactagagaaaagtttctcagaaacacaaagccacagtagaagtgagacagcctaatttaaataaattaaaagaaaaagaaaagaactctaaaaggcaccatgcctttgctgaaaaaagccatttgtttgctagtgtgagttctgacaaagaccaaattctgtcttaagtacat

SEQ ID NO: 165986 - DNA, 601 bp, Human
gaatattacacaaacttcacagataaagcagtggcagtttgagaggactgactccaatgttgaaaaagttgtactgtgggtaaaatgctatcaaatagcttctcatggtacagagaaatctttcctgaaaggaaaagttaatcgatgcatcaaacttcattgtcttattttaagaagttaccacagccaccttaaaccttcagcaaccactaccctgatcagtcagcaaccatcaacacctaggaaagaccctccaccagcaaaaagactacaactcgctgaagactcaggtgatcattarcattttttaggagtaacgtattttttaattaaggtatatacattgttttttaggcataatgctgttgcacaaaatagactacagtatagcaaaaacataactttcatatgcactgggaagacaaaaaaattatgtgacttgctttattgtggtggtccagaactgaatccacaatgtctcttaggtatgcctgtatatgaagagctgactagagaaaagtttctcagaaacacaaagccacagtagaagtgagacagcctaatttaaataaattaaaagaaaaagaaaagaactctaaaa

SEQ ID NO: 165987 - DNA, 601 bp, Human
cattaagaacatttgtgatttacaggaggaggtcaaaatatcagcattaacaggaatttggaagatgttgattccaaccctcatggatgactttgaggagttcaagactatggtggagaaagtcactgctgctgtggcagaaacagtaagataaccgaattagatgtggagcctgaagctgtgactaaattgctgcaatcatgagataaaacttaaatgaatgaagagtttcttcttatgatgagcaaagaaagtggtttcttgggatggaatcaactcctggtgaagatgctgtgaacaytgctgaaataacaacaaaggatttagaatattacacaaacttcacagataaagcagtggcagtttgagaggactgactccaatgttgaaaaagttgtactgtgggtaaaatgctatcaaatagcttctcatggtacagagaaatctttcctgaaaggaaaagttaatcgatgcatcaaacttcattgtcttattttaagaagttaccacagccaccttaaaccttcagcaaccactaccctgatcagtcagcaaccatcaacacctaggaaagaccctccaccagcaaaaagactacaac

SEQ ID NO: 165988 - DNA, 601 bp, Human
cactagtcatgtagccactgaccaactgatatgtggcagtgtgactaagaaactggaattttgcctctatttcattttaattaacttatatagctgtcatattgcacagctcaccttcaatgtttccatgagcttacctgtcctaatagacatagcatggtatttattttaaaaacctaggtgtagtcataaataaccttattaaacagtataaaataatattctgaattggtgtggtttgcctggttatctagttatgtacaggatcctgaacttcaagtcaaatgtaaaaaaaaaaaaacaaaaaaccacttaaacatagacaatggtattttttcaaacctcgtaattgagcatacgtatagctctccagtttatattcctgtgtctgccaccatgtagctacaacctgcattatgagaaattaaatattatcaataaacagatcctgtacaggaggaagaagtgattcactgcttaaggtaagtcatcagtccacccggacttaaatcccacatctgctgctcgcttgctgtgtaagtggcaagtttcttaacttctcggtgcatcattgtcctaagccataaaatgaggatagaga

SEQ ID NO: 165989 - DNA, 601 bp, Human
ttctgaaagttcagtttaaaaatagattactgttctcttaaatctacttgcaacatttaaaaacatattttatattctaaactattatttttagcatgtcctaataacaaaccatttgctaaaagaatcatgaaaacaacactggttctcaggtttaacattcaaaatgcaatactaagcaaaaccaactggttcaagagcgtagcaaaaatcaggccttggaaatttaagcaaatgggtataggtcattggtaatctgtaaaattaagcaatggagataatgggcagacttgactaagartaattttaaaagacaagataattattttataaattatatgctatcattttccaaactttgttttatacaaggctatttttcaactattcttatttttttcaaatgatgatagtgatatttttctcctaaaattataggtataggaaactgttaaacctatatgctatagactaaatatttatatcctctcaaaatttgtattttgaagctctgatccccaatgtgatggcatttggagatggggtctttgggaggtgattaggattagattagatttctaactgcctttcttttcttttc

SEQ ID NO: 165990 - DNA, 601 bp, Human
ttcaagactagcctgaccaacatggtgaaaccccatctctactaaaaatacaaaaaaacaaaaacaaaaacaaaattaaccaggcctcaggcctattggcaggtgcctgtagtcccagctactcaggaggctgaggcaggagaatcgtttgaacctgggaggcagaagttgcagtgagccaagattgcaccactgcactccagcctgggtgacagagtgaaactccgtctcaaaaaaaaaaaaattaaaattctatgctacatctctaatcatgttttaaaatatattaatttctgaaagatcagtttaaaaatagattactgttctcttaaatctacttgcaacatttaaaaacatattttatattctaaactattatttttagcatgtcctaataacaaaccatttgctaaaagaatcatgaaaacaacactggttctcaggtttaacattcaaaatgcaatactaagcaaaaccaactggttcaagagcgtagcaaaaatcaggccttggaaatttaagcaaatgggtataggtcattggtaatctgtaaaattaagcaatggagataatgggcagacttgactaagaataattttaa

SEQ ID NO: 165991 - DNA, 601 bp, Human
gttcaagactagcctgaccaacatggtgaaaccccatctctactaaaaatacaaaaaaacaaaaacaaaaacaaaattaaccaggcctcaggcctattggcaggtgcctgtagtcccagctactcaggaggctgaggcaggagaatcgtttgaacctgggaggcagaagttgcagtgagccaagattgcaccactgcactccagcctgggtgacagagtgaaactccgtctcaaaaaaaaaaaaattaaaattctatgctacatctctaatcatgttttaaaatatattaatttctgaaakttcagtttaaaaatagattactgttctcttaaatctacttgcaacatttaaaaacatattttatattctaaactattatttttagcatgtcctaataacaaaccatttgctaaaagaatcatgaaaacaacactggttctcaggtttaacattcaaaatgcaatactaagcaaaaccaactggttcaagagcgtagcaaaaatcaggccttggaaatttaagcaaatgggtataggtcattggtaatctgtaaaattaagcaatggagataatgggcagacttgactaagaataatttta

SEQ ID NO: 165992 - DNA, 601 bp, Human
ggccaggtgcagtggctcatgcctgtaatcacagcactttgggaggccaaggcgggcagatcacgaggtcaggagttcaagactagcctgaccaacatggtgaaaccccatctctactaaaaatacaaaaaaacaaaaacaaaaacaaaattaaccaggcctcaggcctattggcaggtgcctgtagtcccagctactcaggaggctgaggcaggagaatcgtttgaacctgggaggcagaagttgcagtgagccaagattgcaccactgcactccagcctgggtgacagagtgaaactcygtctcaaaaaaaaaaaaattaaaattctatgctacatctctaatcatgttttaaaatatattaatttctgaaagttcagtttaaaaatagattactgttctcttaaatctacttgcaacatttaaaaacatattttatattctaaactattatttttagcatgtcctaataacaaaccatttgctaaaagaatcatgaaaacaacactggttctcaggtttaacattcaaaatgcaatactaagcaaaaccaactggttcaagagcgtagcaaaaatcaggccttggaaatttaagcaaa

SEQ ID NO: 165993 - DNA, 601 bp, Human
tggaggctgactcccatctgcatacctgggtcaataatcttagcataaaagtataccctagggttagcgctagaatattagtggtagttttcttggccaaaaacaacaaaaaaatgttactacttacggcaatttaattgtaaaatatacaaaagtatcaatagataatacattgacataaagcgtgtttatctttataagggtatactcttgctaaatattttcaattaataagattataccattttatcatttagcaaaattattcctcaacaatttggatagccaaaaaaaaaaaaarcataaaaatgtcaagcactgtaaatgtaacaggcagtggacaaacctatttcaaaaaacaatctttaataacaagttgtaatagctttagtaactattttaagtaatattgttctataattaaatatatgtttgctcattgaaatgtataaaaaattggccaggtgcagtggctcatgcctgtaatcacagcactttgggaggccaaggcgggcagatcacgaggtcaggagttcaagactagcctgaccaacatggtgaaaccccatctctactaaaaatacaaaaaaacaaaaacaaa

SEQ ID NO: 165994 - DNA, 601 bp, Human
ccattgtaaaaccgaaaagcaatgcttgagatgttttgcagaccctgtacctggatcagttggcaccactgtctgataaactggttcatctggtattgtggccttcaaccaggaactgactcagagcaagaggacaattcgactctctatgatttttatctcccacctgaccaatcagcactcgccactttccaaccccttccccaccaaattatccttaaaaaccctaaaacccagtttttcagagagactgattttagtaataataaaactccaatctcccagtacagctggctctgcrtgaattaaactcttcctctattgcaattccccgtcttgataaattggctctgtctatacagtggacaaggagaaacggttgggcagttacagcatcagacactgcaaacaagatggattatttagtattccctgagcacatctcactctttcccattttactcttaggcttatcacactgcaaagagggtccacatggggccagagcagaagcaaaaaatatctgcaacatcattgctccatctacaagaggcttggccaaatccccacaagtggacagcacataagggaaccacttgat

SEQ ID NO: 165995 - DNA, 601 bp, Human
aacctccaaccccctggttcaagcaattctcctgcctcagcctcccaagtagctgggattacaggagtgcaccaccatgcccagctaatttttgcatttttagtagagacggggtttcacacatcggccaggctgctctcgaaatcctggcctcaagtgatccacttgccttggcctctgaaagtgctgggattacaggcgtgagccaccacttgactgtataatcctacaatatacaaagacttacttggttcctaccattagtgctttaggaaaaactcaacgcaatatgcacacccartattccctgccatcatttactccgccatcacagccacacaattggtctatgaatgtcactaaatcaacctgctagttcagtgaaacaacagaccactactagttggctaaagtatttgttctactctttttccagttgtgtggataaattcaaatggtcatcccaattccaaccatctatataataactaccactgaagggttccgataaaagggaaaatatttatataagaatccagttctgagagaggtggtggtctggaaagttcacccacattacttagtagatagatagataggt

SEQ ID NO: 165996 - DNA, 601 bp, Human
tacatctccatacacaagtgagtcatgaatctgagaaaaagctttgtgctgtgaccaacctctccaccctactcagaggaggtcttcactttccacgtctgtttacctgcaaccaacatttaatatcacctagaacagtgtgtctctgggagcaaaactgagttgcaaagagctgacaacttccagttttcattacttttcatcttttgtttgtttgttttgttttttgagacagagtctcactctgttgcccagacttgagtgcaggggcatggatctcggctcactgcaacctccaacyccctggttcaagcaattctcctgcctcagcctcccaagtagctgggattacaggagtgcaccaccatgcccagctaatttttgcatttttagtagagacggggtttcacacatcggccaggctgctctcgaaatcctggcctcaagtgatccacttgccttggcctctgaaagtgctgggattacaggcgtgagccaccacttgactgtataatcctacaatatacaaagacttacttggttcctaccattagtgctttaggaaaaactcaacgcaatatgcacacccagtattccctgc

SEQ ID NO: 165997 - DNA, 601 bp, Human
cttcgggcaagtaattgtgggtttaactccactggagttaatctccaggaaaatatggtaagatccctgtatactgttgctcattcatccctctattcactgttttatcaaacactttataaaggacctggtatatttaaggcactaatgtcaggcagagtaagggatgtagaaagaaacccacagggatctgactcgcaaagagaatcctctttctcatttgtgttcaagtcacactcttccagaatgctccctgcacaacttgctcccccaacccctcccccaaacacaacttctgctrgcaaggagctctcacctttccatcttcctattgcatcggttgttatactcttgatttttgacattttaggtatggaaacctttgttcaaatcaaaatagtttaaaataaacaaaagtagatggaaccagaggtgcttagttaaacgcaaaagagacagagtccaagtcactgcccataaatcctcccttgactgtctacccaccctacccatcacacttcaccacgcagccctaaggggcttttcctaagcacacttagaaaatcactggttcatatacattttgctgattgtttgcaac

SEQ ID NO: 165998 - DNA, 601 bp, Human
gactctattaacactgaattgttattcaactccacctccaaaaaccactgacacatccagctagggcttagagtgaaagaagccaagtaggtttggggtaaatggtaaaattatttccttctcaaagaagagaggtacaaatgctagtaactaaaacaccaactaaatttggaaatgagcagcttatttttcttttaaagtgcaaggttgtctttttttctgtttcttatattcaaagattgtcatcaaaaaattataaacataaaacacttgatctttcataacttttttgtttttttttgagagagggtcttgctctgtcccccaggctggagtgcagttttgtgatctcggctcactgcaacctccatctccagagttcaagtgattctcctgcctcagtctcccaagtagctaggattacaggtgcccaccaccatgcctagctaatttttgtatttttagtagagacggggtttcatcatgttggccagactggtctcgaactcctgacctcaagtgatctgcctgcctcagcctcccaaagtgctgagattataaaatgtataaaagtaaattaagtattttattgacataaatt

SEQ ID NO: 165999 - DNA, 601 bp, Human
taataaagctgtgaaaaacagaggttaagtaattactagagactgcacatgcagagttcctcaaagctgtaaatatggagtcaacgtcaaatttaatgtactcaaatgatcccacactcttccctttcaaattcacttctctccaccaaggaccttgacttaaagatcataaaagaaaagaaagttgtaaacaagaatgagtcttaccactcagagccatggccaaccggaattcttcctttagtatctcgaggacatcttgaacacctttctccccctaaccaagtgaaaagatacagastgattcagaactaaatcagtctgacttgttttattcatttgttttactgtcaagttgtctattttatatattcatttctttgtccagttacctggaaagctaagccccaaacgattggtctccccacaaacacagccttggcgccaagagccagagctttcagaacatcagtgcctttccgcacacccccgtccaggaagacttccaccttcccttccacagcctccacaatttctggcagaacatcaatctggggaaagaaaagttcaataatgtgactctattaacactgaattgtta

SEQ ID NO: 166000 - DNA, 601 bp, Human
tggtattctaaattaggttgaaactttttaaccttttaatttattgctgcttgtgtttaacaactgacttgtatgttgatcttatattctgggatcttgacttaattcatgtattttttccagggttgttttgagattgcttaggattctgtataaaaattcatgatgtctatgaataaagacaataggcttcttcctttctgattgttatgctttaatttcttctattgagctgtccagaaccctccaggatgacttcagtaagtgtggtgacaacagacgtccttccctgtttcctggyttgggggagcttgcaggatttcaccagtgaggacttgctccccatgttgggtttcagaggcgtcttcctcactgtgtggaatttttgtcaaatgatatttcatgtatgtgttgacatagtcatgtgctcttgctcctttattctttaaatttggtagaataaatttttagaattttaaaccaggtgtatacttttctttttttggtactgtctttgtcttgttttggaattagtctcattctgatgacagatcaatttggaagcattccctcttctattttctgaaagagttaagtgttg

SEQ ID NO: 166001 - DNA, 601 bp, Human
aaaaaatggaccgtatcaccctgggtcatacttagattacaaaaatagtagcagtaggacttgtagatcttggaagctggggagctaagggggctcatctttcacttaccaagggcttacccttgtttttcattcttttatttttttcacataagccttttcagaaaaatataggaaaagctgatagagtccaattgaactaaaccactttaaaactttttgtattttggaaaatgtggggactacacacagactgtcttctactgcagaggctctttttctgtcttcatggtagggatcyatttacagggtttgtgggtctgcttttggcatctggcccagccagcccttggattgaggctgggtggggcatgcaggttggccctgaccctcttctgagcacctggctggctggacagatagggccttcagtcaccagctaggctggcctgaccctagaccctctggaacgtgagaacgtatcctgccgggcctctgtgttgaacctgggaggagagttgtctgatgtcattggatgccctatgagtttctgccctcgaaacgtgccccatggaaagcgtgaagatgcctttgagcttcc

SEQ ID NO: 166002 - DNA, 601 bp, Human
agatggcaaacgtgtgtgcctgtgtctgtgagtcagaagcaaacttgttcatttcatttaattttaagtctgccaggaacttcttggaaggaagaaaagaatggttgaatgccagctacaaataggtgagttcagaatatgatccaaagtgtcagagcaaaagattttttaagtttccaacatttggagtaaaagagcactttagagtaacaggtaaatgggttaacttcaggcagagagaggtggatgtttctgcctctctggtatgttaaaataaaaccccttaaatcccctgctcttcataagtttccatttaagagtcattgggcttcacctctgttcggctctgtttgtgaagggagggcagcttttctggggagatcatgcccctctctcctttatgtggccacagagatcctttccctgttttcatgaggaggaaacatggaaccttggcacaatccagttctcatctagaattacattgtatgctgtgcaggccaggggaggaaagatcccggaagtggcagccaccggataggcacgttgccgccacagccagcatcggcgtctgttcaggtttcaggaaggtcacttcttg

SEQ ID NO: 166003 - DNA, 601 bp, Human
gtttgttaaatgtaaaattttatcagtaattagatcagctccttgatattaatgtacagggtagctcttgcgtgctgatcagttcagaatttaaattgagttaaaggttaaatgagtttaatttttgaattgaactgaagcattgtcttgtggcaaattcatccagaatttttatttccagttgctgtacaagtgacggaagtgggtctttttgcgataaaaacattgtgaatacatttaggattcagtgagcttctgtcatttactcgctcattctctaaacgtgtgagtgccctgctcygtgtcagaccagatggcaggccctgcatggggtggggaggggccagaatgtgcagccccacctgcagcccaagcccagctcaggggcagacaggggcagacggggaagtgggctgttccacaccttgagattggtgaattcctcaagacagcggctggcaggggcccaagcctaggtgactggccacagagctgaatggggctgaccgagttaggacatcactgggtggtgaaccaggaggccctggctgctgacaggatgtaggggcatggaggggtagcagaaggaggcagttaagag

SEQ ID NO: 166004 - DNA, 601 bp, Human
atgggaggcaatacttgttcttgttcccaagaagctgatgtgtcgtccggtgaggtctctcgtcagccgaaggttggcacaaggtcgccaggcaagggctttttgtatgtgaagtatgcacattctagccacagagttttctgccagggtgtttagacaagctaaaagtggaatataaactgtattcaatttgctaggttgcaattataaggacaaacatgtttttaagacttaacccattatagtaggaaaatacaaggcttggggtatgctgactctttcccttgttcgtctctcaaayagaaaaatggtgtgtgtaagtaggtgtttgtatatgtacattataagacattctagaaatttctgtcctatttctttaatattcttgccactaaaaatatatgctcctgaaactagggaaaaagaaactgtttatcattcttctgaattattacagataccccaaaagtagcctcctccaaatagtggtttttcttttctaaaaatcacctggaaaaatactgagctttctgatctttattttatccttttcagtggctctgtttggaagagttattgtacaacccagcactgcttttat

SEQ ID NO: 166005 - DNA, 601 bp, Human
aggtgtttgtatatgtacattataagacattctagaaatttctgtcctatttctttaatattcttgccactaaaaatatatgctcctgaaactagggaaaaagaaactgtttatcattcttctgaattattacagataccccaaaagtagcctcctccaaatagtggtttttcttttctaaaaatcacctggaaaaatactgagctttctgatctttattttatccttttcagtggctctgtttggaagagttattgtacaacccagcactgcttttattaaaaagaaaactgggccactyatttccttcaaagtttttggtgtgtttaaatcttctctaggtaaacaaaacttttattgaaaataatattttgagaccgtgacacccttctcacaagaagcggtgctgaaagcccccttgttggctggtcctgcaggcagcctggcgtctgctttgcctgtgggccgtgcagggtgctgggggcagtggggagaggcgtcagtcccacctgcagctttcgggggggtgctggggaggcagatttgacatgaacgcaaataagtgcaaggaccatcagggcaaagagacccaggagaccag

SEQ ID NO: 166006 - DNA, 601 bp, Human
ccgtgacacccttctcacaagaagcggtgctgaaagcccccttgttggctggtcctgcaggcagcctggcgtctgctttgcctgtgggccgtgcagggtgctgggggcagtggggagaggcgtcagtcccacctgcagctttcgggggggtgctggggaggcagatttgacatgaacgcaaataagtgcaaggaccatcagggcaaagagacccaggagaccaggccaggggaggaggcagagagcctggtcaggccaggctggtcctccaggtccaggccctgcaggatcctggaaggcrtgaagatgggctggaggtgtgagcaccaagaatggggcgcggcctgaccttgggtctctagaagttaccctgtggtggcattttctataattgatgtcataaatagctggcttctttgttagaattcatttacttactaagtttggcaaatatgttgaaggaaagaaatgtgagtgtgtggatggatttcagcacgttgacatcagtgcctgtctccttggtgcctgttggagacaccgtgttggaataaggatgaggttcctccctcagaatggttgatccatttccttcagttcttct

SEQ ID NO: 166007 - DNA, 601 bp, Human
ttggttacccactcaggacagtaaaatcacaaagttttagctaaggaaggagaaatcccttctgcctgtataataaatgttgttttgacccaactacactgtttcttgtgataaaaatatgtcacttaaggtttcctgcatctgccatttgtgaacgtacagttgagcgacattagttggtgccatctgtgagtgcacagtgcagcaactttagggggttcacaatgttccgcagccatcaccgccgcccagcactggcatgtttcacagtgttccgcagccatcaccgccacccagcacyggcatgtttcacagtgttccgcagccaccaccgccgcccagcaccggcatgtttcacagtgttccgcagccaccaccgccacccagcaccggaatgtttcacagtgttccgcagccatcaccaccacccagcactggaatgtttctgtgttttgattctttttttttttttttgagacttaatctcgctctgtcacctaggctggagtacagtggtgcgatctcggctcactgcaacctccatctcccaggttcaagtgattctcgcgcctcagccccccaagtagctgggattacaggt

SEQ ID NO: 166008 - DNA, 601 bp, Human
gaacttttctgtcttgcagaactgaaacccgtacccattaaacactaactccccatttctgccagcccatcccctggcacccaccctactcctttccgtcttgatgctaacacaccttgtgtgggttcctccaagtcaagagaaggagtgtccaaagacccctgagaccagaaccctctgccaacgttggtagtgctgtttcggcctggagggcaggtgggcctctgggcacttcttcgtcaggacatggagccatttcgggtagggccctgggtctaccctgtcccagccccgttccctrtcagaaacccgaggcccagaggtgcagggcagctgcagcaccagggtggacagatgttgatgatcagtgggaaggaattcaaagaaatagaacattctacacaaatgtggggaggtatctttagtaaaaacaggacccaagtacatgcaaagtgcactgtgagggagagagatgctctgaagaaaggcactgtttttacattaatgagcatttaaatgatgctgggttaaccatttggctttttgtaccttgtcaccatctcctttatggtgtgattggactttcgagagaaggtggagg

SEQ ID NO: 166009 - DNA, 601 bp, Human
atccaccacgatgtctcctcttaaccatgcgcagccagcttcccaccgcatggagtttaatttctgcgatagggttcagtaagcaaatgcaaatagatttaatgatttgcatcagtagatcatttctcagtttaatatcctctgatattttgggtcaaggactctttctttgggagactagtataatttctagaggtagaattattaatattagtgatattacattatgttgaagtgaagtgagatagatgtatcattttcacaaagtcagatttctgcgtgacttttattcattgtggtrcaaaggaaaccctggctgctgaagtagacttaggagcaggcagaattcctggacgcaggtgccttggagtgaggtgaccctctctggcccccagcaccttgcgagcagtggtttttgcatctgttcaccagcgcatgtgaacctgtgggcccgggggacacgtggtccatttttgttgagtacgttcaacaaaggaatgaattaaaatgagaactcttttcagcaaacgctgatggagctttctgtgtctcgtgtgtggcaccatgctgacggaatgacgagaaaccacaacctggcctc

SEQ ID NO: 166010 - DNA, 601 bp, Human
gagaactcttttcagcaaacgctgatggagctttctgtgtctcgtgtgtggcaccatgctgacggaatgacgagaaaccacaacctggcctcaaggagctttgtctactgcgggagacagagatggtggcagatcagtcctggaggcacaaggagagagtggtagaaatacacaaaaggcattgaagaccagtggagcatcagggtcactttcacagggaggaggccaggggtcttgttgcctgcctgccccaaacgtggcctccattccttctttctgtctcccgctggaaaggctgagygcaggtgccagctctctctgcctcactgagcgggtatgtgtgagaagcgtaggcctactggcaggctcctggggaagacgtttctcccctgatacaaagagcagcatgaggaagactctcccggctccccagtctgcggacacagttgtgtgaatgtgattgcaggagggagctgggcagctgttatgtgaccatgagggcgtgggactggggctgaaaggtggcgtgctgccaatgagaaagatggggagagctgggcacctgctggccctgtggccggccaggccgcctctgaacacc

SEQ ID NO: 166011 - DNA, 601 bp, Human
gtaaagatccataggccgggcgtggtggctcacacctgtaatcccagcactttgggaggccaaggcaagagactcacttgaggccaggagtttgagaacagcctgggcaacatagattctgtctctacaaaaaaacttaaaaaaaaaaaattatccaggcctggtggaaggcgtctgcagtgtcagctactcaggaggctgaggcgggaggaccgcttgagcccaggagttcagagctgcagtgagctgtgattatgccactgcactgcagcctgggcaacagagtgagaccctgtctctaaaaaaaaaataaaataaaaaataaagatcctgtaagtgaagggttagaagagtggaatatatgtgctcttaacaaagaatggtgtgattatagagatgggaggtgaaaagtagcacgaattccaagttttattttcggcaactccgtcagagtcctgaatgttctttacccagtttctcactcccactgggactctctagggccagcgggaaccctgcaggcattcggagaactgagcgctggctggacctcctcaaaacggggcaccctccagggagctgtcgaggggctcttctgcct

SEQ ID NO: 166012 - DNA, 601 bp, Human
tgtttttggtgactcttgccttggaccctgatggcgctggggggtttcatcgccatttaaccctccgcgtctcacagagaccaagcagtgctttcgggatcgctctgttggtctctgtgtagcacgtggcccccaaaatttaggtgttgaagtcctcatcctcagaacctctggatgtgacagtatttttgagatagggtctcttagaaaggtgattagggtaactcagggtcattagaggagcccctcacccagtgtgaccggtgtccccatgagatggaggttgtggcacagacacacrgagggatggccacgtgaggaccctgggagaaggctgccttctgcaagccaaggagagagcgccttggagaaaaccagctgtgcctacaccttgggttcagacttgcagcacccaggctgcagggcttcgtcagggcagccctggcggaagaacgcagcctcgtcggtgggtttggtgatgctgtgcagttcagctttaccgtcttgctgcagcgggaacgtcctgctgtagaagaggcgccgccatcccagacagtgttcataaacaccgacggcaaagtcaggacgggcaggagcgttc

SEQ ID NO: 166013 - DNA, 601 bp, Human
tcttagaaaggtgattagggtaactcagggtcattagaggagcccctcacccagtgtgaccggtgtccccatgagatggaggttgtggcacagacacacggagggatggccacgtgaggaccctgggagaaggctgccttctgcaagccaaggagagagcgccttggagaaaaccagctgtgcctacaccttgggttcagacttgcagcacccaggctgcagggcttcgtcagggcagccctggcggaagaacgcagcctcgtcggtgggtttggtgatgctgtgcagttcagctttaccrtcttgctgcagcgggaacgtcctgctgtagaagaggcgccgccatcccagacagtgttcataaacaccgacggcaaagtcaggacgggcaggagcgttctaggcaaatgatgaaaatggtattttacacatatttgaaaagaaaggtttgagaaggcatccattattaaaaccaaattcaacagagaatttaaaaactggctgtggtgagcaatgttagtcccaaatcactttttcacaacttgtttctgttctgtcgtagggctagtgagaccagctttcccttgagttctggggcggg

SEQ ID NO: 166014 - DNA, 601 bp, Human
tgatgctgtgcagttcagctttaccgtcttgctgcagcgggaacgtcctgctgtagaagaggcgccgccatcccagacagtgttcataaacaccgacggcaaagtcaggacgggcaggagcgttctaggcaaatgatgaaaatggtattttacacatatttgaaaagaaaggtttgagaaggcatccattattaaaaccaaattcaacagagaatttaaaaactggctgtggtgagcaatgttagtcccaaatcactttttcacaacttgtttctgttctgtcgtagggctagtgagaccrgctttcccttgagttctggggcgggacgtggaatgtttgtgaggctacccttcattgaaggggggcccgtgatgttgagtgttcaccgtctttcagaacgtttgtgcggtggcgtgtcccttctgtaaattgctgtgacctgggctgcatgctccacagtcagactcgcttcgccctcttactggtcttcattaattcgtggtccctggagtggagcgggaaatacagatatccacctcctctcattatccaaatacaataacaaattacgaagcatcttatcctaccaaccattatcct

SEQ ID NO: 166015 - DNA, 601 bp, Human
gtgccatgagatgtaaaatgtactcgccctgtatcttggtcttctcctagcagtatcttgtctgacaatctccttgtttaacttcttgggctttttctttgacatcttcccacctttccctaagggtttaactgtcttagatctccttgtctgcttctgcccgagactctgggtccctgtcaactcgggtagaattttattggtatttttaggctctttaacatactttaatcattgtgttgctgcatatatttcttctaagatagaagtaaattgtaattgtcctcagataataacctargaccttaaaatacacacaaatgtacacactaatgaattttgtaaatattacataactcggtaattattgtttcaaattagataatgcagaaatctctggatttttatgtcggtgtttataaagcattttaatgataattggggaagttggttgtgggtttttagctagaacaggaacccattataatttttcccaattataataatgggacataagcctctgtaacctgaaattttcctctatgacatgttttcagaagtagaattattagatttgatgagtgtggatgcctaggtttgt

SEQ ID NO: 166016 - DNA, 601 bp, Human
ccttaaaatacacacaaatgtacacactaatgaattttgtaaatattacataactcggtaattattgtttcaaattagataatgcagaaatctctggatttttatgtcggtgtttataaagcattttaatgataattggggaagttggttgtgggtttttagctagaacaggaacccattataatttttcccaattataataatgggacataagcctctgtaacctgaaattttcctctatgacatgttttcagaagtagaattattagatttgatgagtgtggatgcctaggtttgtagwcaactttttgaactgagctaatcaatgcatatttgggaagagcatataatccaaaatattgggtctacaaatgtaagattgcctttggtgatgagttggtgtcatctgtcttctgtaggaaatgaagggcctcttgcagtgtgctgtgcctcattttaaacctttaactggcaagtggtcctgatcttccctctggacagctgcgggaagaggtttcccggtttaccttggcccccgtaacaccacatcatcccacgtgtgcgtgaagagcccgcacaggccccctgtgcgcccggggtc

SEQ ID NO: 166017 - DNA, 601 bp, Human
ggcccttgaggggtttatagaaattaggtatgtctgagtatggaaatggctggcatggtgaaagaattgagtccttaagtaatttgctattcccagtgataattagaagaaacccctgttctagctccattttcccattttttttaatgttttaggggagatttctttaggtattagcggctgatcttttttttcttaccatgtactcccgctgtaaggtgagtggttttggcatattgtgttgccttgatgggttattaaatcgtcacttggaaggatgaatgtgggttatagagtatgytgtgccatatatcatcttagtcatcaggaatgtttcagaaaactgaataagagtaaagttttttaaatttatgattgaaattagcaattttattaggtccttttaaaaaaacctacaaacttttaaagtttttctcaaaatatacatctttgttctcagaagaggtctgcagactgccctaatttgtcttttgaaaggacacagaattttagcagaatacttatgctgcagaaatggacaaatgcaggtgctgttccttggatggtcagcatggaaggttgacgtgctccaagatttact

SEQ ID NO: 166018 - DNA, 601 bp, Human
ggaggggatatgctggttctggagtctgagaagatggggctgagccagctgtgactcggccacacgtggctgtgggacttcgcactgactacgcagcctctgccaggtttctttgtaaaagtgaagttaacaccgatctcacaatatctggggaggaataaataggaacacacatgctgagttaaagtcctcagttatttcgtcttcagcgacagatgatccccgacttaccgtggttcagcgtttgagttttcgagctttatgatggtgcagaagcagcctacgtgcagtagaaactgtrccacaagtgcccgtgccaccattctgcgtctcagtacagtattgaataaaggacatgacacagtcaccactttattataaaataggctcgtgttcactgatgctgcccaactgtagctaattcaagtgttgtgagcacgtttaaggcaggctgggtggaaccatggcgtttggtgtattgaatgtgttttcagggtcgatgtttttaactttcactgaatgtatcaggatgtagccccatcataagtcgaggcacatctctgtttgagtgcctgttacgtgctggccatggtcccaggcc

SEQ ID NO: 166019 - DNA, 601 bp, Human
tcgttgaaggcctgcggagattcaggtgccatagggagggtctgggacttttctctcggaggccccatgaagttggtattcctcagctctgccccagggtccctctgattccacggaggagctgcggaaagtccacatttttgaagagctgcaggctggggagcccccgtggcgaacagaggctctaagagaggggtctttgttttggggcagtgagactgagtggccagtgagcaatccgtcatcaatggagatcaatacccaggaggtgccatctctcttggcgggtgacacgtaactkttacaaatgggtgcctgtccctgtcacgtcaccggagtgtgcgtcttgatgccctggctccctgaggcacctcgtgttttcgagtgtttccattttagagacccggaaaagggatccttagagctgctttgttttcctttttcaccagaaacaaatgcctttgtgcttctcccgcctgcggactcccactgcgttcagcccgtgcgggtggtcatcggccagacccatccagcctgtggcccgtcccctccacctctcacagccacctaggaaagtagttctcagctctaaggggcattg

SEQ ID NO: 166020 - DNA, 601 bp, Human
agttggtattcctcagctctgccccagggtccctctgattccacggaggagctgcggaaagtccacatttttgaagagctgcaggctggggagcccccgtggcgaacagaggctctaagagaggggtctttgttttggggcagtgagactgagtggccagtgagcaatccgtcatcaatggagatcaatacccaggaggtgccatctctcttggcgggtgacacgtaacttttacaaatgggtgcctgtccctgtcacgtcaccggagtgtgcgtcttgatgccctggctccctgaggcasctcgtgttttcgagtgtttccattttagagacccggaaaagggatccttagagctgctttgttttcctttttcaccagaaacaaatgcctttgtgcttctcccgcctgcggactcccactgcgttcagcccgtgcgggtggtcatcggccagacccatccagcctgtggcccgtcccctccacctctcacagccacctaggaaagtagttctcagctctaaggggcattgtctgttccaagaagaatgactgctccctgccacctcccacccccatcccatgtccccatcatagacccag

SEQ ID NO: 166021 - DNA, 601 bp, Human
aggaatgggccgagacagcctggctgtttttatgtgcagacatcacattaagctcgctttacttggagattttgaactgtagaggcctccaggcctcctgccttcacttgaggtttttggtgctttttaaaggactgtgataatgatgttattcccaagatgtgaaggaccattctggtgctgtcctgacaggggagcaggtttacagctcaggacactggggtgccacggggacctgggggtctccttgtgcctgggattcctcctcgtcaggagccctcactcaggaagccctgcacgrgggcaaatgtcctgggattggagaggcaagcgtgaatcagacatttccaaagacgacaccgaagaacttctgctgtattccaagttaaaaactaattgatcttggtccaaactatcataggatagttaaaaaaaacacacaatagaatttctgaggtgcttgggagacattttagaaatatgtcattggtgaccactttttataggctgaattaagaggaaaaaaaggtaaaatatcttttaaagtctccagtttctgagacccctctggagatgatttcattgagttcctccctctgac

SEQ ID NO: 166022 - DNA, 601 bp, Human
tattcctttatgacagtgtgaggcaggcctggctaatgtcttccagcccattcatctccccacagggtatgagatgatgggctttagcgtcagacagctgggcccacactccggctcggccacttacgggctctggcaggttacctcagctgttgaactcgtgagctgtgacttcctcctctgctaatgcggcactctcatgcctgcctcgcaggttcagatgtgacgatagacataaaacacctggcccggctccggcgcacagatgctgaagtcagttttctgaggtcgtggtgggggygggggtgagggtggcaatggaaatagtgacaacagtagttggcgttgtcatcctgtttacggctagcctgcgagtggctcaggcgaatccagcacagccttgtcctcgggttagctgccctctcagagcttcacatcataactagttcatttatcatccacgctagagactggtcttccagaggatattcctacctcagagccccttcctcccgacgtgctgggacggcccctgctgttgcctggctttgcctggtattacaagggacctcaacctcctgtgctcttacccgggcctgac

SEQ ID NO: 166023 - DNA, 601 bp, Human
tataggaatattttggtgttttccctatatccttggttatatgtggctgagcataattagaagttaaatttgttttagataatctcttcggctgtgaaatggcatcaatacacttaagagtaacaagtcgaatagaaatcagggcctgttgttagtgtatgagcacacaccacacaaagtttcttcttggttccctatttccgcagttcaaagggggttttaaagaagtcataaaaaatgaaggatcctaatattgcagttggagactgagagtgaatgacatattctttacacacctcarctgtcaacatttctaatcaaatcacccagccttcttacttcttaaatgatacaggcgatatttcctgtaataaacacccctaagtctaatgagaggccctaaggcaacttgaaatatatgaattcattataattgaacaacataatctgcagggcaaagatgcctgctacccagctctgaacttcacagagcttgggtgttttatgaaaaatgttatacgttttgtttacaacgtatggctgctgtttgaagtattgtatgttcctgtagtacataagacggggccgcataatggaggaa

SEQ ID NO: 166024 - DNA, 601 bp, Human
taaagaagtcataaaaaatgaaggatcctaatattgcagttggagactgagagtgaatgacatattctttacacacctcaactgtcaacatttctaatcaaatcacccagccttcttacttcttaaatgatacaggcgatatttcctgtaataaacacccctaagtctaatgagaggccctaaggcaacttgaaatatatgaattcattataattgaacaacataatctgcagggcaaagatgcctgctacccagctctgaacttcacagagcttgggtgttttatgaaaaatgttatacrttttgtttacaacgtatggctgctgtttgaagtattgtatgttcctgtagtacataagacggggccgcataatggaggaaaaatcaaggaggcaatctttcattttgttctggtatgaaaaattcaaaagactgaaaactcacccagagaaattttgcaagcatattattttccaatgtttcgatcaatttgtctgtcaaccatgctgagaggtggaaggggccagcaaaagcaatttagcttgtgaggtccaaaatagaaatgttttagggaaccttgtcacatgttatttctttatat

SEQ ID NO: 166025 - DNA, 601 bp, Human
ggtgcattttaattgattgtacccaagtgacactccgtggaagcatcttgcatgtgaacgtaactgaccctgccagggctttaattaagctataatcttcctttagtcagtgcatctgggattgataaacatatgtaaaccatgctgaccatctaagtgttgctttaaagaaaaaaatggtgcagatatgggagttttaaataaacggctttgatgttacctccagttgaatttttagttgggatttgttaagatcaagttatcttaggagtagttaattctaaggtgaatatacaatctyggtgaaacttgtcctggaaaacctgtaattctgtgattagtctgtgtgtaccccaacactttttcttcaaatcttagattaacactgaatacattaaggttatttttcaaacaggttatagttcagagaaattaatttaaatcagttggcttacagaagacccagtttagttttaatttgccttaacagccagggtcttcctgctctacttacttagacgtcctcagagtgtcttctgagtagttggctaccatttgcatggcatgattccgctctcggagcttgatatctttccagatt

SEQ ID NO: 166026 - DNA, 601 bp, Human
acggctttgatgttacctccagttgaatttttagttgggatttgttaagatcaagttatcttaggagtagttaattctaaggtgaatatacaatcttggtgaaacttgtcctggaaaacctgtaattctgtgattagtctgtgtgtaccccaacactttttcttcaaatcttagattaacactgaatacattaaggttatttttcaaacaggttatagttcagagaaattaatttaaatcagttggcttacagaagacccagtttagttttaatttgccttaacagccagggtcttcctgmtctacttacttagacgtcctcagagtgtcttctgagtagttggctaccatttgcatggcatgattccgctctcggagcttgatatctttccagattttcagaatttagaattaagtgtggaagtcaagcatactgaaagttttttatactatggatgctgataaatagaaataaactatgacaaattaattcagaaatctttccactcagtgtagatattaagttgtggtcatacggaagaagtcttgaaacacgatttacagtaaattatgataatttgggatagagactgtgccatta

SEQ ID NO: 166027 - DNA, 601 bp, Human
aaatctaggttatttaatgttgttataaaattattctaagatcaccgaatggagaatacttagattctaaataagtgactttgtgagaattgaatttttatatcattaaccaattctaagacattttaaagaaggcagaatgatctaacccaatacttcatatacttagttttactgtggaatcccaagggcaacatgtcccccgacccaacgacaaaataacatatattcctattaagtttagggattgatggagcttgtaattgttaatttgtcacagatgatactgttatttatgcgyagttactgtctccctttggagagtttcatgtgctaaattttcagcaaatagtttgagcctcacctacagcttcttgaccttttggggaaaaaactatcactttaaaagaccttttacgagtgagcaaatatatgcttttctgttttcacagtaactttcagagaaacccactggtctcagcatggcctatgccttggcagccctttccacccgtagcaggttgttctttacctttcgtttttaaggtggcttccagttcataccaagctcacatactgtggcgaagagctttctgagaaa

SEQ ID NO: 166028 - DNA, 601 bp, Human
acatgtaccctaaaacttaaagtataataataagaaagaaacaagatgagcttgtggactgtctttcacatcctgggaacttatagaaaggtagttaggattattaagcaactaaaacattttcctttatttttccttccttaccgctacctctcccaagttgtaataatttaatagttacaactattagtacaaatagttttaaaagtctctttgagttgccaccctggagtgtgtatctcctaatgggataatacttaaggcattttataaactttaaagtgccatggacatcagtcatttgtgcatttgtgagcactgcctcatttaagcctgccgtcgccttaatgtactgtgtacattagatacgacttcagttcccttatcccaggagggctgaaacttactgggatttctgttatattgacctaacagattaggatgattttaaaattttactcattttctatattgaattaaaacaagaaattagctgagcattttccaagatggaaggaaaaacggccattgttttgatttctagttatgtaacccattccaaaaattcaaacatgagattacacggagtgctgtattaaac

SEQ ID NO: 166029 - DNA, 601 bp, Human
gggcttctgtctctaaccactagctacaaaaggatgctggacagacatcctgtacctagggacaccccatgatggcttgtcccccgaccacagacaccccatgattggggataccccgtgaccatggatgccccataaccacagacaccccacaactgggcagctcaaggcagcaagtgccttccttgtgtgcttccgttttgttgaggtctttgttgcaaacatcgtttgttgagggctgccttacccttagaagacatagtaccatttctgggaaccatggttgctgttgagaaatgcrtccttacacgcccagatccagccgctgtctggtcccactgacatggcacaggaatcaaagcaggtgcttgggggatgtcaacagttgaatttggattcctcataaagcaatgttagcacatgacactctgtgaggaaataatgatgctactttgtaagataagaaaggggaaacagctgcgttggtggataattgttaacggtgcagctgcagtgtgagttgcacactggaaggtgtttgccgtgacctgtcgcgggctgagctttttggtagcctggcattgtggtggatgcctttcat

SEQ ID NO: 166030 - DNA, 601 bp, Human
acatcctgtacctagggacaccccatgatggcttgtcccccgaccacagacaccccatgattggggataccccgtgaccatggatgccccataaccacagacaccccacaactgggcagctcaaggcagcaagtgccttccttgtgtgcttccgttttgttgaggtctttgttgcaaacatcgtttgttgagggctgccttacccttagaagacatagtaccatttctgggaaccatggttgctgttgagaaatgcgtccttacacgcccagatccagccgctgtctggtcccactgacayggcacaggaatcaaagcaggtgcttgggggatgtcaacagttgaatttggattcctcataaagcaatgttagcacatgacactctgtgaggaaataatgatgctactttgtaagataagaaaggggaaacagctgcgttggtggataattgttaacggtgcagctgcagtgtgagttgcacactggaaggtgtttgccgtgacctgtcgcgggctgagctttttggtagcctggcattgtggtggatgcctttcattccatccgctgtggctgagttctgctttcctgcccctggttctg

SEQ ID NO: 166031 - DNA, 601 bp, Human
gatgctactttgtaagataagaaaggggaaacagctgcgttggtggataattgttaacggtgcagctgcagtgtgagttgcacactggaaggtgtttgccgtgacctgtcgcgggctgagctttttggtagcctggcattgtggtggatgcctttcattccatccgctgtggctgagttctgctttcctgcccctggttctgcagtggcgtgactgggctgcttacaggccctgtctttccaagccaccatttaattggggagggctactgacatggcaccattgaacttgagacctgccwttcctccggtggcagtccttggagaacagggccccaggtctttctgaccccacatcattggcatggtctcgcagccaagtaggttatgttttctgaggaaatcatcatgtcattcccatctactgttaatttttaaaaagctgtgattcctgatgaaacaaactagagatgatgcaggaactctggatctaaatggtcagtcactatcttctgcaacttgctggagtgcagacacgtctcagaataagatattctcagactagtcagaacattgtttcctttctttaaaaaacaaaacag

SEQ ID NO: 166032 - DNA, 601 bp, Human
cctggatcatcatcagatgagcagacatgaaagccgctctcaacaggattagaaaacacagtttctaggggattcttgcagggaaacagacatggaggggcaccatttggtttgtaaaaggaaggtatagccctgaagttggcaagctcttggcctgctggcctgatgcagcaggcagctgagaattgcttggcctgtccatgggggcctgacaggtatctcaaattttaattgccagcacacacgaatcaggagatttcatatttcaaaaagcatgtatggctgctgtttcttttttgtrtaaggcttaatttgttttttttttcatgttatagctttcctgagatacattttacatactctaaaatttacccatttaaattgtacagcatgctgggttttcatgcatttatacagttgtgtgtccatcatcacagtgtaattttagaagatttaaatctccctcttccccactgcccctgccaaaaaagggaccccagacctaccagcagtcatttcccatccccctccctctggtaccagcccaccactagtctgtctgtgtctgtggttttccctgttctggatgttttgcatcaac

SEQ ID NO: 166033 - DNA, 601 bp, Human
tttttttctcctcctagcagttgtatttttattcttttatgcttttcttgtaatttttgaatggatgctttatatgcaaatgttacctggctgggtgctaggttatttatttaataaatatcctttagctttgttctgggaggcaggtaagttacgtggaaatagtttgaatcttttggatcatgctttgaagattcactagttgcaactacagtggtatttagtttcaggctaattattcccacaaccaaggcaggattgtaagaggagagatcatggccggggactcatggctagacawaaaacaggacctcagtcctatcagtgcaaggaaatgaattctgtcaatacatagtgagcttgaaagagactcgcagcctcagccctgggagtctcagttgcagctgacattttggtttcacccggagaaacccttagcagaggactgagtccacccgtgcctggactcctgacccatggggcggatgagacagtagatgtgtggtggttaaaccactgaatctgtggtaatttgtggtgatttgttatgcagcagtaagaggtaataccgtatgcatcttcttgcatcatttaccagctt

SEQ ID NO: 166034 - DNA, 601 bp, Human
agtgcaaggaaatgaattctgtcaatacatagtgagcttgaaagagactcgcagcctcagccctgggagtctcagttgcagctgacattttggtttcacccggagaaacccttagcagaggactgagtccacccgtgcctggactcctgacccatggggcggatgagacagtagatgtgtggtggttaaaccactgaatctgtggtaatttgtggtgatttgttatgcagcagtaagaggtaataccgtatgcatcttcttgcatcatttaccagctttttattatatgtggaagtcttaygtctttcctcccttttttattgccctctgagtaccttgttgtccctttctgtgtcacattcttcccactcgcacgcatgcatccaggaataagagcactgtggctcggtgtggccaagacccactgtgtaccttccatgaaagatgtttgtgagtagcatgggcccccgaaccctgggtccagtcctgcctgtactgcgagccagcactgtcatcatggatagtgccctcagcccatactctcctctgtgaagtgtgtgtgccagcacactgacatcacagggtgcctgcagcatttgga

SEQ ID NO: 166035 - DNA, 601 bp, Human
catagtgagcttgaaagagactcgcagcctcagccctgggagtctcagttgcagctgacattttggtttcacccggagaaacccttagcagaggactgagtccacccgtgcctggactcctgacccatggggcggatgagacagtagatgtgtggtggttaaaccactgaatctgtggtaatttgtggtgatttgttatgcagcagtaagaggtaataccgtatgcatcttcttgcatcatttaccagctttttattatatgtggaagtcttacgtctttcctcccttttttattgccctytgagtaccttgttgtccctttctgtgtcacattcttcccactcgcacgcatgcatccaggaataagagcactgtggctcggtgtggccaagacccactgtgtaccttccatgaaagatgtttgtgagtagcatgggcccccgaaccctgggtccagtcctgcctgtactgcgagccagcactgtcatcatggatagtgccctcagcccatactctcctctgtgaagtgtgtgtgccagcacactgacatcacagggtgcctgcagcatttggaaaacacgcagcatcatgcaaactgcct

SEQ ID NO: 166036 - DNA, 601 bp, Human
gagtagcatgggcccccgaaccctgggtccagtcctgcctgtactgcgagccagcactgtcatcatggatagtgccctcagcccatactctcctctgtgaagtgtgtgtgccagcacactgacatcacagggtgcctgcagcatttggaaaacacgcagcatcatgcaaactgcctaggagtgctcaacaatttggagctggtatctttacacttaccacgttgaatattgcatgcagactacatatttgcagagcttaatgaacagagaggcattttaggacaactaggagaaactcgcscagattcccctcagggggagggaagctgttttgtaggtgtctctggcagtagcctaatgcagttgctttagaccctggtggtctggatactgcttcactgtaggctttaattgcattgctccaggtctgtggaaggctggaagaggccggtgtttttgtgtcacttttgctaccccctactctctctagttgacaggccatttggagcaccagggagtacaatctggctgaagaagcggtatccaaggaggacgtcatggtgtctgttctcgcagtcatggagcctagtgccaacaggcc

SEQ ID NO: 166037 - DNA, 601 bp, Human
cccctggcttcttatttttctttgaactacgtcaacggaattgcttcggatccttagccattttaaaaaacacagtcatatcacgtccccttctgacattctcttaagctttagcaaataacagaaatttcagtctcactgtgccttgttcagaggtgacaacaacaatgggtggctgaggcgtaagtctcaatcatccaggctccttaaagcagctttcgggcatgtgtggggaaagtacgccacagacacccagggctgtgcttccaaagaggttttcaagaggttgagtattgacacstttccttacaaggtagtggggaggcctggaggccaggcagtgaggcgaacagtgctcagtgaatccacgctccaggtgaggggaggcaaatgtcggcagagaaggtgggagcagaggaggagttccttatgcagaggtctctgggcaggcagaggaaatgagcctcgactttgctctgccctgggaagggaagcttgtgatccacattatatcagtgtggggttttatgagctggactgagatggttgatctaaagtcacagttggcaagtccctgtttatgcgaggccggcaaagaatt

SEQ ID NO: 166038 - DNA, 601 bp, Human
tgaggcgtaagtctcaatcatccaggctccttaaagcagctttcgggcatgtgtggggaaagtacgccacagacacccagggctgtgcttccaaagaggttttcaagaggttgagtattgacacctttccttacaaggtagtggggaggcctggaggccaggcagtgaggcgaacagtgctcagtgaatccacgctccaggtgaggggaggcaaatgtcggcagagaaggtgggagcagaggaggagttccttatgcagaggtctctgggcaggcagaggaaatgagcctcgactttgctstgccctgggaagggaagcttgtgatccacattatatcagtgtggggttttatgagctggactgagatggttgatctaaagtcacagttggcaagtccctgtttatgcgaggccggcaaagaattcacctctgagtgatctgtgggggcagccctgtgttggtgcctgaggcctctgcctttctgtggaggtctggctgatgcatgaggctagaaacagccattcatttggaagagggcgttgcaatgactcagcctctgggcttaagctttccttttgcataagaagtctgaggggtcct

SEQ ID NO: 166039 - DNA, 601 bp, Human
ctggaggccaggcagtgaggcgaacagtgctcagtgaatccacgctccaggtgaggggaggcaaatgtcggcagagaaggtgggagcagaggaggagttccttatgcagaggtctctgggcaggcagaggaaatgagcctcgactttgctctgccctgggaagggaagcttgtgatccacattatatcagtgtggggttttatgagctggactgagatggttgatctaaagtcacagttggcaagtccctgtttatgcgaggccggcaaagaattcacctctgagtgatctgtgggggcarccctgtgttggtgcctgaggcctctgcctttctgtggaggtctggctgatgcatgaggctagaaacagccattcatttggaagagggcgttgcaatgactcagcctctgggcttaagctttccttttgcataagaagtctgaggggtcctcagatgttttatcttcctttacaaagttgtgttgtcaacaccaaggaaacagtcttgattctgaacaaggaggtagcctgggtactgaaggtgaaaagagctcagatcagaagtttcttggaaagagatttaaagatttttaaaaaatca

SEQ ID NO: 166040 - DNA, 601 bp, Human
ggtctgtttatacctccacttgttatagttcatgaggtacagaaaaaccttgaggccacattcaaaacatggaaggaggcagctttaggctaagcttgattcaacaggttgctctcgtcactaggaagtagtcatgtacaaatgcaaatgtgcttgaagtttcaacctagtttttagaatgtgggatcctgatgggtattcctctcatcttgctgcttcttgtcttgcgcatttatcatcccttcgaggcagtggtttcagatcttaatcctttttcctagtcacctaatattctaagatrtggctatacaaagcatttccaaccattgtccttcccccctcaaaaattatggtaataagcgtccttcccaccccacagataatactgcagtcagtgcagacatatgcttgtacatgctttcacacacgattcactgaggccggcaagtctgtgggagggagttctataactgaatgtttacacggggtgtgcatatctttctctttgaataggttgtttctatactgtttgtcatgaaaactcagaccattcccattttaccatcctttcttcaccagggagatagagtgacagagcgac

SEQ ID NO: 166041 - DNA, 601 bp, Human
gatcctgatgggtattcctctcatcttgctgcttcttgtcttgcgcatttatcatcccttcgaggcagtggtttcagatcttaatcctttttcctagtcacctaatattctaagatgtggctatacaaagcatttccaaccattgtccttcccccctcaaaaattatggtaataagcgtccttcccaccccacagataatactgcagtcagtgcagacatatgcttgtacatgctttcacacacgattcactgaggccggcaagtctgtgggagggagttctataactgaatgtttacacrgggtgtgcatatctttctctttgaataggttgtttctatactgtttgtcatgaaaactcagaccattcccattttaccatcctttcttcaccagggagatagagtgacagagcgacttaattgttgcccatctgatgcagatcaagtgtcatattaactgtgcatatccctgcaacgtttgcacactaatgtacattggtctttctagatgcctgttgttacctataggtaagtaggtaggtaggtaggtaggtaggtaggtagatgtctgctagcaatttgacgggtcatttctttttg

SEQ ID NO: 166042 - DNA, 601 bp, Human
atgtggctatacaaagcatttccaaccattgtccttcccccctcaaaaattatggtaataagcgtccttcccaccccacagataatactgcagtcagtgcagacatatgcttgtacatgctttcacacacgattcactgaggccggcaagtctgtgggagggagttctataactgaatgtttacacggggtgtgcatatctttctctttgaataggttgtttctatactgtttgtcatgaaaactcagaccattcccattttaccatcctttcttcaccagggagatagagtgacagagcracttaattgttgcccatctgatgcagatcaagtgtcatattaactgtgcatatccctgcaacgtttgcacactaatgtacattggtctttctagatgcctgttgttacctataggtaagtaggtaggtaggtaggtaggtaggtaggtagatgtctgctagcaatttgacgggtcatttctttttgaaggataatgaacaaatttgaaacctgtggcacagcctgggacctaagtctgtgtggtgcagggagtctaacttctgtctaagtcagtagtatctccagggatacagccttaca

SEQ ID NO: 166043 - DNA, 601 bp, Human
ccattgtccttcccccctcaaaaattatggtaataagcgtccttcccaccccacagataatactgcagtcagtgcagacatatgcttgtacatgctttcacacacgattcactgaggccggcaagtctgtgggagggagttctataactgaatgtttacacggggtgtgcatatctttctctttgaataggttgtttctatactgtttgtcatgaaaactcagaccattcccattttaccatcctttcttcaccagggagatagagtgacagagcgacttaattgttgcccatctgatgcrgatcaagtgtcatattaactgtgcatatccctgcaacgtttgcacactaatgtacattggtctttctagatgcctgttgttacctataggtaagtaggtaggtaggtaggtaggtaggtaggtagatgtctgctagcaatttgacgggtcatttctttttgaaggataatgaacaaatttgaaacctgtggcacagcctgggacctaagtctgtgtggtgcagggagtctaacttctgtctaagtcagtagtatctccagggatacagccttacatccactgctggctgcggcttctctg

SEQ ID NO: 166044 - DNA, 601 bp, Human
ctttcacacacgattcactgaggccggcaagtctgtgggagggagttctataactgaatgtttacacggggtgtgcatatctttctctttgaataggttgtttctatactgtttgtcatgaaaactcagaccattcccattttaccatcctttcttcaccagggagatagagtgacagagcgacttaattgttgcccatctgatgcagatcaagtgtcatattaactgtgcatatccctgcaacgtttgcacactaatgtacattggtctttctagatgcctgttgttacctataggtaagtaggtaggtaggtaggtaggtaggtaggtagatgtctgctagcaatttgacgggtcatttctttttgaaggataatgaacaaatttgaaacctgtggcacagcctgggacctaagtctgtgtggtgcagggagtctaacttctgtctaagtcagtagtatctccagggatacagccttacatccactgctggctgcggcttctctgagcgacccatctctgcgtccgcccatccatggctgccatctcgcacaaaattattttcctgggatggtcccttgagttagttcgtggttagggg

SEQ ID NO: 166045 - DNA, 601 bp, Human
cggcttctctgagcgacccatctctgcgtccgcccatccatggctgccatctcgcacaaaattattttcctgggatggtcccttgagttagttcgtggttaggggtagctctcaccttagtccctacaaacccacctgaatttcctttgtctccgagccacatgggaaggagactgtggaaaataaaccaagagattctctagtaggtagagctagaggcaacaggttaaaatcacatctttataggagaatgtttggggaatgcattcagcagtcacccattctcattaatagacccagmaaacaattaaaaaatacacattgtgatttggactgggcagacatgccgactgtggagccatttcttaagagagggaggttggcaggtagctggtgagcctatttctttgctcattgagctagcaagagcaacacccattactttcattggattacttgtttgaaaattaaattaatcaagtgaggtaaacatccgtattgcctcttagcacccccataggctgcccgcaaaatggcctgcgtgggtatcctaagagcaggaattggctatgacctgccgaggtggccaactcagatgtgg

SEQ ID NO: 166046 - DNA, 601 bp, Human
catttggcactaaacaaggatttgttgtgggatttgtgagggctgcgcagtgcctctgtgctaagcacccaaaactctaggggactggcactaatttcctctctctcgtaaaacaacgtagtattcataacaactcaagaggcttgacataagtaatgatggcatgtgcaggcgaagattaccacccaacagtgtaatcaaggtgctaggtactaatgcaagttaaattgagacaataatgccgaaacttgcattgtgggattaggagggcacttgaaatgctgacgtgagcacatcctgyctgcctgcctgtctggcgctccgttcctgtttatacttaatgacctcaaaatttgtatgtcgttaacaccgtgtactgaagtgggagagaacacggtttgggagggagaagactccctgtcttcgttgacttttgtctcttttggtaattggtggcttttcctgccgtattagggagcaaagcgtgcagcggggaggcccctgaggtctctgtaaacatgctgtgggcaccgagggcctccgcacccggcgctaggcagtaatttacatactttgaatgaaaagtcatttgtgcctgcaa

SEQ ID NO: 166047 - DNA, 601 bp, Human
taataaaggaatattgagtcactttgactgtattaagctgtgaaatgattcctcatctcaatttaactttctgtcttgagcataatgtttgataagcaatgaatttttgtaggaataatctataacagtatttgactgcaatatttaataacaactagacttgtgactttatgttgtttttaaatgggctgggaaagcccgttttttctctgcaaatttataggacaacttagagggttcttgccctatggtagcttcacaagagttctgagttggcaccctccggtttgggaggtaggtrgagatggctttgacttttgttcaacttacaagggagtaacttcttggaagtgcagtccgggccagcagaaatggtcatagtaggccatggtggaaggagaatcagaaccacgcgtaaatcctcagaaggaagagggcagtcatttttttttttttctcttggaggaatatcccgggaagaattacctggaagaaatcagagtggttttggaagatggattgtcggataacattttaacttaagggctgaagttcctttctacctaagtaccattgaagaagtatgttcctgatcttaaac

SEQ ID NO: 166048 - DNA, 601 bp, Human
gtgtttcacatgcgaggttgcaaaatcatgactccctcaacctgtcgggctcaaatgagaaggttttcagctgggaaaatggaatatatcagtgcatgtaatattgcctgacctcataaaacaaaagggaaaattgcagattctgacagccattatgaatcttgtatcagcatccaaaacgacttggagccagggtatagtacatgtttataatagaaaaaaaacggggttgccacgttgacttgcaatatggagcaaaaaatgacttgtcataattcgttctcagatgttaaagaggctrttgaatttactagtatatacacagaagaatgcgtagcccggagcagagtgtggaaatagtccctacacagaggggtctgctgaagttagtcatcgagttagattagaatggaaggcaggaggggaggaactccgggtttgcgccgcagctgcgtcggtggggccagatttctcattacaagatgtactgaacctttccactttcacccactgtaaatctataagtaatcaggcttctaaaataaagcaaacaaccttgttttgagattatgagaatcatttgaattgaatgtattctgtt

SEQ ID NO: 166049 - DNA, 601 bp, Human
cagcgcgtgctccccagctgaggccccgtccgccttggccactccctttcatctcccgggctgaatgcggagtgtggtgacttttattttttcctttgctattggtttagaatgagatgtagcagttgatttaagtgaagtaaagcatgcttacgcagtacactgtgtccctgtcggggcctgctctctcatgtcacctgccggcggtggcatggagacaaagccttctctcctctcttactgctgctgggcctctcctgggcaggtccgggctcagtggcttgaacaggtgatgcagggmggggcagtgcctgtggccacagtgatggcacaggtggacatgatcctgagagtccagtgggggctgtagcacaggaaaggaggttgtctacagcctttctcaccacacctttccctcctcagtggaatctctggccccatctggagtccctggaggctggatggtagaactggaatcgttggcccgatctggagcccctggaggctgggtggtagaagtggagtctctggccccatccggatgatggaggtggaatctctggccccatccggatgatagaggtggaatctctggccccat

SEQ ID NO: 166050 - DNA, 601 bp, Human
ctctggtgctgggagatgatgaaatgagcacctggtacattaggtttgggacttaaagctgatacttccattcgggagcaggatgagtaagacctggtgcttctttgctcagagctctctgaggtgggaggctggaagcgcttccctgaacactgtaggaagtgttgcaggagagcggaagagcaggaggaggaatggtgcagaggaggaggagcagtgcggagatttcacctggggggacaccaccacgggaggcaggcggcaatggtggaggcgttggctgagcagggcctttagaaamaggcccgggagcttggcagcagaaaggagggtggaagtgcagaagcatcgagatgcccagtgacgtctgtgcagtttggattttgctgttgaaaagcaaaggagatgaatagaaagctttaggcagacactgagagtttttgctttggaggtattttgatatatggtaaactattgtttggattattttggagtatgctttggtctattattaaatatcccagtcaaagatagcagatattcaatatttgagttaggatttttcaaatacttagaatatttgaaaatatttttatcatta

SEQ ID NO: 166051 - DNA, 601 bp, Human
atcaatcaaatacattaagaaatacattggtttggtccagaaaggcgggacaccttgaagtccaggggacttccagcttataggtagatttaaaaatctcctggttgataattggttgagtttctctaaagacctgagatcaatagaaaggaatgtctgggttaagataaaggattgtggagatgcaagttcttatttgtggaggaagccttcaggtagcaggcttcagagagaataacttgtaaaatgtttcttatcagacttcaagtctgtgtggatgttagtgccggagaggtatagygaagcatatccaacccccacttcccgtcatgcctgaaacagtctctcaggttacattttgaaagagccctggctgcggaggaagtccatttgatggttggggttagaattttatatttggtttacaaagtcttgaattaaaatattttatcattacctagttttatacccgggaatgttagttgttgcacgtgaggacatgaagtgagttaatgcagggcttgggccgtccagtgtcttctttccccacagccttgctggcagtgaccccatataaataggaacaattaccggaagaaac

SEQ ID NO: 166052 - DNA, 601 bp, Human
ggattgtggagatgcaagttcttatttgtggaggaagccttcaggtagcaggcttcagagagaataacttgtaaaatgtttcttatcagacttcaagtctgtgtggatgttagtgccggagaggtatagcgaagcatatccaacccccacttcccgtcatgcctgaaacagtctctcaggttacattttgaaagagccctggctgcggaggaagtccatttgatggttggggttagaattttatatttggtttacaaagtcttgaattaaaatattttatcattacctagttttatacccrggaatgttagttgttgcacgtgaggacatgaagtgagttaatgcagggcttgggccgtccagtgtcttctttccccacagccttgctggcagtgaccccatataaataggaacaattaccggaagaaactgtgctcctcctaaagcctagctagtgacttccacctttgaaccataggcgaggcagcacttaaccagggcactgtttgataggatgttacaggtggttccagagaaaaacgaaacatgtcatcttgttaagggaggtcttcgtttcggcatctctgtaaaatatttaaag

SEQ ID NO: 166053 - DNA, 601 bp, Human
tgaaccataggcgaggcagcacttaaccagggcactgtttgataggatgttacaggtggttccagagaaaaacgaaacatgtcatcttgttaagggaggtcttcgtttcggcatctctgtaaaatatttaaagaggtatttttatttctttaaacaggctctgcctcttccgtccccctcgcccaatgtggactctgcccgtccttcctgagcagtgagactctgtccccatgtgcttctggtcacagctgcggtgacatcctgtaacattgtttggtccttgcttaaatcagttactcascatgttatagccgagttcagacccactacacagacctcctaaggtgctggcctgtctaaaacattatttccattattcattcctgttcactctgggatagggaagccatgctccaagctgtattggaatatcaggtccagggtaattagccagggcctaaagggtctgttttggaaaattcaagtacaagtagaatcttctttagtatcttggatccaccagggaagagatggtctctgaggcctgctatgcagaataaaaccaagagagtcactgtgaaggaatccaagagatgcaagt

SEQ ID NO: 166054 - DNA, 601 bp, Human
ctaaggtgctggcctgtctaaaacattatttccattattcattcctgttcactctgggatagggaagccatgctccaagctgtattggaatatcaggtccagggtaattagccagggcctaaagggtctgttttggaaaattcaagtacaagtagaatcttctttagtatcttggatccaccagggaagagatggtctctgaggcctgctatgcagaataaaaccaagagagtcactgtgaaggaatccaagagatgcaagtgctctttgctgtccagtgattaaaatgaaagcaaagacrggaagcgtccttgatccacattttgcctgtgatttgaatatcacatgcttggtccgggcacttaggtgggcttcagtgatttgggccggaaggaaatggtgcccctttcctcgagtttctagattgttttgtcacagacaggggaagccctcatctgacttgccctgtaggaccctagtctgtcgggaggtctctgtccccacccctccctggagtctggggtgtagttgggctgaccctcaaaatatgctgtgtcatcaaaggttcatcatctatctggtctgttttttaacgcaactt

SEQ ID NO: 166055 - DNA, 601 bp, Human
ttattcattcctgttcactctgggatagggaagccatgctccaagctgtattggaatatcaggtccagggtaattagccagggcctaaagggtctgttttggaaaattcaagtacaagtagaatcttctttagtatcttggatccaccagggaagagatggtctctgaggcctgctatgcagaataaaaccaagagagtcactgtgaaggaatccaagagatgcaagtgctctttgctgtccagtgattaaaatgaaagcaaagacgggaagcgtccttgatccacattttgcctgtgatytgaatatcacatgcttggtccgggcacttaggtgggcttcagtgatttgggccggaaggaaatggtgcccctttcctcgagtttctagattgttttgtcacagacaggggaagccctcatctgacttgccctgtaggaccctagtctgtcgggaggtctctgtccccacccctccctggagtctggggtgtagttgggctgaccctcaaaatatgctgtgtcatcaaaggttcatcatctatctggtctgttttttaacgcaacttgataaaataccagtgttttaataaaaaggtctaa

SEQ ID NO: 166056 - DNA, 601 bp, Human
atgcaagtgctctttgctgtccagtgattaaaatgaaagcaaagacgggaagcgtccttgatccacattttgcctgtgatttgaatatcacatgcttggtccgggcacttaggtgggcttcagtgatttgggccggaaggaaatggtgcccctttcctcgagtttctagattgttttgtcacagacaggggaagccctcatctgacttgccctgtaggaccctagtctgtcgggaggtctctgtccccacccctccctggagtctggggtgtagttgggctgaccctcaaaatatgctgtktcatcaaaggttcatcatctatctggtctgttttttaacgcaacttgataaaataccagtgttttaataaaaaggtctaaaacatttaccatttaaatgagcctcccttcctgggatgcacacaggagtcttggcgggaggctggtggcgcaggctgatgggtcctgtccctctgtgccttgggcgcctctgcccagcgtcacgcagtgtcatgagacccctcagtgcaagcgcaggtctgcctgaggtcccccctcccacctgcaacctggatgccttttgtgcctatggaacacaact

SEQ ID NO: 166057 - DNA, 601 bp, Human
ctcagcagctgtcagtgcattcacaccgtcgtgcagccatcaccaccacccatcctcagagcccctcatcttcccacagggaaactccatccccattgagcacagactcccccttccccagccctggcacccacccttctactgtctctatgagtctgactacatcacataagtggtacagccattgtcttttgtgactggcttatttcatggagtatcatgtcctcaaggtccatccgtgttgtagcacgtgtcaaaaggtccttccttcctcaggctggatatgggctctttaaaagcstattttcttagagcaaaacccgtttcccccacacctgatcgtcacatgccgtctaagacacgtggtctagggtttgctagtgatcgtctgtgggctttccgagcctgcgctggttttgctgccacaacctgaggtccgcggacgtccctgtgctcgctatgacttctttgtgtgagactgtcagagtgtgttcctggccctgacacgtgctcggcggctggtttttctccttcagatcagcggccttggacagctttcgcttctttggcagccgtttcaagctgctccgtcttgtcattt

SEQ ID NO: 166058 - DNA, 601 bp, Human
acagactcccccttccccagccctggcacccacccttctactgtctctatgagtctgactacatcacataagtggtacagccattgtcttttgtgactggcttatttcatggagtatcatgtcctcaaggtccatccgtgttgtagcacgtgtcaaaaggtccttccttcctcaggctggatatgggctctttaaaagcctattttcttagagcaaaacccgtttcccccacacctgatcgtcacatgccgtctaagacacgtggtctagggtttgctagtgatcgtctgtgggctttccsagcctgcgctggttttgctgccacaacctgaggtccgcggacgtccctgtgctcgctatgacttctttgtgtgagactgtcagagtgtgttcctggccctgacacgtgctcggcggctggtttttctccttcagatcagcggccttggacagctttcgcttctttggcagccgtttcaagctgctccgtcttgtcattttagagttcaatatctgctgctctgaaggaagaaacggggatgggctggaccattgcacttggtctcttgacctcgatgttgcccatgagcagtgaaggatg

SEQ ID NO: 166059 - DNA, 601 bp, Human
ttgtgactggcttatttcatggagtatcatgtcctcaaggtccatccgtgttgtagcacgtgtcaaaaggtccttccttcctcaggctggatatgggctctttaaaagcctattttcttagagcaaaacccgtttcccccacacctgatcgtcacatgccgtctaagacacgtggtctagggtttgctagtgatcgtctgtgggctttccgagcctgcgctggttttgctgccacaacctgaggtccgcggacgtccctgtgctcgctatgacttctttgtgtgagactgtcagagtgtgytcctggccctgacacgtgctcggcggctggtttttctccttcagatcagcggccttggacagctttcgcttctttggcagccgtttcaagctgctccgtcttgtcattttagagttcaatatctgctgctctgaaggaagaaacggggatgggctggaccattgcacttggtctcttgacctcgatgttgcccatgagcagtgaaggatgacttttgacgagccatgtcagatgtgacaggcaatctagttggcttgagtggaaatgtgctgtacaagtttgaagccttggttgggggca

SEQ ID NO: 166060 - DNA, 601 bp, Human
gccctgacacgtgctcggcggctggtttttctccttcagatcagcggccttggacagctttcgcttctttggcagccgtttcaagctgctccgtcttgtcattttagagttcaatatctgctgctctgaaggaagaaacggggatgggctggaccattgcacttggtctcttgacctcgatgttgcccatgagcagtgaaggatgacttttgacgagccatgtcagatgtgacaggcaatctagttggcttgagtggaaatgtgctgtacaagtttgaagccttggttgggggcatttttstggtgttcaatgcatttaaattgacaccagacttcagtatgttgttcatttcaggcccagcactgtaggctcccatctttaaaatgtgtgggtgccgagcgctccctcgtcagcttttgcaaagcattttgcatattcccagtactgtatttacattcctggctcacattggtttttgttttttgtttttcctatcttaaagcttatttttgaagtgaatttttaatgctttcagttgagtagggatttgtggaattttgaggggtggggaggtgcagtggagaaaagggggaaaatggt

SEQ ID NO: 166061 - DNA, 601 bp, Human
gccctgtcctcctccatgctctcctctaagggccctcactggcacctttgccctccttaaccaggtaacactaaaccaggagacatctagaatcctgtttgagacatcttcgagagtcaccttgttaactagacagaagtggatctctacaggttagagcctggggaacctctgttttctttgtgatattctctagtgagtgttccaggaaagaacatgccccactgtctcctttctacttgcagatagcggtgaggtgggagaggggcctgggagtgtgctcttcattctccacctcctcccccgaggaggtggtcatggtcactcgcttgacgagcccagactctgagcttctgcccctttattgagcaaattcataaagtcaaccatgctcttttattatgtaacttgttttttagattcaggggtacatgtgcatgtttgttgtataggtaacttgcctatcacaggggttttgtgtgtggattatttcttcatccacatgataagcacatgataagcatagtacccaataggtaggtcttcaatcctcaccctcctcccaccctcaagtaggcaccgttgtctgctgttcccttct

SEQ ID NO: 166062 - DNA, 601 bp, Human
ttagtccatgtctttactattatgaatagtgctgcagtgaatatacgcgtgcatgtatctttatggtagaaccgtttatattcctttgggtgtgtgcccaataataggattgtggattgaacagtaattgtgttttaagttctttgagaagtcaccaaactgctttccacagtggctgaactaatttacattcccaccaagagcgtataagcattccgttttctctacagcctcaccggcatctgttattttttgactttttaataaaaaccattctgactagtgtgagatggtgtctcaytgtggttttgatttgcatttctctaatgattagtgatgttgagcatttttttcatatgcttgttggccatatgtatgtcttcttttgaaaagtgtttgttcatgtcctttgcccactttttttttacagagttgattgttttttgcttgttaatttgtttaagttctttatggtttctgggtattagacctttgggggatgcatagtctgcaaagtgtgcttcttatgcaagcacccagccttccggcactgggacgggccacatgggaggagccaaaggatgggagagtttaccccctc

SEQ ID NO: 166063 - DNA, 601 bp, Human
atgcccaatttgcaccagagatagagccaggccccttgggatggaaaaggaaaagaaactagatttactttttaaagtttctagaacttctttggtatccctagaaaactttttttaaaaaggattttctttttaagttggatttctatccattatttacctgagacataatttcagctgatcaaagtttagagtgctggcaagtgccaagccttacgatagatgttgtaccttttgacaaatgaccatgtatgcacagctctgtttctggactctgttctatccatttttctgcttgtcytcatgccaacatggccccgacttcattgctgtggctctgtagtaagtcttggtgtcttgtagaagttctccaaatttcgttgttttttccacaattgttttggctcttcttagtcctttgcatttccatgtagaataagtggattaattagtatagaaaaacctgtgattttcattcaactgcattcaatctatagatctatttgcagagatatttcacagttttgagtcttgatctttgattgtggcgtatagctccatatttgttttctttgatacatctcaacatggttttgtaatt

SEQ ID NO: 166064 - DNA, 601 bp, Human
ttctttgctaatgatgagaattacaggagctttctgtaaatttgtctagtatgctgtgagtttgctgaacaaatttattctagttctagttgcccaaggattctttagtatcttccatgtacgtgaatatcttgtttgagaatgaagacagttttgtttcttcctttatactatgtatgctgttagtttctttttcttactttattgtactggctagggtctccatactgcattcaacaggagttggggaagtaaacatcctctgttcctaatcttaggggtgaagcactcagtattttamtgttaaatataaatacacattcttgtaaattcccattgaagttctattcttgtaggctgagagttttattacagaagggtgtgtcattttgtcaggtgcctttttgcatctgttgtaatgtttatgtggtttctgtcttttattctgatcatatggagaaatgcagtaattgattttctaatgctcaacaaaccttgcttgtctttgataagtgccacttgctttgagaaacgcatgcatacatctctctgtatatatatgtgtataattccagcattatttctatatacatagaaataa

SEQ ID NO: 166065 - DNA, 601 bp, Human
tttattctagttctagttgcccaaggattctttagtatcttccatgtacgtgaatatcttgtttgagaatgaagacagttttgtttcttcctttatactatgtatgctgttagtttctttttcttactttattgtactggctagggtctccatactgcattcaacaggagttggggaagtaaacatcctctgttcctaatcttaggggtgaagcactcagtattttaatgttaaatataaatacacattcttgtaaattcccattgaagttctattcttgtaggctgagagttttattacrgaagggtgtgtcattttgtcaggtgcctttttgcatctgttgtaatgtttatgtggtttctgtcttttattctgatcatatggagaaatgcagtaattgattttctaatgctcaacaaaccttgcttgtctttgataagtgccacttgctttgagaaacgcatgcatacatctctctgtatatatatgtgtataattccagcattatttctatatacatagaaataataaatatacaaataatgctggttatatttgctaatattttacgaattacgggatactggtctgcagttttcac

SEQ ID NO: 166066 - DNA, 601 bp, Human
ttcaacaggagttggggaagtaaacatcctctgttcctaatcttaggggtgaagcactcagtattttaatgttaaatataaatacacattcttgtaaattcccattgaagttctattcttgtaggctgagagttttattacagaagggtgtgtcattttgtcaggtgcctttttgcatctgttgtaatgtttatgtggtttctgtcttttattctgatcatatggagaaatgcagtaattgattttctaatgctcaacaaaccttgcttgtctttgataagtgccacttgctttgagaaaygcatgcatacatctctctgtatatatatgtgtataattccagcattatttctatatacatagaaataataaatatacaaataatgctggttatatttgctaatattttacgaattacgggatactggtctgcagttttcacattttgtcttttttaggctttattatcggggtaatgctggcttcataaaatgaactgatgtattctctcttgtactgctttttaaaattgtttaggattggtattttttttatttaagtgtttaaaaacatctgggcctggaattttctttgtgggaag

SEQ ID NO: 166067 - DNA, 601 bp, Human
tgcaactcgaattatggatttgtctcttttcccctttggttctgtcaactcttgccttgtgccttctgtacatttgctagtaggtgcctaatcacatgagatcatgacgtcctcctgatgtgctggctccttaacagtatgaaatgtactctttatctccagccatttttcttactctgaagttactttgatattaatattgctagctttcttgtgatttgcctatgcatgtgttatactcttttccatccttttgcttttgatctatttctttatatttatagtgtgtttcttggaaccrggatatagtgatccagtatgcaagtctgtactttttatttgaaatgttttagttaatgtactcatcaataggtatgggtttagtctgccgttttgctgattttttcatttgtactttttattcttcattcctgttttcctaattccctgccttcttttggattgaatccttttttgatttcattttataattactattgcgttattagtgctacctttttttaagtagtttgtttagtacagtactttttgttagaaattccagaaatgatggaatgcgctgtatccacactgtccagta

SEQ ID NO: 166068 - DNA, 601 bp, Human
gccattgatcttacttctacatgttatagactctcaaatacatggttgtgactttttcctttaaacagtcatttgtcgagaaataatcatttagaattgaaattgaaagtgagaaagtactcttttcacgtacgcattttgatgttctaaatatgttgaaagggcgcaggggggtttaatgcccttcatcagatctatgctaccttgtggacagtaattggaaaggatggggaacagggacgcacgagtgggtagatgaatgcgaggctgttgaaatggttccatggtgagcagtgcatgrttgcttggaacaggaaggagcggaggtgttaagaagtggttgaatttgggatctctttggaagtatgatgctccagctgttatcagcagagctgtaagtgaaatgtactttgattgtttgttgaacatccttgccgcctttcctatcgaatttgcttttcaaaaatagtgtggacattaaaaagccatccccatgtgcctaatttcaattagaaaatgttgaatcactgtgaatttggtgagtcatcctgcatgtaagtagagctatccatctaactcttagaatttgttaactattaag

SEQ ID NO: 166069 - DNA, 601 bp, Human
agtgaaatgtactttgattgtttgttgaacatccttgccgcctttcctatcgaatttgcttttcaaaaatagtgtggacattaaaaagccatccccatgtgcctaatttcaattagaaaatgttgaatcactgtgaatttggtgagtcatcctgcatgtaagtagagctatccatctaactcttagaatttgttaactattaagagaggaagacagaaggtaatatagagatgactatttatgagtcattttatttattcattatccatctaaagagtagcaattgattgtatcacagaayggtgtttgttttacatcttttgattaggagcagtggtttatggcatagacttgcttaatttcctcctgtttcttcctctggagtggataactgtttcacaacagaaggcgataaaagatttctggtttattcattaattttgctttgagacggaatacctgatctcaaggataagatgctgattggtatgacctgaatcgaatgattagcagtatgttgcccttactctgatctccccacagtgtgagagattttcttaccttcgcatcagtttttagccatgttttggtgtttaagcag

SEQ ID NO: 166070 - DNA, 601 bp, Human
tcattatccatctaaagagtagcaattgattgtatcacagaatggtgtttgttttacatcttttgattaggagcagtggtttatggcatagacttgcttaatttcctcctgtttcttcctctggagtggataactgtttcacaacagaaggcgataaaagatttctggtttattcattaattttgctttgagacggaatacctgatctcaaggataagatgctgattggtatgacctgaatcgaatgattagcagtatgttgcccttactctgatctccccacagtgtgagagattttctyaccttcgcatcagtttttagccatgttttggtgtttaagcagagatacggttccactttgaaagctctggaagtaattctcagatcacatatattcatctcaaatttgaaatctggagtgtttgtcttgaaattaaattgtggtattgtaagctgtcagtggaatgatctgtgctggaacctgatgcggtctagtttacacggtattgaatcatgtaagtatctcatctttcctctttgaattcagtatgacttcacataggtgaggttagcttttaagtgtacacagaggtatggttaa

SEQ ID NO: 166071 - DNA, 601 bp, Human
attatccatctaaagagtagcaattgattgtatcacagaatggtgtttgttttacatcttttgattaggagcagtggtttatggcatagacttgcttaatttcctcctgtttcttcctctggagtggataactgtttcacaacagaaggcgataaaagatttctggtttattcattaattttgctttgagacggaatacctgatctcaaggataagatgctgattggtatgacctgaatcgaatgattagcagtatgttgcccttactctgatctccccacagtgtgagagattttcttaycttcgcatcagtttttagccatgttttggtgtttaagcagagatacggttccactttgaaagctctggaagtaattctcagatcacatatattcatctcaaatttgaaatctggagtgtttgtcttgaaattaaattgtggtattgtaagctgtcagtggaatgatctgtgctggaacctgatgcggtctagtttacacggtattgaatcatgtaagtatctcatctttcctctttgaattcagtatgacttcacataggtgaggttagcttttaagtgtacacagaggtatggttaact

SEQ ID NO: 166072 - DNA, 601 bp, Human
gttttacatcttttgattaggagcagtggtttatggcatagacttgcttaatttcctcctgtttcttcctctggagtggataactgtttcacaacagaaggcgataaaagatttctggtttattcattaattttgctttgagacggaatacctgatctcaaggataagatgctgattggtatgacctgaatcgaatgattagcagtatgttgcccttactctgatctccccacagtgtgagagattttcttaccttcgcatcagtttttagccatgttttggtgtttaagcagagatacgrttccactttgaaagctctggaagtaattctcagatcacatatattcatctcaaatttgaaatctggagtgtttgtcttgaaattaaattgtggtattgtaagctgtcagtggaatgatctgtgctggaacctgatgcggtctagtttacacggtattgaatcatgtaagtatctcatctttcctctttgaattcagtatgacttcacataggtgaggttagcttttaagtgtacacagaggtatggttaactatcagcagacttcagttatcaattgctgatctcagaaagctaatttat

SEQ ID NO: 166073 - DNA, 601 bp, Human
tctggtttattcattaattttgctttgagacggaatacctgatctcaaggataagatgctgattggtatgacctgaatcgaatgattagcagtatgttgcccttactctgatctccccacagtgtgagagattttcttaccttcgcatcagtttttagccatgttttggtgtttaagcagagatacggttccactttgaaagctctggaagtaattctcagatcacatatattcatctcaaatttgaaatctggagtgtttgtcttgaaattaaattgtggtattgtaagctgtcagtggmatgatctgtgctggaacctgatgcggtctagtttacacggtattgaatcatgtaagtatctcatctttcctctttgaattcagtatgacttcacataggtgaggttagcttttaagtgtacacagaggtatggttaactatcagcagacttcagttatcaattgctgatctcagaaagctaatttatctttagtgtccaataacattacatggctttctttctttgttttatgttttgtgtatatgtgcttaactgtttaaataagttctggattgcatccaaataaggtttgatatgct

SEQ ID NO: 166074 - DNA, 601 bp, Human
ctcaaggataagatgctgattggtatgacctgaatcgaatgattagcagtatgttgcccttactctgatctccccacagtgtgagagattttcttaccttcgcatcagtttttagccatgttttggtgtttaagcagagatacggttccactttgaaagctctggaagtaattctcagatcacatatattcatctcaaatttgaaatctggagtgtttgtcttgaaattaaattgtggtattgtaagctgtcagtggaatgatctgtgctggaacctgatgcggtctagtttacacggtaytgaatcatgtaagtatctcatctttcctctttgaattcagtatgacttcacataggtgaggttagcttttaagtgtacacagaggtatggttaactatcagcagacttcagttatcaattgctgatctcagaaagctaatttatctttagtgtccaataacattacatggctttctttctttgttttatgttttgtgtatatgtgcttaactgtttaaataagttctggattgcatccaaataaggtttgatatgctctcattaagaatatgatattgtgaataaatgtaatcctgactt

SEQ ID NO: 166075 - DNA, 601 bp, Human
aatcctgactttcaataaatggcctgtaaaaaaaaaaagaaagtatttagagttagtgagttgaggggcttcgtcacatggctaaaggagatttgagtagcccctggaatgttgagtgactctgacttgtggaatgcatggagccccgtttcgttggctggcaggatctacgtgggccgagcatacagccctagatgaatgacttatgtctctgaattctgttcctaatctctgctgctcaatctgtggccacctgcagaggagccagccggatggcatcgtccttaccgagctctctggktgtcagatccttcactactccttagtggctgattactctgcgtagtgtagggtgctgtagggtgcataactgattagtgccttgcagatataagcaaagtttacaatgaagcccttgcgcttaggagcatacagtctagttatgaagagaagacacaaaacacccagtcacatcactgtgaacagacaagtttgccaggagtctgttcagacctggtgctccctgagccgcgctgagcagcagttcagcggggataccaagttggggaagatgccaagtggtaggaaggaggctggggct

SEQ ID NO: 166076 - DNA, 601 bp, Human
ccacctgcagaggagccagccggatggcatcgtccttaccgagctctctggttgtcagatccttcactactccttagtggctgattactctgcgtagtgtagggtgctgtagggtgcataactgattagtgccttgcagatataagcaaagtttacaatgaagcccttgcgcttaggagcatacagtctagttatgaagagaagacacaaaacacccagtcacatcactgtgaacagacaagtttgccaggagtctgttcagacctggtgctccctgagccgcgctgagcagcagttcagyggggataccaagttggggaagatgccaagtggtaggaaggaggctggggctctggtctgcacatgccagctgatggagtttggagttggggggatatggccagttcccaatgcactggaccagccaccatccagaattaggaagtagatcagcccgtgcctggcatgcattgctttcttttcagtttctaacatatatataacctttttaagtatatatatatgtatgtatatatataactttagttatagagtctcgctgttttgcccaggatggagtacagtggtgcaatcatagctt

SEQ ID NO: 166077 - DNA, 601 bp, Human
ataactttagttatagagtctcgctgttttgcccaggatggagtacagtggtgcaatcatagcttgctgtagcctcaagtgatccctcccacctcagcctcccaagtagctgggactacatacgtgcaccaccacgcctggctaatttttttgaaaggacaagtcttgctatgttgcccagactagtcaccaactcctggtctcaagcagtcttcctgccttggcctccaaaggagttaggattacaggcataagccactgtgcccagcctaatctatataacctttcaaacaggtatctscatttgtatactaggggagaatgtagaccccacaccctcttcctcaagaaacaacttgaacgcatgccattctgccatctcagccaaggcgattgcctgtgcccttcccaagggcttggagacaccctctccctgctagccccgtgcaggggtcttcccatgtgtaccctgcagcaccgtccacctgtctgagttcgatggggcctccaggccccctgccttggtgaggcaacacgctcagcgcctgcgcgaatcttcttgcccatcagttccttttccttttatccaggatttcacaca

SEQ ID NO: 166078 - DNA, 601 bp, Human
ggggcccactgaagaaaagcagatagcaggcactgaagttcctgcagcctgttggaccccgggccgtgtgtctttggaggacagagacattggcctacagtaaaataaagtcagatgagaaagggtggggaggctttcctgctgtaaagggattatgtattcatactcgaaatagggatacattaggggaatagattgtaatctctacatccccaatccatgaaaacaaaacagaaatggagggccaagaaacctacacagggaagacacgaaatagcaaacatacctgatttatccaagrgaaggcagaggagggaaacgaaaggatgaataacaggtgaggcaagcaggacataactcgtaggatggtcagcatgcccagcgcggcggcgaggacttcggaagtcagtggacccagtggagactcagatgaaaatcagagatggtctcactgtgggaacatggtgtgcaaccatagactaaggcggcacaccttaaacatagcctaagagatgcaccgtgcagggcaggcacccacatgaagcggctatgtaaacgtgacaaagtagatattaagaaaagtaggaaggaacagtaaaaa

SEQ ID NO: 166079 - DNA, 601 bp, Human
atgtctctcatgaacccaaattttaaaatcctaataaaatattagaatgtcaattttacaatatagaaaaatatgtatatttccagtggggtttattccattcaaaaatcaatcggtgtaattctccacattcacagaggaaaagaaaagaactttatgatgataatgatcatagtaaccaaaaaaagcatttgacaaatttcaacatccattcacgatgaaaatgcactgcaaagtaagaatataaaggaaattctcttacatgacagcgtgtatacgagtgtgcacacgtgtgtgtgcttgtgcatgcatgtatgtgtgtgtacacgtgtgcacctgtggttttctctccatgtttcttccagtactgatcagggttgcttgttttcaggagttttcaagtgctctaccttcaagttttccccagctaaatctttcccatttctttctctaaatccctttttgatatttgcagttattttcaacttaccaccaatattttagtcttgattagaatcttcccagaaaagacaagttttccttctgattcccacatgtcccttcagctcgtgatggcgcagaatatgtttgcttgccagtt

SEQ ID NO: 166080 - DNA, 601 bp, Human
tcctaataaaatattagaatgtcaattttacaatatagaaaaatatgtatatttccagtggggtttattccattcaaaaatcaatcggtgtaattctccacattcacagaggaaaagaaaagaactttatgatgataatgatcatagtaaccaaaaaaagcatttgacaaatttcaacatccattcacgatgaaaatgcactgcaaagtaagaatataaaggaaattctcttacatgacagcgtgtatacgagtgtgcacacgtgtgtgtgcgtgtgcatgcatgtatgtgtgtgtacacrtgtgcacctgtggttttctctccatgtttcttccagtactgatcagggttgcttgttttcaggagttttcaagtgctctaccttcaagttttccccagctaaatctttcccatttctttctctaaatccctttttgatatttgcagttattttcaacttaccaccaatattttagtcttgattagaatcttcccagaaaagacaagttttccttctgattcccacatgtcccttcagctcgtgatggcgcagaatatgtttgcttgccagttaggggaacctgaggctgccttcctgggc

SEQ ID NO: 166081 - DNA, 601 bp, Human
tctgattcccacatgtcccttcagctcgtgatggcgcagaatatgtttgcttgccagttaggggaacctgaggctgccttcctgggcagagtggcgatttgtactgggccgacagggcagccactgttacttatggacaggtggactaggctctttttcatcctgaggaactgctccgcgcttgggaagagccactggagtttatcagcctgcgtgtaagcatgtgggaagggggatcaggaacatttagtagaatagtccgtgctccaggtgatcagtccccacccacccgcatgcctcwccttctccatcccacccgcattttgggtcattgggggattaatttattcgtgtctcgtaagcactggcagaacaccacccgtgtgaacagcattggtgaagcctggggagttctttttgagacttccttgagcttccggcagcacgtgtgagtttcgggggtgattggaatgtttctccctggagggaggcctgatgccctggagctggctccagcccgagccccgcggcgtgttctgcctgctgccgcctacctgcagggagacgcctgagctgggaaggttctgagggttggcagggt

SEQ ID NO: 166082 - DNA, 601 bp, Human
ggccgacagggcagccactgttacttatggacaggtggactaggctctttttcatcctgaggaactgctccgcgcttgggaagagccactggagtttatcagcctgcgtgtaagcatgtgggaagggggatcaggaacatttagtagaatagtccgtgctccaggtgatcagtccccacccacccgcatgcctcaccttctccatcccacccgcattttgggtcattgggggattaatttattcgtgtctcgtaagcactggcagaacaccacccgtgtgaacagcattggtgaagcctgkggagttctttttgagacttccttgagcttccggcagcacgtgtgagtttcgggggtgattggaatgtttctccctggagggaggcctgatgccctggagctggctccagcccgagccccgcggcgtgttctgcctgctgccgcctacctgcagggagacgcctgagctgggaaggttctgagggttggcagggtgctctgctgtgctctttgggaggatccccttggctgttctgcatgcccagggccgtgctctccgtggaaatctatgttggagacgacaggctccggttccagctac

SEQ ID NO: 166083 - DNA, 601 bp, Human
gcctggggagttctttttgagacttccttgagcttccggcagcacgtgtgagtttcgggggtgattggaatgtttctccctggagggaggcctgatgccctggagctggctccagcccgagccccgcggcgtgttctgcctgctgccgcctacctgcagggagacgcctgagctgggaaggttctgagggttggcagggtgctctgctgtgctctttgggaggatccccttggctgttctgcatgcccagggccgtgctctccgtggaaatctatgttggagacgacaggctccggttccrgctacaccagcctgacttccactggacagtgccattttctgcctctgataacaccgtggtgaagcgccttacgtaaagcaacagattttttgttttaagatgcactataattactcttttcagaaccaataatattaacccagtgaagtcaaaactgaattgttttataaactgactatggagctggtgtaaggagatgcagggaaggcttctcatctgagtcggtagcagagtacatagtgcaagaagcgtgggcaggctcccagcgcacccagagatcaaggagagtgatgggtgctg

SEQ ID NO: 166084 - DNA, 601 bp, Human
acttccttgagcttccggcagcacgtgtgagtttcgggggtgattggaatgtttctccctggagggaggcctgatgccctggagctggctccagcccgagccccgcggcgtgttctgcctgctgccgcctacctgcagggagacgcctgagctgggaaggttctgagggttggcagggtgctctgctgtgctctttgggaggatccccttggctgttctgcatgcccagggccgtgctctccgtggaaatctatgttggagacgacaggctccggttccagctacaccagcctgacttccrctggacagtgccattttctgcctctgataacaccgtggtgaagcgccttacgtaaagcaacagattttttgttttaagatgcactataattactcttttcagaaccaataatattaacccagtgaagtcaaaactgaattgttttataaactgactatggagctggtgtaaggagatgcagggaaggcttctcatctgagtcggtagcagagtacatagtgcaagaagcgtgggcaggctcccagcgcacccagagatcaaggagagtgatgggtgctgcccgcctctgaggggacggag

SEQ ID NO: 166085 - DNA, 601 bp, Human
tgagtttcgggggtgattggaatgtttctccctggagggaggcctgatgccctggagctggctccagcccgagccccgcggcgtgttctgcctgctgccgcctacctgcagggagacgcctgagctgggaaggttctgagggttggcagggtgctctgctgtgctctttgggaggatccccttggctgttctgcatgcccagggccgtgctctccgtggaaatctatgttggagacgacaggctccggttccagctacaccagcctgacttccactggacagtgccattttctgcctctgwtaacaccgtggtgaagcgccttacgtaaagcaacagattttttgttttaagatgcactataattactcttttcagaaccaataatattaacccagtgaagtcaaaactgaattgttttataaactgactatggagctggtgtaaggagatgcagggaaggcttctcatctgagtcggtagcagagtacatagtgcaagaagcgtgggcaggctcccagcgcacccagagatcaaggagagtgatgggtgctgcccgcctctgaggggacggaggcagctgccacccgccgtgtccctcac

SEQ ID NO: 166086 - DNA, 601 bp, Human
aagaagcgtgggcaggctcccagcgcacccagagatcaaggagagtgatgggtgctgcccgcctctgaggggacggaggcagctgccacccgccgtgtccctcacgctggctttcagaaggcttcacgcaagtgggctcacaggcaagaagaaaagctgtgggccgtgtgtctcccttggctatggctcagttttaatgtaattagaagctcaacttgaaagtgagatatcaaaggaagccttcagttgctgaagatgggtgtgctgggggatgagggcgtgggttgaaaagtatccagtkactctttttctcacgtggatcagtctaacatatgtgactctggtaattgaagatggtgacaggctaaactaagctgggattccccagggagagactaggatttctggaaccagtctaacaaaaacagaaacttgaaggagaaaacagaatatgcctccctctcttccctgcttccctcctctactcaaaaaaaagaaagaaagaaaaaagcagcttttgcaatgaagaattcagtttttcgcccccgagtgtatgatggtagtgactttggtgttcctggtgcagacctgtatttttttg

SEQ ID NO: 166087 - DNA, 601 bp, Human
agcgtgggcaggctcccagcgcacccagagatcaaggagagtgatgggtgctgcccgcctctgaggggacggaggcagctgccacccgccgtgtccctcacgctggctttcagaaggcttcacgcaagtgggctcacaggcaagaagaaaagctgtgggccgtgtgtctcccttggctatggctcagttttaatgtaattagaagctcaacttgaaagtgagatatcaaaggaagccttcagttgctgaagatgggtgtgctgggggatgagggcgtgggttgaaaagtatccagtgactstttttctcacgtggatcagtctaacatatgtgactctggtaattgaagatggtgacaggctaaactaagctgggattccccagggagagactaggatttctggaaccagtctaacaaaaacagaaacttgaaggagaaaacagaatatgcctccctctcttccctgcttccctcctctactcaaaaaaaagaaagaaagaaaaaagcagcttttgcaatgaagaattcagtttttcgcccccgagtgtatgatggtagtgactttggtgttcctggtgcagacctgtatttttttgtgat

SEQ ID NO: 166088 - DNA, 601 bp, Human
ttcagtttttcgcccccgagtgtatgatggtagtgactttggtgttcctggtgcagacctgtatttttttgtgatgtcttcatctggcccctcgccctccactcttcatgatgaatatgagacctgtgcactgagggtcctcaccaacacttccttcctcacagccgtatgatttcatccggaagcggcctctaaaaataaacaccctcatgttagcctttttccaccatgcttcatatttggctcttgtataaatatctgccacgtttccactgggaattattgctgttatatattttayagacactcgactgtcatctaagtggcttattttattcccatagctagaagaaaaatacaaaaataattttgtaatgtgagtgtgattgtgggccaggagttatgttctgagaaggagctgagagtaaattatattcctgctttattgtgttgatattgtcttccctgttgtgtcctgagttagcctttgttgttccaagttattaaccagaggtggcttgataatgacgccactttggaagcgtctggctggtgtttaaaactctagctggtgataaatatattttagtcctattaatga

SEQ ID NO: 166089 - DNA, 601 bp, Human
tatattcctgctttattgtgttgatattgtcttccctgttgtgtcctgagttagcctttgttgttccaagttattaaccagaggtggcttgataatgacgccactttggaagcgtctggctggtgtttaaaactctagctggtgataaatatattttagtcctattaatgaagaattgtaacattttagtcctattaatgaagaattttaacatccatgcagatgagcggcatcctaaaagcagcttcagatgctttggggtgttttctaccgaagatgcttttgtagaaataccgccttscttttcattttttacactggtctgttcatcaaaaaccataacttcatggaacttgcttctgtggaatgaactaaatgtaaattatttttccaaaagctttatgagtttatcatacatgttttggaaaaagtggaaaaacactaggaagaagttccagtgagcaaatgtttcccgacatgtttcacgttttgctctggtttgaagcagggcgttttgtggaaggtagggctggtggatcgctcggtcgctgggcagtgctggtcactgcctttctttggttgagctggtcttgagtcctgg

SEQ ID NO: 166090 - DNA, 601 bp, Human
cagggcgttttgtggaaggtagggctggtggatcgctcggtcgctgggcagtgctggtcactgcctttctttggttgagctggtcttgagtcctggtacctgtgtctgccctggcattgaccccgtggtgctttctgtgcatctccgtgctcacctttctggaacacagcccctgaacagaatcatttggcaaaacatcccagtacaaaaaccagtgggttttacatggggaaagaactcaatgagtccacagttcgtgtcgatgaaggaggcactgcgtgttgggctcaaacgcatctgkaactgtgggtgccaagagacaagtagagctcagactgctgggagcgttggctggaataaagctggccctcacggggctgttaaaatacttgaacttgaattcaaagtcagatttaagctgacttcacccctcttcccttgcttctgaagattctggtttttcacgagacagaaaaaagggtggaaccaggagcttatccccttccttccttccttgcaagcagcagcaacagccattgaaactcaaagacagcaagagctctcttcccgcccactcccagcgccactcccgggggaaccc

SEQ ID NO: 166091 - DNA, 601 bp, Human
tgccaggcggcaatggtctacaccgccattttaccttccccaggtctgtggcattaggtcttcccttgtgagtggctcgtattcttttcaagatactgtaaataatttggcatcatatggaccacttgatgcttctatatgaaacatgccttataaacccttagtactgcatgatttcagattacggaaatatctgcatgagtattggctgcgatatctctgtactagaaatttcagtgctacctctacacaaacagacacactggggatgtgctgtgtgtattgtatgagtgtatcatakaatatttcattgtccgtggtagtacatttcacatcataggctgtctgtggctacttttaaaccttagacatttgaattttccctcaagctttattctggtgaagcgtgggatggggtcttagctcactttggaaggatggaacagttaagcagcgtacctggtgactggcactgtgtgtgagtgatgccacctcggcaccttcgcgttgatcatctttaggatctttaggatcactgagaattaatcattctttgcatgcataaacctgtgtaagggttgctccacgtttctgccattgc

SEQ ID NO: 166092 - DNA, 601 bp, Human
ggtcttcccttgtgagtggctcgtattcttttcaagatactgtaaataatttggcatcatatggaccacttgatgcttctatatgaaacatgccttataaacccttagtactgcatgatttcagattacggaaatatctgcatgagtattggctgcgatatctctgtactagaaatttcagtgctacctctacacaaacagacacactggggatgtgctgtgtgtattgtatgagtgtatcatagaatatttcattgtccgtggtagtacatttcacatcataggctgtctgtggctactyttaaaccttagacatttgaattttccctcaagctttattctggtgaagcgtgggatggggtcttagctcactttggaaggatggaacagttaagcagcgtacctggtgactggcactgtgtgtgagtgatgccacctcggcaccttcgcgttgatcatctttaggatctttaggatcactgagaattaatcattctttgcatgcataaacctgtgtaagggttgctccacgtttctgccattgctcacagataaaacacattcatgatctcagcttaatcccaagaggatgtttccccat

SEQ ID NO: 166093 - DNA, 601 bp, Human
aggttttcactgatgggacatagggaaggtatggcaagctgggtggaggtgtgtttcctggacttttccggaataacccaacccatccctcctagtgagcacagaattacccagaaagttgaaaaggaaaacacagtttattggaacaaatatgcaaagtgatttgttcttttcacagagaaggtaaatagcatgtcagccgccaaggccctcacacacacggatctgcccgtggagtgatgaacttgtaaaagaacgtcaggtggaagcggtgagagggcctggacagttgttctgcagstgtgttctttgtctggttaatcgcgtgcgtctccagtctgtggctggccagccgcgtccacctgcgtgctccgggcacccaaggtgcttggttaatatgcagctctctcaacatctcccccttaggagcaacaggtacccggtgctggtgttgtccgtccagatgaaagggcctggccactctgattgcacttctctttgatctccctgtagaaggtcggcttgtctgcctagagattcctctgaagggcaatttaaaagttggatttgagcaacatcaagtgaaatgtcttcccatctc

SEQ ID NO: 166094 - DNA, 601 bp, Human
gtggctcatggctggatgtgaggaaagatattaacccttcctttgaaacaaactgtctcacaggctgaacttgccagctacctttctcctctgcttttagaaaagaaaatattttctttctcataatgctcttggcccttgaagataaactcattgcagtgtttaaaatttgtcctgagaccctattgcctttactttgttagtgtgtgtgagactgaaggcctgtggatgggtgagatgcttcgaactgatagaaaaagaaaacagaaggaagatttttgtgggcagagccgagacgccrtctctcaaggtgttgtgatcagtaaaagaatccatttttaatggtgaactggcaaaggctgctaaataccaattactgagtaaagtgccatgagaaggtaaagccactttttgtgaattatttcattgcactaacgtgctcgtactgaaaaacatggccaggctgcttccgatacagttcacttaaagaaaaatggctcacgttaaaaatagttgctttattttgtaaatgttttagaaaagtgcattgctgtccagaaatctagatgtacacttgttttgtgtttaatgaaaaagggaa

SEQ ID NO: 166095 - DNA, 601 bp, Human
aagataaactcattgcagtgtttaaaatttgtcctgagaccctattgcctttactttgttagtgtgtgtgagactgaaggcctgtggatgggtgagatgcttcgaactgatagaaaaagaaaacagaaggaagatttttgtgggcagagccgagacgccgtctctcaaggtgttgtgatcagtaaaagaatccatttttaatggtgaactggcaaaggctgctaaataccaattactgagtaaagtgccatgagaaggtaaagccactttttgtgaattatttcattgcactaacgtgctygtactgaaaaacatggccaggctgcttccgatacagttcacttaaagaaaaatggctcacgttaaaaatagttgctttattttgtaaatgttttagaaaagtgcattgctgtccagaaatctagatgtacacttgttttgtgtttaatgaaaaagggaaggaaaaatatctcgaaatcccaaatctcatcggtatcaataggatcataaaagtaaaggcaggaaaaggaatttgctgctcgtgtttcccatccatgtttccaggttatgtattttgtttctcaacttttatttatgttaa

SEQ ID NO: 166096 - DNA, 601 bp, Human
ctttttatgcaccagcgtatgcattgtgccacatccttagacatgacttttattggatatgcagtagcctggcttatggatgtttcataatttatttaacaccctgtgattggttatttagcttactttcatttttaactgtaccaaattgtgctgtcatgccatcctggaagtggattgcatgtgggcgccttgtacttgatagagcactttcttaaactgtatctcagtcattagcacaagtgctccatgaggcagtgaggccactgagtagtgatccgggtcacaagggaagaactgrggcccagcgagactgaagcgggtattttcacgtgagacttcgccagtacgggcaaaagcacacggtagaggattttgaaatcaccctgattgaagaccaagctggtttttgtcccaacaatagtgattccttcatttatcccacaaatatttaaatgctgcgtacgtgtcaggcactgtccttggttctggtgaatagagcagaccctgcctgctgctccgggggatgccggcccgattctttggtaactctggaaggcttgtgcacctgctggagtttgggggagagagggagggttgt

SEQ ID NO: 166097 - DNA, 601 bp, Human
gtcattagcacaagtgctccatgaggcagtgaggccactgagtagtgatccgggtcacaagggaagaactgaggcccagcgagactgaagcgggtattttcacgtgagacttcgccagtacgggcaaaagcacacggtagaggattttgaaatcaccctgattgaagaccaagctggtttttgtcccaacaatagtgattccttcatttatcccacaaatatttaaatgctgcgtacgtgtcaggcactgtccttggttctggtgaatagagcagaccctgcctgctgctccgggggatgycggcccgattctttggtaactctggaaggcttgtgcacctgctggagtttgggggagagagggagggttgtggacccagtcacataccacagtgggttcaaagtctcatctttattctgggagtgactgggtgtctttaaaagtcaagttcggaagattctcatttaatgatatttgattccatgtctcatgcagaggaatacttaggtacgacggaatgagttaagtaaagggtaaagtattacttaaatatatcatctgaaaataactgcttcatatctcttgtatcttaaaatattt

SEQ ID NO: 166098 - DNA, 601 bp, Human
tcaccctgattgaagaccaagctggtttttgtcccaacaatagtgattccttcatttatcccacaaatatttaaatgctgcgtacgtgtcaggcactgtccttggttctggtgaatagagcagaccctgcctgctgctccgggggatgccggcccgattctttggtaactctggaaggcttgtgcacctgctggagtttgggggagagagggagggttgtggacccagtcacataccacagtgggttcaaagtctcatctttattctgggagtgactgggtgtctttaaaagtcaagttcrgaagattctcatttaatgatatttgattccatgtctcatgcagaggaatacttaggtacgacggaatgagttaagtaaagggtaaagtattacttaaatatatcatctgaaaataactgcttcatatctcttgtatcttaaaatattttctggacaaaaattttatgtaaattaaaacaaaatgctgtttttcatcattgtattaggaaaaaatgtaaatacaaaatatttggtgttttgaaggatgggccggaaatggggatgtttttgtatgatgctgctgataacagtaagttgcta

SEQ ID NO: 166099 - DNA, 601 bp, Human
tagaaacccccaaagtgcctcgtattttctcacccgagtccagccggagatactgaccttggtctagatcgtcacctctgaaccattcctgaagaagtgggtagacaccccctcaggactgctgtaagagtggaacacattcacgtataaccagcacagaggttagtattcagtaagcactcaataaatgttggctctgaagagattcttctcatttgcatcattgaaaaggggtctttgcaatgatgcttatagcccagtttggggtgaatcatacctctaagcaactgtcattgaaagaaggccttaatgctgatagtcattgtttcagttttactttttatttctttgtcttggctctctggctaggcctttaatacagttttgaatagaagtcgtgataatgggcattcttgtcttgttactaaatttagaggaaaagctttcagcattccactgttgatttcctgtgaactctatagattgttttgtggatacccattttcccccagaatgaaagatctttttgaaattatattattctttctttaatgaggccattttcatatttgcatttatgagaaaatgtttaaaaaagtat

SEQ ID NO: 166100 - DNA, 601 bp, Human
accattcctgaagaagtgggtagacaccccctcaggactgctgtaagagtggaacacattcacgtataaccagcacagaggttagtattcagtaagcactcaataaatgttggctctgaagagattcttctcatttgcatcattgaaaaggggtctttgcaatgatgcttatagcccagtttggggtgaatcatacctctaagcaactgtcattgaaagaaggccttaatgctgatagtcattgtttcagttttactttttatttctttgtcttggctctctggctaggcctttaatacarttttgaatagaagtcgtgataatgggcattcttgtcttgttactaaatttagaggaaaagctttcagcattccactgttgatttcctgtgaactctatagattgttttgtggatacccattttcccccagaatgaaagatctttttgaaattatattattctttctttaatgaggccattttcatatttgcatttatgagaaaatgtttaaaaaagtatgtgaacataaattatataatcttttgagtcaatcagaattatacaattgaaaaatagtctacaattaatgatattcaagta

SEQ ID NO: 166101 - DNA, 601 bp, Human
ttctaggtagatgcacattttcccagttggcaggtgctggctcatgctgaaggggaacatatgctcaggattcctgctttatgtacttcaaaaggagacatgtgacatgtttcacttaacttcatctaaatttcctagacacaccaatctgtaacggtttagaactcaacccggtggttatacagctttcctgaagtggagaggtgggctacttatcttgtatgagtcccatgagaactaaagaacaatggttcaaaaaacagatggatgtctcccatcttacattccctccaggaagaartagttgaagaaataatggatataaatttccttgaattaagaacacatgaaagacttaagaataagaagtccaagagaggaccaaagaggcaaaaaaaaaaaaaaaagaaaaaaaaaagaaaaataactgacgtctatctagaagagcacagtgaaatttaagaatagagagaaaaatctaaaacattagcaagaacaaacaacacatataaagaaccagtggtcatattggcttcagatttgtcaacagcaatattgaatgtaagaagagaatggaggcatgttttcagcgtattaaagg

SEQ ID NO: 166102 - DNA, 601 bp, Human
aaaacattagcaagaacaaacaacacatataaagaaccagtggtcatattggcttcagatttgtcaacagcaatattgaatgtaagaagagaatggaggcatgttttcagcgtattaaaggaaaataacttagaacagagttttatatgcagctaaaactttaaaatatgagggcttggcaaaactattctcacaaggcctcaaaagttacaccttaacaattataataaatgtaaatgaactaaactcaccagtaagaaaaagactgaaaaatggaataaaatataaaatccaaatataygccactcaaaggttatccaaagtataaggactttcaaactttgagggtaaatggatggaaagaagcatgtcaggaaaatacccaaagaaaactggcatagctataatgatatgtaaaatagattctaagactaacagccttgttagagatagaaaaggtgaatacacaataacaaaacaagtaaaatagattaacagagtaaaacataaatgacaaaaataatttgtattcttgaaaatatatagccatggaagtatacattttaagttagaaaatgaacagaataaaccttttaaaaag

SEQ ID NO: 166103 - DNA, 601 bp, Human
agcacaacctatcaaaagctgtgggttgcggctaaaagtgtgctttgagggaaatttataacattaagtttttataatagcaaaaggtctcaaaacaatgatctaagctgctgctttaagaaaacagaaaagtaagagcaagtcaaacccaagacaaacagaaggaaggagataataaagataaaaacaaagatgaataaacatggaaaacagaaaaacagtggaaaatatcaatgagtcaaagaactggttctttggaaaaatattaattaaactgataaatcggtggctagactgaccaaaaaaaaaaaaaaagagagtgaagtcatatattaacaatgttatgatgagaggggccattgctacaaaacatactgacactgaaaaaaaaagtgcatagcaggacagtttcgctacccatatgtttgactgcttagataaatgaataactttttttttttttttttggagacagagtctagctctttctcccagcctggagttcagaggcacgatcttggctcactgcatccttctcctcccgggttcaagtgattcttctgcctcagcctcctgagtagctgggactacaggtgagcac

SEQ ID NO: 166104 - DNA, 601 bp, Human
ttaaatctatcataataattgaatttataatttaagcctttccataatgaaaatttcagacgtagttgtcttcattggggaattctacaaaacatttatggaagaaataatgtctgttctagaaaattcttccagaaaatacacgaggaggaaatactttccaactctttttatgatggcagcattaccttgataccacaaccaaataaagggattagaagaaaattacagaccaatattcctaatgtacataaaatgcaaaagtcctcaggaatattaccaacttgaaaccaggaaatayataaaggatgatggaacatgaccaacttgagtttatcttatgaatgtaagactgttcagtatttcacaattaatcagtttaccatatcaataggaaaaatgaagataaacctgtgttaatctcgaagaaatttcctgatttgataaaaaggaatctatcaaatacttattgctgacataattcctaatgataaaagattgaatgttttcctcctaaaatcagaaataagacaaagatgtctgtccactcttcctacagctattcagtggaaggtcctagccagtccagtacatcaaggga

SEQ ID NO: 166105 - DNA, 601 bp, Human
gtatctaatgtaatgctgaaaacatgaaatccacataatgtatgcggcatagctaatattagaagcatgttcaaggagcagcctctggggttaatagagtttaatttgcaagacaaatgaaagcttattttctcctaggctctctgctcataattctagtagggccacttttgaagaatagtaccttcaacagacacagagaacccttgttggacagcaacagaacttgctcacagtgagacccgacatcccctccgctcagtgggcatttcctacagtgcagagttgtgcgttgaaaagygcctcttcactccctacatgaggttcctcacacaaccccgcacctgggcgggcgggcgggcgtagggggcataaatggcttatccctatgaacttcatcattatgaaatgtaaaaatggacagtcccattgccccagaaacagtgggggagcttttaagtaaatccaggtttatctgcatttgggaatattctgcattttttgaaaatgatgttcccaggaatctttataaccaaggagaatccttactgtaaacattccacctgaatttttccaaaaaaaaaatagatcattaagaaca

SEQ ID NO: 166106 - DNA, 601 bp, Human
gtggcagccaaaaatgcttccacgttttctaagcattccacaggtgtatgttcctggcctgattcaggatagaccagtaactcctgaaagtaatcaaaggggccggctattgtggctcacgtctgtagtcacagctacttgggaggctgaggcgggaagaccacctgagccccgaagttcaagactgcagtgagccgcgatcccaccaaggcattccagcctgggctgcagaataagaacctgtctcttaagaaaaaaaaaagaaaaaaaggtaataaaagagcaccaggaagcataggtratgcacctcccatgtagagaaggctgggcgagcgaatgtgtagtggtttctgcggctccattgttagtgatgacttacggatggaaaagggagttttgtagctgagtgaaaactgttagaaaaccaaatgccgctgtcatgtttttgtctcgtgcgcttccccttcaccttcatccttgggcccatgctgtggccaactgaggagtaccctgaggttaagcgtcccccatggcaggtgaggctgtggggtgggaggagggctgggagatagcagattagagatctacaagagaatagaaa

SEQ ID NO: 166107 - DNA, 601 bp, Human
agcccagcctctctacagagagaccttcccagccagccccggtctaacccatcatgctgttgagtgttcttcctagcagacatcattatattactcatgcattcattttagggggttatggtctattccattgctcccctctcccagagcagtgctttaggggagccaggtctgtcttactcccggtacacccagcacctgtaactctctagcaaatcctagatgcttggtgagtgagtgagtacattgaagtacattgagtacagtgaggccacacaatttaaaaagtgacaatggcagwacactgcggcatgtgctggaaaatgaagtccagggtgctgggtggcctcatggcagggaggctcccctaggctggcgtcggggccaggcagcctgaggatgtgaaattcaagaggacacagcaagaggctggaaggaaactagttggggacaggggtgagaggactcgattgaaggggtcccactgcaaagggccccatgagcccatccagagtgcttgggttccccccctgaggcctggtgagagcccgtggaagggccgagcctggggagctcacaccgaggcctcaattcctgcttc

SEQ ID NO: 166108 - DNA, 601 bp, Human
cagacatcattatattactcatgcattcattttagggggttatggtctattccattgctcccctctcccagagcagtgctttaggggagccaggtctgtcttactcccggtacacccagcacctgtaactctctagcaaatcctagatgcttggtgagtgagtgagtacattgaagtacattgagtacagtgaggccacacaatttaaaaagtgacaatggcagtacactgcggcatgtgctggaaaatgaagtccagggtgctgggtggcctcatggcagggaggctcccctaggctggsgtcggggccaggcagcctgaggatgtgaaattcaagaggacacagcaagaggctggaaggaaactagttggggacaggggtgagaggactcgattgaaggggtcccactgcaaagggccccatgagcccatccagagtgcttgggttccccccctgaggcctggtgagagcccgtggaagggccgagcctggggagctcacaccgaggcctcaattcctgcttccctttcagacacgcattcatccttaactctttatcagaagggaaataaaacctcccagatagcttggttgtgagga

SEQ ID NO: 166109 - DNA, 601 bp, Human
tgtagggctcacgacagcttgtaattatttcatttgtgtgggtcttactttttgcacatctcttcactgcgtggcaggtcctgtggaggcagagcttgggtctgttttgtccactttgttcccagtccaggcagaaggatgggcagggagtggacgtccagataatgaacctgaagtgagtgaatgaatgcactaagctcaagtcagggttttctttacatagaaattctcccacgctcctttttgcttttagtcttgaggatcaacagtgttcatgtactaaatcaagcctgaaagccctttttttttttttttttttgagatggagtcttgctctgtcacccatgctggagtgcagtagcatgatcttggctcactgcaacctccgcctcctgggttcaagcgattctgctgcctcagcctcctgagcagctgggattataggcgcccaccaccatgcctagctgatttttgtatttttttggtagagatgaggttttaccatgttaatcaggctggtctcgaactcctgacctcaggtgatccacccacctcagcctcccaaagtgctgggattacaggcatgaaccactgtacctgg

SEQ ID NO: 166110 - DNA, 601 bp, Human
gcccacgtttggcagggtggctggcagccttggggcctcatccacggtgaggttgtgtttggcctctctttgcaggttgatggctggaagggggaagggttctgtggtcaggcctgtgcttcatggagatgtctgaccgttgggactgtacctttcatcctttggatgagatgctctgccttgaggcagaagcatggaaagccggtggatttgtgcgtgtcggtggttttccactgggtctccaatccggactcagcattgtgggaccaccagtggctccccctgccacttcttgtggacrcgttctttctccttagagcatctgttccaggccagcggcggtgttactttccagcctggggatgactttatggcgtgatgtctaatctccagtgggcaagtggtgaaggtactctagcatccatccagtggccagtcggccgagggcctgtctgctcatggggaagtgtcctctgatggcagcccagtgtcttgctaaccagcagaccactgcagaaggcaacgctggcctcctagaggtgtggcttgtttgcatctctatgtttgtgaccaagtcgtttccttccttggtctcagaatc

SEQ ID NO: 166111 - DNA, 601 bp, Human
ggtgagagcggcggctttcctcttgtttgggcagcgggtgaaggacaggcgtggcaggctgtatggtgagtgtgggcatggccgcccctccgtcctctttcccctctggcccgtctcgcatctgaacacctgggagtctgtgattagacctgagaagaggaaatgaggggcagttcccttccattttcctcccagccgctcagtccaggtgtgtgtcagtttgcacgcctccctctggaagtccgtgtctctgcgaggctcctcagccccggtagcccccacgccaagtcccatttactcrgggtttctgctggtgacggctctaataggcacttcacctgctctgcggaggcgcctgcggaatggtggtcgctctcattagctctgctcacccgcccagcgttacaggcagctggggagggattcaggggctgctgtgttcagcagtaatcagagccccttctgtgcacattcgacgctcaagtgtgtagtttaccacgggagatcaagaaatacgttaaatgcataaaattaaaggcagcggcctgcaggatccccaggtggcgtgtgctgggaattggatgcacttggctgtgtgtgt

SEQ ID NO: 166112 - DNA, 601 bp, Human
aaagcatctaaatgtttccaaattactgcaggtaatttttacagcttaattcctccgagacaccattttaaatgaacccataattcaattttcagactttgcatttcaaatttttatgttgaaagtaatttcctttcttgcttaagttgtgctcagaaccagattcataaaatgtgtatgatgtatgtctgtagaatcagtgactgttagaagcttaataacaaatatgcaaggaagaaattaaatgatttttctcttcagtagttcagtttaacattgatttctaaaagaaatgattctsactttgccgctaagtttctttctttcactttttttcttttcttttttcttcttgcagtgttccaggggataaaactgtccttgtatctgtattttgaatgatttggaatcttttatctttgcatattcctttagaccagaaaagaagttgaataatgttcagactggctcccatgttaaggtagcacttagagattctctgaatatcatccctgaagctatggcttcctaaagacttttgacctcttaaattagtgaagagtggacaccaccgcttaagccctgctaagaccagttaaaa

SEQ ID NO: 166113 - DNA, 601 bp, Human
gatttttcaaaacccttttccatgtctgcccttcaatagaacactccaagtatccagttttattaatgtccagaagcgtaaatcacagccccctgttttgtcattccagtcattttagtcactaaaggattacttcaagtgactgaactcggctgttatctgtttgagtttttgcagccaggtcatctcaggggactgggaacaagctttctgcccccttaactatgtcgagtggatggctttagctggaccactttttgtgattgatgtacattctgtgtcgctgtatcttcccgcgacrtggtaatgcaaacttagaaaaaaaaataagatggaaatggtgctgcaagtttttaaaatcaagggttgggcagtgcagggggagctattgtttaaaaaataaaagttgggaggaagatataatggattttgtcagtggtattagggcgatgaggcattcttgagttcagcaaatattggcagataattctgctttatggaaactattaaatgtaattggtcacatcagagacacaattggcatctgtactttgaagctgaatctcctcaggttgagagagagaaagagagattaagacgg

SEQ ID NO: 166114 - DNA, 601 bp, Human
acacaattggcatctgtactttgaagctgaatctcctcaggttgagagagagaaagagagattaagacggactcttcagagaccatggactacagggcccaaagttataaatctggaagatgtaaataaaggaatattttaggctaacgttgctccaagaagcagtatttgcctgtaagaaatgtaataatagaggtgccaatacaagatagcaaaagttacccaggaaagatgttaagtgacatgctgtcttcatttttaaacaggacaaattatttaattgggaattttgccgacactrttgaagcaattatcatatttaaactgtttatcttctccacattctgcctgtattttttttcttctttgcattaatctttttcctctttagcatctagagagggtccctttctcgtggagatcggcattgtagaccttaaaaggtctcacttgagaaatatttttgatattattgaataattattaattcatgcaagaaacaaaaggaagggcactcaccggctcgtggccagagcagactctcattctttacttctgagtgtttgggggcttctagcgaataatccctggatgacgggtc

SEQ ID NO: 166115 - DNA, 601 bp, Human
aataactcaacctaaaaatcctttaggtgttctctgggggctggaaacagaggccggtggcgtggtgtgatgttcagcgttggccaggatcacttgcttcacccaggtgttgggcctgcacactgagtgcccgagaggaaaggttccgggaaagctgctgtcggaagccggggtttgtgggatcgtgtgtaggagtagatgtggaggggcttgtgtgaatgggggagttatgaaaccaggactgaagacaacagaaaggccccctgggagacaggtccctggcttgccctgtgcttccccrccactcggggggccggccatgcggagaacactctcctctcccagccaggcttcagaactggggggctcggcctccttcctctggccccagcagcccccgagcggagacgctggagttccagtagagtggagggaaaagtgtctttgacagcgaggtgagctgcctgcctgcacggtgggtcccctgggtgactcaggcccccttcctggaaggcaaagggaggggcacgtttctgaccctcctgagggaacggaggagactggagagggaacattctagtatgtgcgtgcgcccatgcga

SEQ ID NO: 166116 - DNA, 601 bp, Human
atggacaggcctcaggaagcacagcgtggtggccgtcacagccttctgggaaggctatttctgcatcactgaggccccacagcccagggtgtttaggatgaagggcacagatttccagatgtgaagagtgtcaggtgggctaggggcaggagaagcatgaggaggaccctgtgctggggatgagaggagagcggccctgcagtcaaggggccaggtggagccacctttggggatgcggggagaacttggtggccctcagagacccctgcttggagaccccacctcccccttgacaagactkcggcctgtgctgggcacagctggcccagagcgagggccacaccctactactgcaccctccacgcctgtctgtccttgcccacctcggtggctgcctcgccgacccccgccttgcagctggagtagctgtgctgataaagatgcaggtgggaagctggatggtgaggtagcccatctgtggtttgggatccgagaagacggcaagacctcagcttcatgagaagagagacctgaagatccatgctggggaagggcgaggatggaaaggggtgcagggcgtggagcaggtgcccaggtcggg

SEQ ID NO: 166117 - DNA, 601 bp, Human
aagggcacagatttccagatgtgaagagtgtcaggtgggctaggggcaggagaagcatgaggaggaccctgtgctggggatgagaggagagcggccctgcagtcaaggggccaggtggagccacctttggggatgcggggagaacttggtggccctcagagacccctgcttggagaccccacctcccccttgacaagactgcggcctgtgctgggcacagctggcccagagcgagggccacaccctactactgcaccctccacgcctgtctgtccttgcccacctcggtggctgcctcgcygacccccgccttgcagctggagtagctgtgctgataaagatgcaggtgggaagctggatggtgaggtagcccatctgtggtttgggatccgagaagacggcaagacctcagcttcatgagaagagagacctgaagatccatgctggggaagggcgaggatggaaaggggtgcagggcgtggagcaggtgcccaggtcgggtacagagacaggcctgggacctggaggacctgcacgcggggtcgggcacctgccacactctcccatgtctttgaagcctcttgtggtagaagagaaggtg

SEQ ID NO: 166118 - DNA, 601 bp, Human
cgcggggtcgggcacctgccacactctcccatgtctttgaagcctcttgtggtagaagagaaggtgctcatattttaccttctgtgccttagtatgtagtttggtattgtgttaagtggacagaaatcacatacccctgctcactctgagcctgcatcctttgaccgtcactgtgaacctcagatcgagacaccagcctcagcgggggctgagatagggcattccccattcccactggctgcttggagggctgtgagggacctgctgcctggagcacagggcctgtatgggtgggtaagtycctggagagacaggaggaggcaggggtgtgcaagcctcttgaggtatgaggaaggtggccggggtctcgggaagcttgtctggccctggcaggcaggacaagggccccctcctgcccatacctctaccttaggccccttgtcatgacacgtgatacctgagggtggggggctgtatgggcatttggaatgtgacggcacaagccacagtgggtcacttgtttctacaaatgcctgagaagaaaactattcttctaactcagagaagtgggatttcccactgaaaatcagtggaaatcact

SEQ ID NO: 166119 - DNA, 601 bp, Human
ccctcatccctggtgtcagcacactaccgaggtgctcctggtttaaggacgtttgtgcacccacccggaggtatgcatggaaagaaagcactgcagccataccccagccagtgtaggggtgggacacagtcccgtgggggccccgcggagggcctgggcagatgcagggctgcgcactgccgtggtttcctgtgtgtctgccaggagtgaagacctgagcagcctcactggcctggtgtggaggggccgcctccgagcatgcggagaagtggtttgcatggctggaagtcaatgtttatcygtctttagactcagttgaagacacatttctttcacacattaccatttttaaaacccattaaggtctgattttccaaggcgctgaccctgacgcttctagagggcctcatcccggaagctggtggggagagcaggaaaatcttccccgttgagttttaaacgtccagacctttgttgtctccttgtgacccttgcaggagagctctcgtggcttctgtgcatgttcgtgtgtgactcgcccggctgagggactggcataaacaaacagggatgagcttgtaaaacactttgtaatcccttg

SEQ ID NO: 166120 - DNA, 601 bp, Human
gcatggctggaagtcaatgtttatccgtctttagactcagttgaagacacatttctttcacacattaccatttttaaaacccattaaggtctgattttccaaggcgctgaccctgacgcttctagagggcctcatcccggaagctggtggggagagcaggaaaatcttccccgttgagttttaaacgtccagacctttgttgtctccttgtgacccttgcaggagagctctcgtggcttctgtgcatgttcgtgtgtgactcgcccggctgagggactggcataaacaaacagggatgagyttgtaaaacactttgtaatcccttgaaaaggagaaaaatataaatgaaaatcactgtttaacagtgaaggcaggaagggagctgttcctcagtatagctgtgggttgtcgttacgtgagcaggagggaatttcactttggatggatttggattttctcttcatgctcatgctctctaaatcttgcaaaagcacatggtaaacacacagcgcatgtgtttctggaggaaacgcacagtgtccatatagagcaggcactgattttgcactgaaagaacgtggatgagaagttccacgtgttt

SEQ ID NO: 166121 - DNA, 601 bp, Human
gcagtcgggaggtgacaaacatccatggcatgagggcagcaagagcccctctcttgggaaccagttgtggccactatctgcccagtgaacatgggcttcagccccgagcatgggagggctcctggttgggcatctccctgggagttccttggtactgcctcctgcagggtgaggaggggtggggcctacttccaggcctctggaagcagcatcggcatgtcctttctggtgtgaactccaaatatctgagatggtctcagttaatttagaaagtttattttgccaagattaaggacatgcrcctgtgacccagcctcaggaggtcctgatgacacgtgccccaggtggtcggggcaccgcttggttttatagattttagagagacatgatacatcaattaatatatgtaagaagtacattggttctgtccagaaaggcagggacaactcgaagcagggaaggggcttccaggtcacaggtaggtgagagtcaagtggttgcaccgagtttctgataagcctctccaaaggaggcaatcagagatgtctttctctctgtgagcagagggatgactgaatacaacgggaggcaggttggccct

SEQ ID NO: 166122 - DNA, 601 bp, Human
agagatgtctttctctctgtgagcagagggatgactgaatacaacgggaggcaggttggccctgagcagtttccagcttgactttcccctttagattagtaatttgggggccccaaggttctcctttcatgctgggaggagggtttttccacacgtctcagacccaactctcgggcttcttaacccaaaagaacttccacgcagaagacagcgaaaatagtgcacttcattttctaagacatctaaagctgccacaatgactgtgagttaggtgagctctatgaattaggctagggatttrcaaccacttagcaagttctaagtaactgtaaaagatcccatagactgcaaattgtgtttcatttggggacagataccctgtcttggggatttaagtgtgtttacctgcccagagttgacacagacgactgtcccttagcttcctttcctcatgctggttttaagtgcttcgaatcgggattttcctacccatctgatgcattccattgaaaattcaggaatacacatgtatgtgactgtttattggcaagtaattgtgaaataggccagaaatctaccagcttcctttaattaatgtaac

SEQ ID NO: 166123 - DNA, 601 bp, Human
gagaattctaaagcagggaggagggatggggtgagttttaaatgtggtgactgctgaagaaatggcctctgacagcctggaggaggagctggagctgggggggggacaggctggccagctcctccaacacacacacacacacacacacacacacacacacacacacacacacacacacacacacacacaccctctcccccaaggacccacaaggactgcggcctcttagcgtgtgtggagtcatcacactgacccttagcagtgtggcctgacttcatgaggcccccgttgtcatggagaygctgggaatgggaggatttgccaccctccagtgaggagcccccatcccatgagtgcaaagcctgaaccggcccttccctaattggcacctctatcctattttctttggctgaggaaattctcgtaaatgtatatttaatgtggtgttgagattggtagttctcccccatcccccaaagatcatcaaatctctgggggtctttcaaaacctaaaggtgatctccctggtcctattatgctgttttgtttttgcttcttttctttttcttgaaagacctaattgtggagttttttccccctt

SEQ ID NO: 166124 - DNA, 601 bp, Human
ggagcaccttggggaagaagaaaacatagtttctgcccttacaaagctgataccccatcaaacttgagattaaaacagacaaaaaacccaagaacctacagagcactgcagagaggccttgggaccctctgacagagtcagtggggagtcggctgggaagggcagcttttctgtcccagcagccttgcttcctcttcagcatgctgagggacatggagccctccaccattatctgaattgattccatctttctctcctgcctctgctgtgggtttccataatgtgaaattaatgcatgtgcttaggttgcggggggccaacccctcagaaatatgcaaagacttcaagggagaccttttcttttcacaaagaggaagatcccccacccccaacacacacacacacacacacacacacgcacacacatgcacagtttgcatagccggagtagggagtatctctttctggggaatgttcgtatgtcactgttgattttacattgtttttcctttctttgacttgaaaatttttaaagtaacacaaatttattattttaaaaacttcaactctggaagtacagccgtaaaatcctctttccaga

SEQ ID NO: 166125 - DNA, 601 bp, Human
gggaagcaggggttgccatcttgggattagaccaagcagaaatcaggctaaaaaggcattataagagacagatgagaacaccttaaaatgctaaaagtcacactcataatgaagataaaacccatgtaacacagaaaccacctgtataaagcagaacctacagcatacgcaaagagaaataaatagcaacacggaaattgtcagagatgttaacacactattctcagtacaagacaggtcaagtggccacaagtaaggaatgatacaggagacccaaacaacctatcccgtcacagatacrtattgaaatgcattcgctgagtagaaaatacgtctgtttctcaacatacatggaatatttacaaaagcttatcaaaaattaggttatgaagaaaagtttcataaaagaattgttacaatcaacattctctgatcacagtgcaataaaactataaattgttaacaaaaacaaggcccatccacctagagacttaaaacctattcttgaatgaaagtgtaaatataaaccaacgtaatagaatgtctgtaaaataataactctgtgtatcaaaggcatagttaatgcagtgattagagaatt

SEQ ID NO: 166126 - DNA, 488 bp, Human
accccccaactcacttacccccacacccgctcacccacccatcctctcccctctcccaactctctctctcccaactctctctctctctctaactcagaaaagtggctttactcagagtctccccaagccttaaacagccattccctcacttggagaactgagtaagtagataagctgtagttcatccstaccatgcagttcagatcagccctgagaaaggagcagacaattgatacatacaacatcatgaatgactctcaaggcattatgcatttgatagtggaagaagccagacactgagatgacattactccacttacaggactgactgtgggaggcaaaaccactgggacagcaaatcagtggtagcgagggatgggattgagggggaaagaggtttcctatgaaggaccacaggaagtgcttaggatgatggaactctggcttgagcttagtgatggtcatgtgactgtaggtgtttgtcaaaa

SEQ ID NO: 166127 - DNA, 601 bp, Human
ctttactcagagtctccccaagccttaaacagccattccctcacttggagaactgagtaagtagataagctgtagttcatccctaccatgcagttcagatcagccctgagaaaggagcagacaattgatacatacaacatcatgaatgactctcaaggcattatgcatttgatagtggaagaagccagacactgagatgacattactccacttacaggactgactgtgggaggcaaaaccactgggacagcaaatcagtggtagcgagggatgggattgagggggaaagaggtttcctatraaggaccacaggaagtgcttaggatgatggaactctggcttgagcttagtgatggtcatgtgactgtaggtgtttgtcaaaacttacagaactaaacaccaacaagggtgagttttacttcatgtaaaaaatgttaatgtcatgaaagacaaaggctgtaaaactgttccagcttgagggagactgaagagacatggcgactgaatacaacgtgtgcctgtactccagggaaagtgtattgtgggagagacttaattgggacaattgatgaaattggctatggattatatgttagataaa

SEQ ID NO: 166128 - DNA, 601 bp, Human
ttggagaactgagtaagtagataagctgtagttcatccctaccatgcagttcagatcagccctgagaaaggagcagacaattgatacatacaacatcatgaatgactctcaaggcattatgcatttgatagtggaagaagccagacactgagatgacattactccacttacaggactgactgtgggaggcaaaaccactgggacagcaaatcagtggtagcgagggatgggattgagggggaaagaggtttcctatgaaggaccacaggaagtgcttaggatgatggaactctggcttgakcttagtgatggtcatgtgactgtaggtgtttgtcaaaacttacagaactaaacaccaacaagggtgagttttacttcatgtaaaaaatgttaatgtcatgaaagacaaaggctgtaaaactgttccagcttgagggagactgaagagacatggcgactgaatacaacgtgtgcctgtactccagggaaagtgtattgtgggagagacttaattgggacaattgatgaaattggctatggattatatgttagataaaagcactgtgttgatgtagaatttcctcagtttgacaactgtact

SEQ ID NO: 166129 - DNA, 601 bp, Human
cccaacagttgtagaagtttttgtttctaatgtttgctgcttatgaaacataagatggtaattaacaggtgattgctggaagttcttggcttggttcccacacctgaaaagcatttgtgatttactgaaaaccagtgcatgttgaaggcttcccagccttacataattgagattcactttgactgtcatattgccaaaaatggactcaaaccctgaagttgtatccataccatcttgagaatcagttgtttgaagcgtcacccattgtttctaaccatttttgttataaagataatacacwcagagagaagcgcctgcagtgaatctttgtgtaaccatcatgcagatcaggagacaaaccatggcggcccctcagaactctgccacgtgtttcttcccatcttttgctgctgctgctcccagaagtaaccctattccgacttttctgggttttcttggtaatcaatttctggtttttctttatagagttgttgcctaagtatgcacccttcaacacgatactgttgttttgcttgtactttttgttaactgtacatataataaattatgttatatatttctttattgcaggctcctttaa

SEQ ID NO: 166130 - DNA, 601 bp, Human
tgatacagtatgtcaggatatccagcttcagtttctgactaaatttcatagaaatgattgtcattaggtccgtgagcatcaatgaagtacaccattgattacactctttaaataatgtgcaatagattcagattcacatattttatgcagagtacctgctagtaggtaatatagtaaccataggccttaacattttcataagtttttcagtttagccaactaatccttttttgcttcacacaatttcacaaccaccacttataacacatcttagcagattccacttcaggttgtaccgaaktagtactttctcatttttctgaaaatcttttctttggatttaaaaattttttctttgaaaatattcttgccatggccatagtttgccagctgttaatctagctttcaaaataagaaaccacaaagaagagaaaattgaaacatagacctagtagaagaaaggcaataatgaaaagcataaattaatgtaatggaaataaaaaaaatttttgagaaaatcaaagaaaccaatagcttatttcagttttgaagacatcaataaaaatgataaaactcaaactgagaaagagattacaaatta

SEQ ID NO: 166131 - DNA, 601 bp, Human
tttcataagtttttcagtttagccaactaatccttttttgcttcacacaatttcacaaccaccacttataacacatcttagcagattccacttcaggttgtaccgaagtagtactttctcatttttctgaaaatcttttctttggatttaaaaattttttctttgaaaatattcttgccatggccatagtttgccagctgttaatctagctttcaaaataagaaaccacaaagaagagaaaattgaaacatagacctagtagaagaaaggcaataatgaaaagcataaattaatgtaatgraaataaaaaaaatttttgagaaaatcaaagaaaccaatagcttatttcagttttgaagacatcaataaaaatgataaaactcaaactgagaaagagattacaaattacccaaattgatgtggtaagaggaaataagtacagatcctacagacattaaaagattatgaaggacatattataaacagttatgccagtaaatgtgacaacagacaaaatggacagaaacattgaaagacacaaactatcaaagctctctcaggaattcgtaacttagttgctgtggtgcctgtatgactgtac

SEQ ID NO: 166132 - DNA, 601 bp, Human
attagtaaaattcgaattatataaatttacagttaaatacattatgtttggaaagagaacacacattcaaaactgattccttccaattattgtactaattgtgctgttatccataccttggaggccatttttatgatgctgtgatactccacatttagtgctgtcaccttggtagcttgaagtcagtcctggtaggaatatttacacagcagaaattagcaaatgctactaattagaagtttatttgattatctagaccagaggttggtaaactatggcctggggctggggctggacatctttttttttttggtaaataagtatttgtcaacacagccacactcatttgtttatgtcttgtctgtggctgctttcatagctcagtagcagtcaagtgggagcaactgagacttccggcccacaaaacacaatatatttactatctggccctttgagaaaatgtttgccaaccaaaatctagatttcaaaatgtgatggagaagatgttagtaaggtgcattcattttcagatgtcttgtgtgtaactgttacattttgaatagctccagaaatttagcccctcttccagtggttaaaagta

SEQ ID NO: 166133 - DNA, 601 bp, Human
attagaagtttatttgattatctagaccagaggttggtaaactatggcctggggctggggctggacatctttttttttttggtaaataagtatttgtcaacacagccacactcatttgtttatgtcttgtctgtggctgctttcatagctcagtagcagtcaagtgggagcaactgagacttccggcccacaaaacacaatatatttactatctggccctttgagaaaatgtttgccaaccaaaatctagatttcaaaatgtgatggagaagatgttagtaaggtgcattcattttcagaygtcttgtgtgtaactgttacattttgaatagctccagaaatttagcccctcttccagtggttaaaagtatcatctcattcaacaaagaaatcgctcatgtcattgccgaagacgtgaagttctgacataacatcttcatcacctctgtctcgtcactttgcagcattcatgtagaactgtgtgttcaccagttgcaaccacagattggctatggacatgagtttggcaaatatcaacaaagtcatgctataagaatcagctggctatacagaatttacaacaaagagtattgtgtattga

SEQ ID NO: 166134 - DNA, 601 bp, Human
tcatttgtttatgtcttgtctgtggctgctttcatagctcagtagcagtcaagtgggagcaactgagacttccggcccacaaaacacaatatatttactatctggccctttgagaaaatgtttgccaaccaaaatctagatttcaaaatgtgatggagaagatgttagtaaggtgcattcattttcagatgtcttgtgtgtaactgttacattttgaatagctccagaaatttagcccctcttccagtggttaaaagtatcatctcattcaacaaagaaatcgctcatgtcattgccgaasacgtgaagttctgacataacatcttcatcacctctgtctcgtcactttgcagcattcatgtagaactgtgtgttcaccagttgcaaccacagattggctatggacatgagtttggcaaatatcaacaaagtcatgctataagaatcagctggctatacagaatttacaacaaagagtattgtgtattgaattatttgtaaattgtatacttcacatcctttatatcagtagagtttattctttaagaaatgcacatctacatgaatacttgttttggaatgccagctaaacatttatcag

SEQ ID NO: 166135 - DNA, 601 bp, Human
ttggttttaaacccattcatagaatacattatttcaatgatttctcaattctagtattttcatttttttaaatagttggtgattctttcctgaatttgagatcttagcttttttcctgcttgaaggtagtaaagcatagttattttacattccaacacctggaatccctgtgatctattttttgtctttatttctgccatttttgttcatattgtcttatctcctcgtgggtctagttgttttttattttgtgccatattagtacattggagaaacagtgtgtagaaatgacgtattgccygggaggatgttttcttcctctagcagtgcttggggcaccggcagtgtgggatcagctcattctaatcctagggattaatacgatcagagcagggctgtggctcttttgaggtttgctctagtgacagctcacttttactcctacaaggtggccattcagattcttcccccaagttgagggtgctcaaaggaccctgcaagacactgtctgttgccccagggcagtcacctcgcaggaatggtgcttcatcccagggtaggggcagctcctgtgctgctgtttcctcctgtacgctggccc

SEQ ID NO: 166136 - DNA, 601 bp, Human
gcttcatcccagggtaggggcagctcctgtgctgctgtttcctcctgtacgctggcccaaaattgtcgctgtctgctcttagaatatgacccactcctttcataaagctgagttcaaatcccacatcccaatttaaaaaaaaaaatcatgttataagcaacactaacaacaaatccacttttctctcagccctgcccacctccccatcttcctttctgagacatgcagcatttctctgcaacaagcaaaattttgtatgtgcaaacacaccctcccaccccaaactttattttagtctctrtgtcttggttaaggtgtcttcctcgcagtgcctgccaccttgcggtcgagcccagctggcaaatgaagctgagctccagttctgcctgatgcaccaccccatgccttggtcttctgctggaggctgggggaggtgagcactggccaaggaccagccctctggttctgtccacatcggcttgatgcccattcaggggttgcaagttctcctggtctggatctattagttgaagaaattgccacctcgtaatttcaaattagtgggaattaaaaatttaatgggatgtatgtattttttgga

SEQ ID NO: 166137 - DNA, 601 bp, Human
tgtggtgagcacattggatttggagaggttaggcagatgcaggcaggccagttactggaccatcatggtggtctaggcagggaatgactgggtttagactagtagaaggatgacagcagtgacgtctgtaagtggacagattgccggaagagttaggagttaaaacgaggactttgtgattaaatagggccaaagaggaggataaggcaggcgtgggcccgtgttgctggcatgtgtgactagcaggaggggagtccccatcagaaggggaaacagagcaggaagccaggagtggcgggarcaacgcttcaaccttgggcctgctcttgttgaggtccagggaaccagtgggtcggatccgtgagcatgcaggcatggagctcagagaagcagcatgtgtcagagatatggcctgagagccacacacccactgctgctgctgtgatctccttgggtgagagcatcagggagaagagagaaagacccagtaggtggtgtcgccaagggagcaggccgtggtgacagaggctggtggaaccatcgggaaaaagggtgccagagcccatttccctgtggcagccaccaccccctcctcacaaca

SEQ ID NO: 166138 - DNA, 601 bp, Human
gatgacagcagtgacgtctgtaagtggacagattgccggaagagttaggagttaaaacgaggactttgtgattaaatagggccaaagaggaggataaggcaggcgtgggcccgtgttgctggcatgtgtgactagcaggaggggagtccccatcagaaggggaaacagagcaggaagccaggagtggcgggaacaacgcttcaaccttgggcctgctcttgttgaggtccagggaaccagtgggtcggatccgtgagcatgcaggcatggagctcagagaagcagcatgtgtcagagatayggcctgagagccacacacccactgctgctgctgtgatctccttgggtgagagcatcagggagaagagagaaagacccagtaggtggtgtcgccaagggagcaggccgtggtgacagaggctggtggaaccatcgggaaaaagggtgccagagcccatttccctgtggcagccaccaccccctcctcacaacacccaccaggtcccttttccttaaatcaaaacctggtggatttcaggggcaggcgctgctcagttgtggcctctgcaaggtcccggccatgtgtcaccattgagtagct

SEQ ID NO: 166139 - DNA, 601 bp, Human
ctgggcattatgagtgtatttttcttttggaaaaaaaaacattgaaaaagcagagttattaattggagtcctcaaggtccttatttcagtaaatctgaaatggtgaccatcttacccatagctaagttgggatgccaaagccatttccaccatcagcgtgctagtagtaaccatccaggggcaaagcggctgattctgcagcctgggcatgtggtatgtgggtgtctctgatgggccaagggaaatgacaggcccttgtgctgaagactgataggagttgatttacatgaaacacatgtgtttttttttttaaagacaattttaatgcacatattttcattttcagctttatagtgttttatgtcttttgcctttgtgatttaaattgtcttatattatttataagcattttctattatttataattatttttaatgattttatgtaataccattttatttctagcttgacctgagttggcctatgctaacacatttaagctttcctaattcccaaggttaccataaatcagcaggtccctaacttctgtattcatctctgccctgtagagaatagccaacctcaggttttcgcagccatg

SEQ ID NO: 166140 - DNA, 601 bp, Human
ttttatgttaggtgttaacattcagcaaacaaatccaggctctacttttatcctttaatgaaagattttattttttattcagcattggtgcattgaggacttacagccatcttatcttacctcgatgccattgaaacaaaaaaattagtcatagaaaacaaacctaatgccttcctttgcaagttccagtcagaagtgtcgcatataccagacaacacatcatttttatagttatagagagaactcctatgtacttcatgggaatacaaaaatgtcacaaaattaaaaggaatttttccaraattactgtgactgaacagatcattccacgctccgttataccattctgatcctaatcccatagtttaagtgtagaggctggaaaatgtcttcgatttagaaaggaaagacaggcgagtgctgtacaatggtgcaattcagtggccaacgagcccagcagtcgcagaccccatacattcctctcgttcatatcctatcgatttgtgacagcgatcacatgctattgtagtacaaggaagaggtttttttaaccgactgtatgacttgtagacttttctgtgaattttcattaaggttggtg

SEQ ID NO: 166141 - DNA, 601 bp, Human
aaaatctcctggcacacaggtcagcctgagttcagattttatttcgcgggcatgattttggggatcccgtgctagattgtagttgtgttgtaataaagccccctttccagcgctgcagtgggttgtggaaattgttgagaggagaaaccaccttctcctaggcatctgtatttggttacccgccagcactgagacatgcaggcatggaaaggcagactcaggaaggttcaggaattctaccgactttggagcatgctctcccccggatctgaaacactggcccccgtcttatccacccacmactccttaagacatccaggcgtggaagggaagattcaggaaggttcaggaattctaccgactttggagcatgctctcccctggatctgaaacactggcccccgccttctccgcctcccgctcctttaaccagtcgtcaggtatttcctcaggtacccgctctgggaagccttccctgaccctcctttgcccccgtggggacgtggctgctgcttcccccgtgtgcctgtggccccttgtgcccagcgccatcgccactccgtgagggtagatgtgggtgccggccgtgtctgatgcctcc

SEQ ID NO: 166142 - DNA, 601 bp, Human
aattcagtctacatacaattaatttttgcctattaataaaccccttggtgttagcgacagctatctaaaccacttcacctagtgtggaatgagcaagtgtacttgcaaatttccatccctggtctgcattttttagtgttgtatttgtgggttggagagtttgggtgcataaatcaagcattgtgaagaaatataactgccgaagactctgggttcagactggctgatgggaagtttgaaatacgaattagttccacattaattggggatagagggagatgcaggggggccatcccagcaygtggtagtcagggagggtctctggctatgggaaaatttgtcagccttgtatgtgcgtgagaccaactttctttttccacaaatacaaatcctctccaaattggacacttctcaaaagatatcttttctgtgtgttttcaaatctcataatttcttaaacatctaataaagtctgtgaatacacgtaagtgattgtgtatgtggtaactacaccagccaacagcattgaaaggaaaaaggaagaaaacacaaaaatcagaatggagccttgaagttgagatgagcaccacctagctcattt

SEQ ID NO: 166143 - DNA, 601 bp, Human
agccttgaagttgagatgagcaccacctagctcatttagagacatccacaggaaaggaggttccccaagacttttgttatgctccaaagccctgagacagatccatgtcacaaggacacctttctcatggttcaacatcaccagccaggaggaaatgcagaattctgtataaatgttaggaattcttagatttctcacctggatttgtaaaaattgcagttcatggcgagagacatccgggagatccaaatgccatcctcctagaacttgctggaggaaccagattctttctaagcgattkgcatcttgatgtgatgctacagttctatgacaggcccgagtagctgatgaaattctacgtgggaaaagcttttgagtgcctgtcctggtaaacctgtgacagtggcatcacataaaggtttccagaatgttctgtgaggagattgagccaatgtcgttggtcagcttaattggaagcaggtgattgaaagtcagataaacatgcaagatttgctgatttttaaatatgccatatgtgtcaaatgtatgaattgtgatgatggacaagaacactttcgcagctttaatgggagcatgtaat

SEQ ID NO: 166144 - DNA, 601 bp, Human
caagacttttgttatgctccaaagccctgagacagatccatgtcacaaggacacctttctcatggttcaacatcaccagccaggaggaaatgcagaattctgtataaatgttaggaattcttagatttctcacctggatttgtaaaaattgcagttcatggcgagagacatccgggagatccaaatgccatcctcctagaacttgctggaggaaccagattctttctaagcgatttgcatcttgatgtgatgctacagttctatgacaggcccgagtagctgatgaaattctacgtgggaraagcttttgagtgcctgtcctggtaaacctgtgacagtggcatcacataaaggtttccagaatgttctgtgaggagattgagccaatgtcgttggtcagcttaattggaagcaggtgattgaaagtcagataaacatgcaagatttgctgatttttaaatatgccatatgtgtcaaatgtatgaattgtgatgatggacaagaacactttcgcagctttaatgggagcatgtaatgacttgaacaagactgcttagttttggttactgatgatcaagtacagaatcttgctggtgtctcc

SEQ ID NO: 166145 - DNA, 601 bp, Human
ctctgggtttctaagtaattgaataagaaacgtttctatttatattcttatttatgtgcaactgtatttaattattccctagttttgaggattggccaataaaccttttcttcccttttgccattgattattcttaagtttaagacaatgcccagtggcagatgtgcttaaccgccatccttcatctagttcatgtgactttttaatgtcaattataaagaaaattactcctttggcttcagaagtttatttaaatctcttctgagaaaattggcagctcttcggagttaatgtccagagyagcagaaacagaaactggagggcacagactggtggatatgtgaacagaagcactttttttaaacaaagttaaaaaaaaaatgttatgctattgctaataaattgagtcaggggaaagaaaaaaaaaagagatccctaaatcagcttccaagctgccattaagatgggcaagtaagataattccacataaataagaccagaggccttgtctctgtttttatttatgtatttattttattatttttttgagacagagtctcgctttgttgcccaggctggagtacagtggtgtgatctcctc

SEQ ID NO: 166146 - DNA, 601 bp, Human
aagagatccctaaatcagcttccaagctgccattaagatgggcaagtaagataattccacataaataagaccagaggccttgtctctgtttttatttatgtatttattttattatttttttgagacagagtctcgctttgttgcccaggctggagtacagtggtgtgatctcctctcactgcaacctctgcctcccgggttcaagggattcccctaccttagcctcccaagtagctaggattacaggcgcccaccaccacatccgactaatttttgtatttttggtagaaatggggttttctgctgctctcaaactcctgacctcaagtgatccacccacctgggcctcccaaagtgctgggattatagacatgtgccaccgtgcccggcctgccagggctgtttttaaatgaggatttctccatttaaggaggtcacctgtcctggacggtatttcctaaatgcctggcataggtgacatcatgcgaacaagtgatggttcagaatacagaagtcatgagtttgaaggttgtgatagaggaaggccgggagagaagtgagaacagaacgtgcttgccctgggcctgcagctgttgccagc

SEQ ID NO: 166147 - DNA, 601 bp, Human
agagatccctaaatcagcttccaagctgccattaagatgggcaagtaagataattccacataaataagaccagaggccttgtctctgtttttatttatgtatttattttattatttttttgagacagagtctcgctttgttgcccaggctggagtacagtggtgtgatctcctctcactgcaacctctgcctcccgggttcaagggattcccctaccttagcctcccaagtagctaggattacaggcgcccaccaccacatccgactaatttttgtatttttggtagaaatggggttttctgctgctctcaaactcctgacctcaagtgatccacccacctgggcctcccaaagtgctgggattatagacatgtgccaccgtgcccggcctgccagggctgtttttaaatgaggatttctccatttaaggaggtcacctgtcctggacggtatttcctaaatgcctggcataggtgacatcatgcgaacaagtgatggttcagaatacagaagtcatgagtttgaaggttgtgatagaggaaggccgggagagaagtgagaacagaacgtgcttgccctgggcctgcagctgttgccagca

SEQ ID NO: 166148 - DNA, 601 bp, Human
agtagctaggattacaggcgcccaccaccacatccgactaatttttgtatttttggtagaaatggggttttctgctgctctcaaactcctgacctcaagtgatccacccacctgggcctcccaaagtgctgggattatagacatgtgccaccgtgcccggcctgccagggctgtttttaaatgaggatttctccatttaaggaggtcacctgtcctggacggtatttcctaaatgcctggcataggtgacatcatgcgaacaagtgatggttcagaatacagaagtcatgagtttgaaggytgtgatagaggaaggccgggagagaagtgagaacagaacgtgcttgccctgggcctgcagctgttgccagcatcttctgtcagctgatctgggcagggcgtgggggttcttctcaggcctacctcctaagaacaaaaacatgactgaccacgagcctgtcctcaggatgcagcctccatccttggtgggcacagctgagagaggaagttctgagctgctttggggtagggctctgttgcactcaccctcccatctccttagtcgctgcaaccctgtgtcgcaaatagtaggttctcagca

SEQ ID NO: 166149 - DNA, 601 bp, Human
atttttgtatttttggtagaaatggggttttctgctgctctcaaactcctgacctcaagtgatccacccacctgggcctcccaaagtgctgggattatagacatgtgccaccgtgcccggcctgccagggctgtttttaaatgaggatttctccatttaaggaggtcacctgtcctggacggtatttcctaaatgcctggcataggtgacatcatgcgaacaagtgatggttcagaatacagaagtcatgagtttgaaggttgtgatagaggaaggccgggagagaagtgagaacagaacrtgcttgccctgggcctgcagctgttgccagcatcttctgtcagctgatctgggcagggcgtgggggttcttctcaggcctacctcctaagaacaaaaacatgactgaccacgagcctgtcctcaggatgcagcctccatccttggtgggcacagctgagagaggaagttctgagctgctttggggtagggctctgttgcactcaccctcccatctccttagtcgctgcaaccctgtgtcgcaaatagtaggttctcagcaagtgtgctgaaccaaggggtaagaacaacgtttttatttt

SEQ ID NO: 166150 - DNA, 601 bp, Human
ataggtgacatcatgcgaacaagtgatggttcagaatacagaagtcatgagtttgaaggttgtgatagaggaaggccgggagagaagtgagaacagaacgtgcttgccctgggcctgcagctgttgccagcatcttctgtcagctgatctgggcagggcgtgggggttcttctcaggcctacctcctaagaacaaaaacatgactgaccacgagcctgtcctcaggatgcagcctccatccttggtgggcacagctgagagaggaagttctgagctgctttggggtagggctctgttgcamtcaccctcccatctccttagtcgctgcaaccctgtgtcgcaaatagtaggttctcagcaagtgtgctgaaccaaggggtaagaacaacgtttttatttttttatttaatttatttttattttttgtttttacatttattttttaatccatttggaatttttctttttgagatatatataatagggatgaacttttatttcatttttctagacaggtgtacagttaccttaggtacatatattgaattgttatgtctcaccaatgcaccacaacgtagcagtctctcatagcccgacgtat

SEQ ID NO: 166151 - DNA, 601 bp, Human
tatcactggactgaaaatttaataagcaaaagaagaaagctctctggtgcacaggggggacccagaagagggttgctgtttttacagttgaatgcaaaggcttttataggaaactgatgagagctgggcatcttatttgcatacggtgcaaatctgtggtagctccaccccgtcctcctagtgcacacgtaggcccttagcttgagttactccatattgctttgtttcccttactgtgcatgtgtcaggggacaaaatttttcattgtgggcatgtctgggaaactcacatgtgtagccctttttttttttttttatactttaagttctagggtacatgtgcacaacgtgcaggtttgttacgtatgtatacatgtgccatgttggtgtgctgcacccattaactcatcacttacattaggtatatctcctaatgctatccctcccccagccccccaccccacaacaggccctggtgtgtgatgttccccttcctgtgtccaagtgttctcattgttcagttcccacctatgagtgagaacacatggtgtttggttttctgtccttgcaatagtttgctgagaatgatggtttccagcttc

SEQ ID NO: 166152 - DNA, 601 bp, Human
cagaagagggttgctgtttttacagttgaatgcaaaggcttttataggaaactgatgagagctgggcatcttatttgcatacggtgcaaatctgtggtagctccaccccgtcctcctagtgcacacgtaggcccttagcttgagttactccatattgctttgtttcccttactgtgcatgtgtcaggggacaaaatttttcattgtgggcatgtctgggaaactcacatgtgtagccctttttttttttttttatactttaagttctagggtacatgtgcacaacgtgcaggtttgttacrtatgtatacatgtgccatgttggtgtgctgcacccattaactcatcacttacattaggtatatctcctaatgctatccctcccccagccccccaccccacaacaggccctggtgtgtgatgttccccttcctgtgtccaagtgttctcattgttcagttcccacctatgagtgagaacacatggtgtttggttttctgtccttgcaatagtttgctgagaatgatggtttccagcttcatccatgtccctataaaagacatgaactcatcattttttatggctgcatagtattccatggt

SEQ ID NO: 166153 - DNA, 601 bp, Human
gctgggcatcttatttgcatacggtgcaaatctgtggtagctccaccccgtcctcctagtgcacacgtaggcccttagcttgagttactccatattgctttgtttcccttactgtgcatgtgtcaggggacaaaatttttcattgtgggcatgtctgggaaactcacatgtgtagccctttttttttttttttatactttaagttctagggtacatgtgcacaacgtgcaggtttgttacgtatgtatacatgtgccatgttggtgtgctgcacccattaactcatcacttacattaggtrtatctcctaatgctatccctcccccagccccccaccccacaacaggccctggtgtgtgatgttccccttcctgtgtccaagtgttctcattgttcagttcccacctatgagtgagaacacatggtgtttggttttctgtccttgcaatagtttgctgagaatgatggtttccagcttcatccatgtccctataaaagacatgaactcatcattttttatggctgcatagtattccatggtgtatatgtgccacattttcttaatccagtctatcatggatggacatttggcttggtcttt

SEQ ID NO: 166154 - DNA, 601 bp, Human
tccttttaagagacacggcaagcatcagacctgagggacatcatcatttccttgcagctcagaatgcacttaagtgtcatgtagtgggttttctgtttatgggtttgttttttttttagaaaatgtgttcttttctatcttttgtttgtttttgagacagggtctcgctgtgtcacccaggctggatggagtacagtggcaagatctcagctcactgcaacctcagcctcctgggtagctgagactacaggtgtgcaccaccacgcccagctaatttttgtattttttgtagagatggggwttagccactttgcccaggtttgtctcaaattcctggactcaagttgtccacctgccccagcctccaaagtgctgggattacaggtgtgtgccactgcgcccagcccaaccctgtcctttgtttcttacaatattcaacagtcagtcacttctagctttcactttgtcccataaaaatatttcattgaaaattgcaagccatggcagtttgcagtgtttctaagctgaggagttcagctccacacccaacagagctccagcttctggtttgattcttagagataggagtgacttttttcaa

SEQ ID NO: 166155 - DNA, 601 bp, Human
taaagttaaagctctagagtttggtgcctgccacttagctgcatggccttgggagttattcactcctctgcactttggttttctcgttaatcaaactggaatccagatactcacctcctaccttgttatgggaactagacgtgggcggtgcacgtgggggcaccgagcacagtgcccagcacccagtgggtgctcaggggatggcagctgccatgatttttgggactgaatgctttgataccacccaaatatatggtctgaggtggttgtaaatagaattagcagaggagatgatacagaytcagagttgaattagggtttgaagaagggcttaggtctggagcgttacaggtgggaggaccagcagagagtggtcaggaatcaggaatgacaggacacacctggggagcctgagcggcggcttccaggcagggaagaaaagctcggggcagtatgagtccagaccaggggcctatcaggcgccttctatgcagggtcaggtggtaaagaattatctcagccttagtgggctagaagatctctgtcatagctattcagctccgttgctttctgagtaaacaaatgggcgtggctgtgttcc

SEQ ID NO: 166156 - DNA, 601 bp, Human
tcaggcgccttctatgcagggtcaggtggtaaagaattatctcagccttagtgggctagaagatctctgtcatagctattcagctccgttgctttctgagtaaacaaatgggcgtggctgtgttccaatgaaactttatttacaaaaacagatggtgggccagtttggtatgtggaggcatgttgactatggacaccttgaaaatcccatgtggcaacagatatgagccaagtggtgacgtggaatgccccatcgttgagggatggggacgcaagggcagcaaggaggtcctgtgggtccrggtgtggcgtgggcccagcgtggccatggcatctggggcctcagctgcagggttgcagtggaaggaaggggaaagaagctcagagtgcattctgagggtcaaactggcctgtaagtgacaaactgaggtcacttcacatgtacatggagggagacaggctgtctttggagcagtgtccatgcaagcctgcctggagggagctgccaccctcagctgcagccccagacctcgcggttgctctcatccgtcgttcccagtgtgggcagtgacgcagcaccacggtaagttctgtagagtgga

SEQ ID NO: 166157 - DNA, 601 bp, Human
ctatgcagggtcaggtggtaaagaattatctcagccttagtgggctagaagatctctgtcatagctattcagctccgttgctttctgagtaaacaaatgggcgtggctgtgttccaatgaaactttatttacaaaaacagatggtgggccagtttggtatgtggaggcatgttgactatggacaccttgaaaatcccatgtggcaacagatatgagccaagtggtgacgtggaatgccccatcgttgagggatggggacgcaagggcagcaaggaggtcctgtgggtccgggtgtggcgtrggcccagcgtggccatggcatctggggcctcagctgcagggttgcagtggaaggaaggggaaagaagctcagagtgcattctgagggtcaaactggcctgtaagtgacaaactgaggtcacttcacatgtacatggagggagacaggctgtctttggagcagtgtccatgcaagcctgcctggagggagctgccaccctcagctgcagccccagacctcgcggttgctctcatccgtcgttcccagtgtgggcagtgacgcagcaccacggtaagttctgtagagtggacgccactcgct

SEQ ID NO: 166158 - DNA, 601 bp, Human
gtcaaactggcctgtaagtgacaaactgaggtcacttcacatgtacatggagggagacaggctgtctttggagcagtgtccatgcaagcctgcctggagggagctgccaccctcagctgcagccccagacctcgcggttgctctcatccgtcgttcccagtgtgggcagtgacgcagcaccacggtaagttctgtagagtggacgccactcgctggcaaagcccagcagggcaaggaataagtgtcactcagtctttatccagaaaaatccaccaatgtacttttagtgcagtattaacasatggtagaaaatggaattgcctagaggattttaatctctgatggattattcttgtacctgtacctgtctgatggtcgtgtaagtccatgttaacaaacctgggaccacaggaaaggagaactgatgcgaatacaaacaggtggaggatttccaggcgtcagtggggtctgggagacttttccaagaagtgttttcattgcagttaacatttttaaagatgaatatctcactattataaaggtcaatgccacttctgtaatattaatttgcaattgaaaggtattttcttttaagaagtcc

SEQ ID NO: 166159 - DNA, 601 bp, Human
aagaagggttcagcgttggccggaagcataactctagctctccaaggccttgggctgcggcagggtttgcatgtccaggcagtaggtggaggcttctcttggtcagtgtgtctgctcagggggaggcctggctggggaagcgggtagcagtttgggaccagagcttaaaagagaaggagagaccggtgcggtggctcaggcctataatcccagcactttgggaggatggggcaggtagatcacaaggtcgggagttcgagaccagactgaccaacatggtgaaaccccatctttactaaaratacaaaaattagcagggtgtggtggcgcacgcctataataccagctactcaggaggctgaggcaggagaatcacttgaacccgagaggtggaggttgcagtgagccgacatcatgctgctgcactgcagcgtgggcgacagagtgagattccatctaaaaagaaaaaaaaaaaagtgagactttgaaagtgatgacagtttccacagttcccatgggcaggtggctcagaatgaggtggcctgaggcccacagtctgtccttggggactgggtggcccccacgtccaggcagcagggag

SEQ ID NO: 166160 - DNA, 601 bp, Human
gggggaggcctggctggggaagcgggtagcagtttgggaccagagcttaaaagagaaggagagaccggtgcggtggctcaggcctataatcccagcactttgggaggatggggcaggtagatcacaaggtcgggagttcgagaccagactgaccaacatggtgaaaccccatctttactaaagatacaaaaattagcagggtgtggtggcgcacgcctataataccagctactcaggaggctgaggcaggagaatcacttgaacccgagaggtggaggttgcagtgagccgacatcatgcygctgcactgcagcgtgggcgacagagtgagattccatctaaaaagaaaaaaaaaaaagtgagactttgaaagtgatgacagtttccacagttcccatgggcaggtggctcagaatgaggtggcctgaggcccacagtctgtccttggggactgggtggcccccacgtccaggcagcagggagaggacgtgctggctgccaagatggggtgggagaagcccagggcatcaagtgccacggaaataaagctggttgccttagttgaatggcgcctttgagttcccagaagctcttctcagcg

SEQ ID NO: 166161 - DNA, 601 bp, Human
aaaattagcagggtgtggtggcgcacgcctataataccagctactcaggaggctgaggcaggagaatcacttgaacccgagaggtggaggttgcagtgagccgacatcatgctgctgcactgcagcgtgggcgacagagtgagattccatctaaaaagaaaaaaaaaaaagtgagactttgaaagtgatgacagtttccacagttcccatgggcaggtggctcagaatgaggtggcctgaggcccacagtctgtccttggggactgggtggcccccacgtccaggcagcagggagaggacktgctggctgccaagatggggtgggagaagcccagggcatcaagtgccacggaaataaagctggttgccttagttgaatggcgcctttgagttcccagaagctcttctcagcgggaggctccctgtctttcacctctgctcttctgaggtaccagttgaagggtttggggggtgaaatcaaggcatagggctcctggcaacactacccctggctccggggtttgcatgccggggcttcttccttgtcctggctgtcagagaacacctggaaataaatgctgcattgttttgctggaaaatc

SEQ ID NO: 166162 - DNA, 601 bp, Human
caatttacaagacaggtaatttagtgacagaattatttattaatgagcccaagtatacaagttaatgggaccgagccccgtggaggtcaatcctcatataatccatgccttttggaaagaaaagtattgtcttcagaacatttagttatgattgttaaatttaaattacgatatattctcttgctaagacaaaaaataattttttctgaattgcatgatgacagagttagtctgtaagctgtgtggagatgaattgtgtcaattaggggtaggtacatcttagccctgttggtaccaaaartattatttctcattgcatgggctcacaggagaaagcaagcctgttctttaatagagacgacaaatcagaaaccgctgcctgcctgggagatggaacagtcgtgcaggcgaggagctcagagggcgggcgtggcttcccaagctctggcacagcctgcaggccttatcaggtgctctgcttctggggtactcggcactttgctcttccggtggatgggggaggggcgggctgttccatgtgacagcatgtgggcttgtcatgattcggggtgaccactggcttccatttcccaggagtggc

SEQ ID NO: 166163 - DNA, 601 bp, Human
cattgcatgggctcacaggagaaagcaagcctgttctttaatagagacgacaaatcagaaaccgctgcctgcctgggagatggaacagtcgtgcaggcgaggagctcagagggcgggcgtggcttcccaagctctggcacagcctgcaggccttatcaggtgctctgcttctggggtactcggcactttgctcttccggtggatgggggaggggcgggctgttccatgtgacagcatgtgggcttgtcatgattcggggtgaccactggcttccatttcccaggagtggctttgtcctcgyggtcttacggtatgtttccagtagatgagaaggcatgcctacagacagggcctgctggtgtctgctgtgtgtcatggggggaggcaaggttttcctcactgggacctcttcactccccctttattaatgaccccctggctcctccccagaggcccagaagcctagaggagaaatgagggtacagcatagatgccttagtgtaacgagtggggctgctggaactcaacagactatttacagttacagcatgaaggtggtgcttgaaggatttgctgcttcgtttcatttttctcatttcat

SEQ ID NO: 166164 - DNA, 601 bp, Human
gaaggcatgcctacagacagggcctgctggtgtctgctgtgtgtcatggggggaggcaaggttttcctcactgggacctcttcactccccctttattaatgaccccctggctcctccccagaggcccagaagcctagaggagaaatgagggtacagcatagatgccttagtgtaacgagtggggctgctggaactcaacagactatttacagttacagcatgaaggtggtgcttgaaggatttgctgcttcgtttcatttttctcatttcatctcatcatgaagtcgattgcattatatcaggggtggggaatggaacagacacagaggagaacccaccaagttctgtgtcttcaaacctgcagcatttccaggttccgactgcagagtcctatcaaagtaagcaaaattggaagtgatgcccatttcctgggctttcacaaactttgttattctgcagtctaccacaaaatctgaaaaggcagagaaatgtagctttcactgtttagaaaatctttgtgagtttttcttccccctagggaatggttttcagcacattattcattggaaaaatgaaatctgaaatgtaggtgtattttcag

SEQ ID NO: 166165 - DNA, 601 bp, Human
atgaccccctggctcctccccagaggcccagaagcctagaggagaaatgagggtacagcatagatgccttagtgtaacgagtggggctgctggaactcaacagactatttacagttacagcatgaaggtggtgcttgaaggatttgctgcttcgtttcatttttctcatttcatctcatcatgaagtcgattgcattatatcgggggtggggaatggaacagacacagaggagaacccaccaagttctgtgtcttcaaacctgcagcatttccaggttccgactgcagagtcctatcaaartaagcaaaattggaagtgatgcccatttcctgggctttcacaaactttgttattctgcagtctaccacaaaatctgaaaaggcagagaaatgtagctttcactgtttagaaaatctttgtgagtttttcttccccctagggaatggttttcagcacattattcattggaaaaatgaaatctgaaatgtaggtgtattttcagtgcacgtgctccggaggagcctcagcacccttgtgtcttgtctacccattcgctcagtgggcagggattgagcactgggaatgtgctgggtcggagcc

SEQ ID NO: 166166 - DNA, 601 bp, Human
aatgtgctgggtcggagccgagggctggaggcagagttgggaccagccccaggatggtgcctggctgtttgtcccagggctcactggaacagccctcctgggcagcccttggttggacttctttacgcagcccagtccacacctcacctgtgcattcgtcaagccattgagtgcagtgttgtggcctgaatcactccaggccttgctttggagggttgacagtaggggacacggcaggccgggggcattctgggacccaggtctcctgcctatgtggaatactgatgtgtgttgtgtggayaggtcactgatgtgtttaaatgtaaatctgaccttcctttaagagcaattgggcagcagtctgggagcttgagactgtatgatgtggacacctagtatctctttctggaagcttctagtgtataatagaaagtaggttggttactcattcccattgtctttgaataatggggcagtgggcctggattgttgtcctgtggattggggaagagatcatagagatcatagaagtaaccttagagtaaaagaaagtaaatcaaaatgctattctatgtagaatatatgccatcaagggcagagc

SEQ ID NO: 166167 - DNA, 601 bp, Human
ggctcactggaacagccctcctgggcagcccttggttggacttctttacgcagcccagtccacacctcacctgtgcattcgtcaagccattgagtgcagtgttgtggcctgaatcactccaggccttgctttggagggttgacagtaggggacacggcaggccgggggcattctgggacccaggtctcctgcctatgtggaatactgatgtgtgttgtgtggacaggtcactgatgtgtttaaatgtaaatctgaccttcctttaagagcaattgggcagcagtctgggagcttgagactstatgatgtggacacctagtatctctttctggaagcttctagtgtataatagaaagtaggttggttactcattcccattgtctttgaataatggggcagtgggcctggattgttgtcctgtggattggggaagagatcatagagatcatagaagtaaccttagagtaaaagaaagtaaatcaaaatgctattctatgtagaatatatgccatcaagggcagagcatgtgggcgtgtggacttgtcatgatgaggagtgaccactggcttccatttcaaagaggagagctggagtgcttcta

SEQ ID NO: 166168 - DNA, 601 bp, Human
cttacatcccagagcaggttcttggttgagacacaggtgcttgcctcaggtttccttggaaaactccagtggcaccaagcggtcagtagcctgtagcggccacttgcactgttgtccccttttgtggacgtggacgttgactctccatgtctggtctgtgcaggaaagagtgagtcctctctttctcactccagagcctgcaggggtacccaccctcagccgggcagggcaagccaggacagaggctttgagggcatctgaggaggaaactgcaaggtgtgcagtttggcccagcagagaragaccagaatgcagagggtactcagggcaggcggttgctactctgggctgtgtgcgtcatagcgtttgcatgacagacaccagcggttgaccaaatgccccatttgaagcccatgtccaggcatgcagtgttgatctctgtgtatagatcgacgtggcttcttctctagggttggggaagagaactgtttaataatgcacagttgcctagcctcaaagatcctttgagaaatagctactctgtgcaagttttcaacaatttgtttagactaatggaatgactctttaaaagtttatatct

SEQ ID NO: 166169 - DNA, 601 bp, Human
agtttatatctttacagatatacaagcactttatttctaagcaactaatttaagctgggaaagaagaacgtgccctcatgtgtgtgtaaaacgttagaaagcagctctgttcactgccgtggtggtggaaggcatgtgcaacacagacataaggctatttgaactctttatttgccacatttacaatattaataatagcgtttctagaagttgtcacatcaagtaaaagatcttcattccaggctgtctttaggggccaaattgagactggatgcatgcatttaataaattgtagtctcaygtagtcatttttgtaaataattagtttcagtgaaagaataagttagcatattgtatgcatctaatgttgcaaatgtacatacagcaaactttgctattaatcaacagtcaggcatcgcaagtggggtctcatacataatgaattgtgcttaagcctcatgggcttcttgatagaaaaataaaagaaaacacaagtgcagtaagcttttgaataaaatttaactagattgctctgcatcctgtaattgttttggaatctttagggacctgatcattcatctatagttttggggtgttttta

SEQ ID NO: 166170 - DNA, 601 bp, Human
cactgccgtggtggtggaaggcatgtgcaacacagacataaggctatttgaactctttatttgccacatttacaatattaataatagcgtttctagaagttgtcacatcaagtaaaagatcttcattccaggctgtctttaggggccaaattgagactggatgcatgcatttaataaattgtagtctcacgtagtcatttttgtaaataattagtttcagtgaaagaataagttagcatattgtatgcatctaatgttgcaaatgtacatacagcaaactttgctattaatcaacagtcargcatcgcaagtggggtctcatacataatgaattgtgcttaagcctcatgggcttcttgatagaaaaataaaagaaaacacaagtgcagtaagcttttgaataaaatttaactagattgctctgcatcctgtaattgttttggaatctttagggacctgatcattcatctatagttttggggtgtttttatcttcatctgtcaaatagtagagacttttaatgatatgttaaaatgttgataaaatacaattttccttttaatgatttgaacatttggaggggggaggtaaataggctttt

SEQ ID NO: 166171 - DNA, 601 bp, Human
gccgtggtggtggaaggcatgtgcaacacagacataaggctatttgaactctttatttgccacatttacaatattaataatagcgtttctagaagttgtcacatcaagtaaaagatcttcattccaggctgtctttaggggccaaattgagactggatgcatgcatttaataaattgtagtctcacgtagtcatttttgtaaataattagtttcagtgaaagaataagttagcatattgtatgcatctaatgttgcaaatgtacatacagcaaactttgctattaatcaacagtcaggcaycgcaagtggggtctcatacataatgaattgtgcttaagcctcatgggcttcttgatagaaaaataaaagaaaacacaagtgcagtaagcttttgaataaaatttaactagattgctctgcatcctgtaattgttttggaatctttagggacctgatcattcatctatagttttggggtgtttttatcttcatctgtcaaatagtagagacttttaatgatatgttaaaatgttgataaaatacaattttccttttaatgatttgaacatttggaggggggaggtaaataggctttttaag

SEQ ID NO: 166172 - DNA, 601 bp, Human
agtaaagatctgctgacttgacagccagagctcctcacagccctcctgcaagcactcatggaacccggccttctccaggaagacctcctgtttacttctgcgctaggaatgggctgtgctcatcacttacttccctgtcttatatgatgtccttttgtacagaatgcatctttaaaataggccctacaactaaacacataacagtcaatcagtagactcacctgtgataagtgggaggccctcttgtaccagaaagtttaaaaaaaaaaatacattactcatacctgtcattgtttgttaygtaaacttaagcatatttttgatgttttgtgcgtgtttattcacttcttcctttcatagttgaacacatcttgttcttgaggttgcgttggaaatcagtagggtggcgcatgaatcactgagaacagcccacagtgtgtggtcagtgccatcgtcatcatcgtcatcagcaacggcagctcaagaccagcaaggccgcggttgtgtctgtcatgagcccgttggcatgccgtttgttttttatctttgccacagttgcactgttgagatccatgtttcctattactaacatcagcacttt

SEQ ID NO: 166173 - DNA, 601 bp, Human
gtacagaatgcatctttaaaataggccctacaactaaacacataacagtcaatcagtagactcacctgtgataagtgggaggccctcttgtaccagaaagtttaaaaaaaaaaatacattactcatacctgtcattgtttgttacgtaaacttaagcatatttttgatgttttgtgcgtgtttattcacttcttcctttcatagttgaacacatcttgttcttgaggttgcgttggaaatcagtagggtggcgcatgaatcactgagaacagcccacagtgtgtggtcagtgccatcgtcrtcatcgtcatcagcaacggcagctcaagaccagcaaggccgcggttgtgtctgtcatgagcccgttggcatgccgtttgttttttatctttgccacagttgcactgttgagatccatgtttcctattactaacatcagcacttttaattttccgtttctactcagtttcctaaaagaactatagaatattcaaataattgcatgcgctttgtcaaacgtacatggtcatagtgcccaaacagttgctggccaccacgcagagccacggagcagtcactgccatgttccttcgcagcctcc

SEQ ID NO: 166174 - DNA, 601 bp, Human
gccacggagcagtcactgccatgttccttcgcagcctccttggggcctccatgaaacatcggggccaatggaaggcggaagtgctgtttctgatgttgacctgtgtgtttgaccctcaccttcccttcctgcgcagtcggctgtcaactccagaggaagggacagccctgagtcagtattctcaccactaaccgcatgcatttcagatcctcagtaaatgattgaatgaaattaagccactgcatttgtctgaaatatagagtcaaaaggttttattcagcctcctgtttaaaataaaatkatctttattaagagcaggtagcatagtttatttcttttcttcagtcttacccctgaaagaaaacatctgagctttagcaggaagttataattaaatgcaggacaaatccatcaaacacaagacactctgctagagatctctaaatgggacataattgtgcatttaccagtgatatttagcaagagtctccatgcagcgtggataatctttggctgaaggcatgttccttcctacatgagccccggagtctgctgctctgcccttcagtcccgaagcctctcctggccctccacaccaggt

SEQ ID NO: 166175 - DNA, 601 bp, Human
ccaagtcaaagaaagtgaaagccaccagtgtcatgatatttgcctcgggattattctgtgggtgacacgtgatgtcctaggagaggcctaggggaggtgcgactctgatgggctctgagtgtttccccaccaatgctgggagagggtcttgtctcctgcagggttcaagggatgggataggaaggggctgaggtgccaggcaaaagtcttgtctcctgcagggtttgagggatgggacaggaaggggctgaggtaccaggtgagggtcttgtctcctgcactggctcctgctggcatcatsagctggcatccgtggcagcccccggagctgcaggatttgggcttccgagcaaaggtgctcccccggcaaggatggggcggaccacagggccggcatttcagtggtgggtgagttgcagggcccctggggaagactgggacgtggcatttccatgagcgtgggctacggagcccgtaattgttagtgtttcagggtttgccagtggggaagcttgaggaactcccccgtgataagcgccgccgtgagagaggccatcaccccagctcttcttccagggccgagcgcggcagggaaggagga

SEQ ID NO: 166176 - DNA, 601 bp, Human
cagaggtagtgcaggagacaagaccctcacccagcgcctcagccccttcctgtcccatccctcgaaccctgaaggagatgtcagctgagctcttgctgcaggaggtgccaggcccaggtggcttgatcaggggttttgtttcctcagttgaaggtcggggcacatgggccccatcacgcttgctcttcctgtctgggcagtggtggttgacagcagccagctctgcatcactcaggagggagccggggctaaccctcactgcacagggcttccacccctctgttcggccgccttccccggrgatcaggacagcaaagtacattacatatttctccatcgttcttcttagatagcatcagtacactgtttattcgcttagcaaagagcagagcaagaattgaatgactgaaggtgtgtctctgaaattgaataatgtttaagccaagcagaagttctcctttccgtggccagacctcactaacggggaaggaaattgggcagtgaaaagacagcactcccatgccctaaggaaactctgagagaggccacttcgttgcctgctcggcaggcccattctctgcctgcagagtgagcccggctt

SEQ ID NO: 166177 - DNA, 601 bp, Human
aagggtactgggctgaatgagggcactgtctgcgtgagttcccttgggcagggatctgggtaaggcggcagtttggagaagaccggggcatgttctgtctggccgcagtgtccacggggtcagcgtaatttagccggctctgctgggcttggttcacaggtccgactgctggtcacagttatccgtggctgtcggtcatcctagtgagcttccttctttttcccttcattctctggctccttccttaaaaccgtcaggatttgtgtgcttggaaacctctgaccaccctcctgctccaccrtgaaaaacagtgtatgggggcccctatgtgcatctcacccaaaaaggtccatttttagaaagacccgaggatctcggcagagacttttacacccacaaaatgctccagcccagagacccagcctccagcacaggacagcgtgtgagactggcccgaggtcttccatcgccgcccctgctgtcggatgacatgcacatttctgcacctgcaggacctcaaagcgaagtaaccctggacacacccttcactgggtctctttcccccacatctcccccaacaatggaaggcaagcaccgctcc

SEQ ID NO: 166178 - DNA, 601 bp, Human
gagcttccttctttttcccttcattctctggctccttccttaaaaccgtcaggatttgtgtgcttggaaacctctgaccaccctcctgctccaccgtgaaaaacagtgtatgggggcccctatgtgcatctcacccaaaaaggtccatttttagaaagacccgaggatctcggcagagacttttacacccacaaaatgctccagcccagagacccagcctccagcacaggacagcgtgtgagactggcccgaggtcttccatcgccgcccctgctgtcggatgacatgcacatttctgcamctgcaggacctcaaagcgaagtaaccctggacacacccttcactgggtctctttcccccacatctcccccaacaatggaaggcaagcaccgctccacacgaaaataacaacacgggtgcagttctgtgcctctccttagcttctccctgccgccccgtgggcttggtcatggtgtcaccacgcactgtagatgtcgcagacgcaggcccatggccgtgtgtgcccctgggcatgtctgctgtcttctggggaaatggaaacgccaccataggcatttactcaggcagaagctccagaact

SEQ ID NO: 166179 - DNA, 601 bp, Human
catgagggcccaccaggtcgaagccacagatgaatgaacaccccaaacagaagcagccacaaaacagtctgaagcgactcccagaggtacaggttcaaactgcaggaaatcaaagggaggagagtgtccagaaagaaccaagagggccgcgcagtagctcacacctttaatcccagcagtttggggggcccacgcgggcggatcacctgaggtcaggagttcgagaccagcctggccaacgtgatgaagccaacatggagaaaccccatctctactaaagatacaaaaagttagctggccrtggtggcagtcgcctgtaatcccagctactagggaagatgaggcagaagaatcacttgaacccgggatatggaggttgcagtgagccaagatcgagccattgtactccagccacggcaacaagagcaaaactccgtctcaaaacaaacaaacaaacaccaggaaggtttgagaaagaaccaagtagacacaggcacacgaggcacagggctgcccccgagaggacagactcaccgatgaaggaaacacagagtaggccctctggagcgtgggaatcaggggactgcaggtaaaccctgag

SEQ ID NO: 166180 - DNA, 601 bp, Human
agggacactgtcacttgggttgccttgcgctgtgatgcagactctcagaacacacgtcctgggaggcctgaaggtggagagtggttgcggggcctcggtgcgtccttgcctcaccagtccccctttctgctgcacagctagttgagacgtgtgtgcccatgaagcagccacaggtgtttgcccgtttagatgcagtaggtgtttgcttttccgatgtgtggaggcagggcccagaggtttactaagcccctgttctcacttttgcagtgccgtggaggtcccagcccccgctgcggttctyggaggtccggagcccctgatgcagtgcacagcctggctgaatgcctatttccaccagcccgaggctatcgaagagttccccgtgccggctcttcaccatcccgttttccagcaaggtcggtaactaagccatctgcggtgtttcctttggggagcttgacttattaacgatcgctgacatcacagttcattttattgagtataccaacttggtatttttacatcagctaaacagaggcagcgtttggccgagctggagggacgggggttcgccgcctccacccactccaacacttgtgtt

SEQ ID NO: 166181 - DNA, 601 bp, Human
gcctcggtgcgtccttgcctcaccagtccccctttctgctgcacagctagttgagacgtgtgtgcccatgaagcagccacaggtgtttgcccgtttagatgcagtaggtgtttgcttttccgatgtgtggaggcagggcccagaggtttactaagcccctgttctcacttttgcagtgccgtggaggtcccagcccccgctgcggttctcggaggtccggagcccctgatgcagtgcacagcctggctgaatgcctatttccaccagcccgaggctatcgaagagttccccgtgccggctyttcaccatcccgttttccagcaaggtcggtaactaagccatctgcggtgtttcctttggggagcttgacttattaacgatcgctgacatcacagttcattttattgagtataccaacttggtatttttacatcagctaaacagaggcagcgtttggccgagctggagggacgggggttcgccgcctccacccactccaacacttgtgttagttttggcacagggttgcataattcttggcaaaggcaataaaaatgaagcatgcagatcgactcttgactctcgctggctgaaaggttta

SEQ ID NO: 166182 - DNA, 601 bp, Human
tgatgcagtgcacagcctggctgaatgcctatttccaccagcccgaggctatcgaagagttccccgtgccggctcttcaccatcccgttttccagcaaggtcggtaactaagccatctgcggtgtttcctttggggagcttgacttattaacgatcgctgacatcacagttcattttattgagtataccaacttggtatttttacatcagctaaacagaggcagcgtttggccgagctggagggacgggggttcgccgcctccacccactccaacacttgtgttagttttggcacagggtygcataattcttggcaaaggcaataaaaatgaagcatgcagatcgactcttgactctcgctggctgaaaggtttaaataggaacacatctgaatggcagtaaatttttcaataagcttattgtgaacttcaactatctgcttgccaacagcacagaaaacgagacttgtgcgtggacatttagctatttccatacactctgttggtgacacttacatcatagcaggtagcagcattggagcttctcaaataattttacatttaatttctcaaacgtaccagagttagacatattctttctt

SEQ ID NO: 166183 - DNA, 601 bp, Human
gtcagacaggcgaacatatgaagtcatgagcacgttttgtgcataatgaactgaagctgtgcagctataatgaaccaggcaccttgctgtcctctgaatcatacagaactgtctccagaagggttcagtggggatctctaggatgggcagataggaagctagagtgggtgggcctttacatggaaccacaaacgtccaagaaacctctcatcatctctgcccaccaatgggccgctgccaggacaaaggcactaccaaagcctcctgggctgccgccagctgggggccacctctccccagygccacaagccagtgagccaattagacggtgtgggggaccttgctcactgtgcacctgatgggccgggcacagggcaggatgttgctgaatggcccaaggaagtcagagattggttttgtttattaaagttggggcttggggatcttagagtggtgaactcttctctatacgatctctttttgggggttcgcctgccaggaggagcaaggctgaagagctgtccagaggcttttcttctccttaagcctgtgaaatatgtgagctgaaatgtaaggtctcaggacagaaaagttctcttac

SEQ ID NO: 166184 - DNA, 601 bp, Human
tacccctgcctccctggctttcagcccacgccaggccaggctgcttcctgggctggcaggtcatgataggtcttggtgaccaggaagacctcagagtagccgccaggatactggtaaaggctgtctggctcccccgtggccctgcccctcttggaaagccctacagtgcgggtggatacctctagctgggacgaggtccactccagccaagttttgggatggtagtgcgacagccgctcacatccttctctcttggtgttctagaactctgaggctggctgcagacccagggtgctgagckcagggccttctctcgagggtaggggctggagtcccctgggccaggcctgcctgcggatggttagtggttgctgtgggggctgggattccccaccacagcatgtgtaagccaggtttttaacatttagctcaatcgtttactcctgggcaggggccaggtgtatggattttactgtttgaagaaggggaggtggatggtggatggttgctaacagggagttaattggttctcccagatgtggatacgcccctctctgtctggcatgagtttggtttgctctctgtccaggttgttatcttg

SEQ ID NO: 166185 - DNA, 601 bp, Human
ttactgtttgaagaaggggaggtggatggtggatggttgctaacagggagttaattggttctcccagatgtggatacgcccctctctgtctggcatgagtttggtttgctctctgtccaggttgttatcttgtaacatcagtgaaatcaacagtgaggggccaggtcttctagaggaaaagtcttttgacatctcagagccgcctggaagctgtggagtaacagaaatcaacctgctttgcagactgagaggagcgggtccattgtaacatggaatgaacatttccttgaccaattccttyttctgcacattttaatttctgtatatgtttaacatacttttgcatatcatttttcaccatagtctcacttctgagattgagaccaggtttatctatttcaacctggtttgtctatgtcaacatttttaaaaatgtgattgtatttgagctcatccttgagttccagcacattgaccatttctttctgaaggcctggctggtaaaacttctgactgcgcagtaccaagccctcatcccttcctcaggcctgtcctgctgctgaaagaccctctctcctgcacacggcctcttcgcggtacc

SEQ ID NO: 166186 - DNA, 601 bp, Human
gtaacagaaatcaacctgctttgcagactgagaggagcgggtccattgtaacatggaatgaacatttccttgaccaattcctttttctgcacattttaatttctgtatatgtttaacatacttttgcatatcatttttcaccatagtctcacttctgagattgagaccaggtttatctatttcaacctggtttgtctatgtcaacatttttaaaaatgtgattgtatttgagctcatccttgagttccagcacattgaccatttctttctgaaggcctggctggtaaaacttctgactgcscagtaccaagccctcatcccttcctcaggcctgtcctgctgctgaaagaccctctctcctgcacacggcctcttcgcggtaccacctcaccttccaggattcctctctggaacgaacatgctgtttgtgatttgctttttaaggctaaccacaaaaatatgcattacgttgaaccatatgaaattgctattttttaggttaaaacttatcaaataccagaaatttcagatggttcaacttcttatcttggggaatttccaaagacaggttagtagctaggtagctgttgaagtatttctg

SEQ ID NO: 166187 - DNA, 601 bp, Human
tttcaccatagtctcacttctgagattgagaccaggtttatctatttcaacctggtttgtctatgtcaacatttttaaaaatgtgattgtatttgagctcatccttgagttccagcacattgaccatttctttctgaaggcctggctggtaaaacttctgactgcgcagtaccaagccctcatcccttcctcaggcctgtcctgctgctgaaagaccctctctcctgcacacggcctcttcgcggtaccacctcaccttccaggattcctctctggaacgaacatgctgtttgtgatttgytttttaaggctaaccacaaaaatatgcattacgttgaaccatatgaaattgctattttttaggttaaaacttatcaaataccagaaatttcagatggttcaacttcttatcttggggaatttccaaagacaggttagtagctaggtagctgttgaagtatttctgccaagggacagtgaagctgcctttcccgaccaggtgtccggaggtccccggggctgcctcattgtgaggttgggacaggtgggatttcccagtgggagggcgctgaggctctggaaggaagcctcattgttctgc

SEQ ID NO: 166188 - DNA, 601 bp, Human
ctgaaggcctggctggtaaaacttctgactgcgcagtaccaagccctcatcccttcctcaggcctgtcctgctgctgaaagaccctctctcctgcacacggcctcttcgcggtaccacctcaccttccaggattcctctctggaacgaacatgctgtttgtgatttgctttttaaggctaaccacaaaaatatgcattacgttgaaccatatgaaattgctattttttaggttaaaacttatcaaataccagaaatttcagatggttcaacttcttatcttggggaatttccaaagacagrttagtagctaggtagctgttgaagtatttctgccaagggacagtgaagctgcctttcccgaccaggtgtccggaggtccccggggctgcctcattgtgaggttgggacaggtgggatttcccagtgggagggcgctgaggctctggaaggaagcctcattgttctgctgaagggattaagaggaaagctgagctgtccagtgaagcatattctaatttctcgttcaagtgttgttttagtcaggtcatttcctaaaataaaattagtcaaagttttcttggtttggggttttttggcttt

SEQ ID NO: 166189 - DNA, 601 bp, Human
aatatgcattacgttgaaccatatgaaattgctattttttaggttaaaacttatcaaataccagaaatttcagatggttcaacttcttatcttggggaatttccaaagacaggttagtagctaggtagctgttgaagtatttctgccaagggacagtgaagctgcctttcccgaccaggtgtccggaggtccccggggctgcctcattgtgaggttgggacaggtgggatttcccagtgggagggcgctgaggctctggaaggaagcctcattgttctgctgaagggattaagaggaaagstgagctgtccagtgaagcatattctaatttctcgttcaagtgttgttttagtcaggtcatttcctaaaataaaattagtcaaagttttcttggtttggggttttttggcttttttggtttgctattctggtttttttaaagtgtcaacaaaatccattttctagctactgtgtgaccgagggctagcatcttgtcgtacaacgtagctttttaaggaggtaattttttcccataagcctctcgcaagggtcagctttgtatttatttctaattcatttttcctcaagaaatacttattta

SEQ ID NO: 166190 - DNA, 601 bp, Human
ttttgtatttttgtgtctccatcgaattcctcatttcaaaagcgcctctaacaaaagccctgccccagagttaagggaaagggccttcagggtgaattcgttaaggttcccaccgtgtcctggaagatgggccctctttgctggtgcttctagtgaggactgcttgggtcctggaaggggcatgtcccgggagaggatgacgagggaggagaggagaagagagtggcgtcattacttgggtcctcaccggagccagccctttaagattagaaatccttcttgaagagccaagcaaaggctyatccagccccctacaaccccatcctgctgcctactcacatccaggaaagagcccacccctgatgggtgcccaagtagatggcctcccctggaaagaggcatattagccctcctcacccgagggtcctagggcccgtttgggtgttcttaaaatgtgccctataagtcgtgatccagcctgagtttttctacagagacactgcagccaagaggggatgtttttctcgtagcttccacatagatcacggcagcacgcaggctttgtcctttcagcactttgtaccgatattttccctgaact

SEQ ID NO: 166191 - DNA, 601 bp, Human
ctgcttgggtcctggaaggggcatgtcccgggagaggatgacgagggaggagaggagaagagagtggcgtcattacttgggtcctcaccggagccagccctttaagattagaaatccttcttgaagagccaagcaaaggcttatccagccccctacaaccccatcctgctgcctactcacatccaggaaagagcccacccctgatgggtgcccaagtagatggcctcccctggaaagaggcatattagccctcctcacccgagggtcctagggcccgtttgggtgttcttaaaatgtgccytataagtcgtgatccagcctgagtttttctacagagacactgcagccaagaggggatgtttttctcgtagcttccacatagatcacggcagcacgcaggctttgtcctttcagcactttgtaccgatattttccctgaacttaagaaaaaaattaccaattgaaagagaagagaatagctaaaataggagatgcatttgccaccacgtgtgggtggccaccgctgttccccttgattttaaacgagggctcataaatattgttgaccttgctgagatattacctggtggagctggaaggt

SEQ ID NO: 166192 - DNA, 601 bp, Human
gcgtcattacttgggtcctcaccggagccagccctttaagattagaaatccttcttgaagagccaagcaaaggcttatccagccccctacaaccccatcctgctgcctactcacatccaggaaagagcccacccctgatgggtgcccaagtagatggcctcccctggaaagaggcatattagccctcctcacccgagggtcctagggcccgtttgggtgttcttaaaatgtgccctataagtcgtgatccagcctgagtttttctacagagacactgcagccaagaggggatgtttttctygtagcttccacatagatcacggcagcacgcaggctttgtcctttcagcactttgtaccgatattttccctgaacttaagaaaaaaattaccaattgaaagagaagagaatagctaaaataggagatgcatttgccaccacgtgtgggtggccaccgctgttccccttgattttaaacgagggctcataaatattgttgaccttgctgagatattacctggtggagctggaaggtttgtaaaccttcttccgatgcccgtttattgattagaacaagctaacaacactgcacttaagtgga

SEQ ID NO: 166193 - DNA, 601 bp, Human
tcctttcagcactttgtaccgatattttccctgaacttaagaaaaaaattaccaattgaaagagaagagaatagctaaaataggagatgcatttgccaccacgtgtgggtggccaccgctgttccccttgattttaaacgagggctcataaatattgttgaccttgctgagatattacctggtggagctggaaggtttgtaaaccttcttccgatgcccgtttattgattagaacaagctaacaacactgcacttaagtggaaaaaacagctggtaaaaatgtaattctttcagccttagrgctgctgtgctccttttctggagagcaaatgtggaaatcaagatctgtggccttctggaaccttcaccaggaaaggtgaaaagaagaagaacccatccacagctgagagtggatggcaggcccgcgggtttccaggtggccagtaggattgtccgatgtctggaatgagtaccggggccgccaccaggaacacttgtcatttctaccatggagaggaaagcccagtgcatttctgtggttcagaaacttgacacaaagagaaaagctggaatgtttaaaagcaaaaatagggcagagatc

SEQ ID NO: 166194 - DNA, 601 bp, Human
aaacgagggctcataaatattgttgaccttgctgagatattacctggtggagctggaaggtttgtaaaccttcttccgatgcccgtttattgattagaacaagctaacaacactgcacttaagtggaaaaaacagctggtaaaaatgtaattctttcagccttagggctgctgtgctccttttctggagagcaaatgtggaaatcaagatctgtggccttctggaaccttcaccaggaaaggtgaaaagaagaagaacccatccacagctgagagtggatggcaggcccgcgggtttccargtggccagtaggattgtccgatgtctggaatgagtaccggggccgccaccaggaacacttgtcatttctaccatggagaggaaagcccagtgcatttctgtggttcagaaacttgacacaaagagaaaagctggaatgtttaaaagcaaaaatagggcagagatcagtgaaagtgcaggatgtgtgtgaaacaagggtagagtgagcactggtggggatggaggtggtgaggggtcttctgagctggggacgtttacttacaccagccctgcctcccaagaacccatcccctgtgggtcc

SEQ ID NO: 166195 - DNA, 601 bp, Human
ttcttgctgtttatactatgaacaacatcttgggctaggagagagtttttaaagtttcaacaatgattcattcaagcactttcctttttcaagttactcatatctcagttcattcaatggggttgggggatttatatcagaatcctctagacatttcatttataatattctacctataaatttttatacttcttacccctcctcaagatacactaaaaccttagcatgggcacacgcacacacataccctgtttctgagaattattgttctaaaggaatttatcaaaatggatgtagctcytatgaatgcttttgctgtgtgctttaccctctactaagcctaacattcctaatttaatagctatttttgtttgagacttaaaaactgtgcgcattgaaggaatgttttgccgttgaggaaatgccagcccctctcctaggaaaggggtgctcggctcctggtccactggcagtggctggaacagaaccacagcctgctgaatcccaggaaattcatggtgtccctgtgcagagccctctgactaatcagcgatcccacaatgcctgtagcagaagcatagttaggtgagagttttatcct

SEQ ID NO: 166196 - DNA, 601 bp, Human
ccttagcatgggcacacgcacacacataccctgtttctgagaattattgttctaaaggaatttatcaaaatggatgtagctcctatgaatgcttttgctgtgtgctttaccctctactaagcctaacattcctaatttaatagctatttttgtttgagacttaaaaactgtgcgcattgaaggaatgttttgccgttgaggaaatgccagcccctctcctaggaaaggggtgctcggctcctggtccactggcagtggctggaacagaaccacagcctgctgaatcccaggaaattcatgrtgtccctgtgcagagccctctgactaatcagcgatcccacaatgcctgtagcagaagcatagttaggtgagagttttatcctgaatgtaagaggtggccaggtccttagttccctgaggttccgtgagtcgggggtaaaggaagcagccctcacacagagtaatttaccaagcctgagagggaaccaagaggactgtttgagagtcagccacttccaaaccttggtggacataacgagggtctctactacaataagcaggacttgtaatatgtaaaattattatgagtgctgcttttatg

SEQ ID NO: 166197 - DNA, 601 bp, Human
tatatgttgtttcatgtgtcagaatggaaaaagcaaatatttacgtagagggaactcctccctcctgttggaggtacgcggcggtcagtgtagcttccgaggccgcgtggagatgggaacatcctcaagacagagcagacttcctggaggctcagccggaacgtctccagctctgtagcacgttttaattccatacaagaagttactcccaaagaagtaaattgaagaacgaaatcgaggaaaagaaagtccttttttgaaagctcttaaacacttgactccgtttagttcggatcaggcyttctctgcccttccaaagattcaggttaggtattggtaacgcccaggaagcacccactctggcgagcccaccctctccgccagtaaatatatacagtgtagctgttactatgacaacgacttttttttcttgagtactgtttttaattgttgcacaaacacatattgtgtaagaaaggggaattgtccatagtcttccacgtgtggatgtgtgtgcccacactgtctgctttctttaaaaatgcacattcctttctggattgggctccgcgatcccccgcctgccaagcaacctgatttt

SEQ ID NO: 166198 - DNA, 601 bp, Human
cctgttggaggtacgcggcggtcagtgtagcttccgaggccgcgtggagatgggaacatcctcaagacagagcagacttcctggaggctcagccggaacgtctccagctctgtagcacgttttaattccatacaagaagttactcccaaagaagtaaattgaagaacgaaatcgaggaaaagaaagtccttttttgaaagctcttaaacacttgactccgtttagttcggatcaggccttctctgcccttccaaagattcaggttaggtattggtaacgcccaggaagcacccactctggygagcccaccctctccgccagtaaatatatacagtgtagctgttactatgacaacgacttttttttcttgagtactgtttttaattgttgcacaaacacatattgtgtaagaaaggggaattgtccatagtcttccacgtgtggatgtgtgtgcccacactgtctgctttctttaaaaatgcacattcctttctggattgggctccgcgatcccccgcctgccaagcaacctgattttctcttcagcctttcctcacttagatggttttagtaagacctagcaaccgagctcaagagacac

SEQ ID NO: 166199 - DNA, 601 bp, Human
tggaggtacgcggcggtcagtgtagcttccgaggccgcgtggagatgggaacatcctcaagacagagcagacttcctggaggctcagccggaacgtctccagctctgtagcacgttttaattccatacaagaagttactcccaaagaagtaaattgaagaacgaaatcgaggaaaagaaagtccttttttgaaagctcttaaacacttgactccgtttagttcggatcaggccttctctgcccttccaaagattcaggttaggtattggtaacgcccaggaagcacccactctggcgagcycaccctctccgccagtaaatatatacagtgtagctgttactatgacaacgacttttttttcttgagtactgtttttaattgttgcacaaacacatattgtgtaagaaaggggaattgtccatagtcttccacgtgtggatgtgtgtgcccacactgtctgctttctttaaaaatgcacattcctttctggattgggctccgcgatcccccgcctgccaagcaacctgattttctcttcagcctttcctcacttagatggttttagtaagacctagcaaccgagctcaagagacacgtcag

SEQ ID NO: 166200 - DNA, 601 bp, Human
tacagtgtagctgttactatgacaacgacttttttttcttgagtactgtttttaattgttgcacaaacacatattgtgtaagaaaggggaattgtccatagtcttccacgtgtggatgtgtgtgcccacactgtctgctttctttaaaaatgcacattcctttctggattgggctccgcgatcccccgcctgccaagcaacctgattttctcttcagcctttcctcacttagatggttttagtaagacctagcaaccgagctcaagagacacgtcaggacttactgcttgcccaagacatrtacttttcatagaaaattcgcgtctcttcctcttttcagaataaaatatgcaagaaccaacagaaatggcacattcccctgcttttccccaagaattgggcctttgatgttcaagagcagctgatattaaaggctatccctagaaggctgtagaaactgtacctatttatgacaaatgtaaaacagcacaaatctagctgaatgtgatggtatcattagtttgtgaatcgcatccttgaaaataactgtgaaggagccaaatcggtttaaaagaagataacaaaatggtttaagctactt

SEQ ID NO: 166201 - DNA, 601 bp, Human
gcctgctaaggcgtgtcaccttccgctcaggtgtgtcacctttctgagatgtctagagccagtccacgtgcctgctcaggcacatcaccttcctaggctgtctagaggcagtctgtatgcttgctcaggcatgtcaccttctgctcaggcatgtcaccttcccgggatgtctagagctagttcgtttgcccgctcaggtgcatcaccttccgctcaggtgtgtcccctttctgagatgtctagagccggtccatgtgcccgctcaggtatgtcaccttcctgagatgtctagagccggtcygtctgcctgctcaggcgtgtcaccgtcccaggctgtccagagccgatctgtgtgcccattcagctgtgtcaccttctgctcaggcatgtcaccttcccgaggtgcccagagctggtctgtgtgcccgctcaggcgtgtcaccttctgctcaggcatgtcaccttcccgggctgtctagagctggtccgtgtgtccactcaggtacgtcaccttcccaggctgtctagagccagtccgtgtgcctgctcagatatactgtcaccatgtgggccctactcttgtgtcagggccattagctgg

SEQ ID NO: 166202 - DNA, 601 bp, Human
cgtcaccttcccaggctgtctagagccagtccgtgtgcctgctcagatatactgtcaccatgtgggccctactcttgtgtcagggccattagctggcacatgctgtgtggttgcctggtgcgcgctggggcaacctcgggaaacactcttagcctttgtattgatctgtgcaggctgccaaaacaaagtgatgccaactggggtcttatacaacagaaatctttctcagctctggagcctggaagtccgagaccgaggtgcggcagggtgtcagctactcagaccaaggtgctgaggctgycctgcttgccctgcagatggccgtctccttgctgcgtcctcactaggcctttcctctgggcgtgcatcgctcgggtctctatatcataatctccccttcttagaaggacaccagtcagatgggattagggctacctgaacaaccgaatgagaacttcttcacctcttaaagaccccatctgctgatacagttgaaatgccgagggtcagggctgcaacatacgaattttggcagaacatagtttagcccataacaccctttccgagcctctgattatctgtctgtaaagtggggacagta

SEQ ID NO: 166203 - DNA, 601 bp, Human
ctctgtgcttcactctgcactagctggttcctgagtaccaggaggcattctctgatatgctatggatacagttatggacaaaatggactcttaggaaggcagcaagtaaggggaatggaggggcaaagagcacacagctaaagattgcctgactcaactgtggtagtcactggtgcactgcaggttggcatttgcaccctgctagcatgtgctcctgaaactggggccggagagctttcttctctgtctgagcactcagagcagtgcctgccaatgctgtgacaatgaacgaatgaataarcaaaatgtcaacccattttcagagttttgtttaatgtccctggacctggatctctcttgagagtgagcattgaatgggccttccctgcccctactgagagctcagggcatggaccccaaacgcttgggtctctcctcttccctcttctgttgtaaatttaaatgtcagggggaaaaaaaaaaaagcaagaaaaatatgtaaataaatacatttgcaatcatatgttatcggatgagaagggtagcggtttcaagagttacattcagagtaatcgttgagcacattgatggcaagttgata

SEQ ID NO: 166204 - DNA, 601 bp, Human
tgcactgcaggttggcatttgcaccctgctagcatgtgctcctgaaactggggccggagagctttcttctctgtctgagcactcagagcagtgcctgccaatgctgtgacaatgaacgaatgaataagcaaaatgtcaacccattttcagagttttgtttaatgtccctggacctggatctctcttgagagtgagcattgaatgggccttccctgcccctactgagagctcagggcatggaccccaaacgcttgggtctctcctcttccctcttctgttgtaaatttaaatgtcagggggaaaaaaaaaaaagcaagaaaaatatgtaaataaatacatttgcaatcatatgttatcggatgagaagggtagcggtttcaagagttacattcagagtaatcgttgagcacattgatggcaagttgatagtttcgttattatgaaatatttactttggacaaaggagtattcaaaactgacttacgaggtataaataataaaggacaaagtcatatatatgccacccaggtgatgtaataatttgttttcttcccttctgtcagtagacatttgggttctgaagtttttgcctttaaaacta

SEQ ID NO: 166205 - DNA, 601 bp, Human
tctctgtctgagcactcagagcagtgcctgccaatgctgtgacaatgaacgaatgaataagcaaaatgtcaacccattttcagagttttgtttaatgtccctggacctggatctctcttgagagtgagcattgaatgggccttccctgcccctactgagagctcagggcatggaccccaaacgcttgggtctctcctcttccctcttctgttgtaaatttaaatgtcagggggaaaaaaaaaaaagcaagaaaaatatgtaaataaatacatttgcaatcatatgttatcggatgagaagrgtagcggtttcaagagttacattcagagtaatcgttgagcacattgatggcaagttgatagtttcgttattatgaaatatttactttggacaaaggagtattcaaaactgacttacgaggtataaataataaaggacaaagtcatatatatgccacccaggtgatgtaataatttgttttcttcccttctgtcagtagacatttgggttctgaagtttttgcctttaaaactaatgatgttacagatattctaggttgtgtgccctagtgctccagctggctggaattcatgggcggagt

SEQ ID NO: 166206 - DNA, 601 bp, Human
cctactgagagctcagggcatggaccccaaacgcttgggtctctcctcttccctcttctgttgtaaatttaaatgtcagggggaaaaaaaaaaaagcaagaaaaatatgtaaataaatacatttgcaatcatatgttatcggatgagaagggtagcggtttcaagagttacattcagagtaatcgttgagcacattgatggcaagttgatagtttcgttattatgaaatatttactttggacaaaggagtattcaaaactgacttacgaggtataaataataaaggacaaagtcatatatrtgccacccaggtgatgtaataatttgttttcttcccttctgtcagtagacatttgggttctgaagtttttgcctttaaaactaatgatgttacagatattctaggttgtgtgccctagtgctccagctggctggaattcatgggcggagttcgcgagaagagggaactatacagagaaagaattccagaggtctgcatggtatcccattgagtctgttgcagattacaaagtcatacatgcatttgtaaaccacatgaaaccagacaactattggggaactataagttgaacaaatttca

SEQ ID NO: 166207 - DNA, 601 bp, Human
aaaaaaagcaagaaaaatatgtaaataaatacatttgcaatcatatgttatcggatgagaagggtagcggtttcaagagttacattcagagtaatcgttgagcacattgatggcaagttgatagtttcgttattatgaaatatttactttggacaaaggagtattcaaaactgacttacgaggtataaataataaaggacaaagtcatatatatgccacccaggtgatgtaataatttgttttcttcccttctgtcagtagacatttgggttctgaagtttttgcctttaaaactaatgaygttacagatattctaggttgtgtgccctagtgctccagctggctggaattcatgggcggagttcgcgagaagagggaactatacagagaaagaattccagaggtctgcatggtatcccattgagtctgttgcagattacaaagtcatacatgcatttgtaaaccacatgaaaccagacaactattggggaactataagttgaacaaatttcagataagtgaacctcactagaactagaaaatatgtggacaagtatgaaaattttcttctattattttatttaaaagatgattaactgtt

SEQ ID NO: 166208 - DNA, 601 bp, Human
gttgatagtttcgttattatgaaatatttactttggacaaaggagtattcaaaactgacttacgaggtataaataataaaggacaaagtcatatatatgccacccaggtgatgtaataatttgttttcttcccttctgtcagtagacatttgggttctgaagtttttgcctttaaaactaatgatgttacagatattctaggttgtgtgccctagtgctccagctggctggaattcatgggcggagttcgcgagaagagggaactatacagagaaagaattccagaggtctgcatggtatsccattgagtctgttgcagattacaaagtcatacatgcatttgtaaaccacatgaaaccagacaactattggggaactataagttgaacaaatttcagataagtgaacctcactagaactagaaaatatgtggacaagtatgaaaattttcttctattattttatttaaaagatgattaactgttcatgataaagttaataaagatgtattttgtagtttataatacacgtagaaggaaaacatatgacaacaatagcatagaagatgagactggggaaatggaaatacattgttctaagt

SEQ ID NO: 166209 - DNA, 601 bp, Human
ttgtgtgccctagtgctccagctggctggaattcatgggcggagttcgcgagaagagggaactatacagagaaagaattccagaggtctgcatggtatcccattgagtctgttgcagattacaaagtcatacatgcatttgtaaaccacatgaaaccagacaactattggggaactataagttgaacaaatttcagataagtgaacctcactagaactagaaaatatgtggacaagtatgaaaattttcttctattattttatttaaaagatgattaactgttcatgataaagttaataargatgtattttgtagtttataatacacgtagaaggaaaacatatgacaacaatagcatagaagatgagactggggaaatggaaatacattgttctaagtttcttactttatgaacaagtataatatttaagggcagactttgataaattatgaatgcatattaaaaatcctagaataccagtaaaaataaccagaatctatagctcatgggccaacagaaaagataaaatagaatgctaattcttttattagaattagcatattagaatgctaaaatgtaaaagaagatagggtaaagggg

SEQ ID NO: 166210 - DNA, 601 bp, Human
ggaactatacagagaaagaattccagaggtctgcatggtatcccattgagtctgttgcagattacaaagtcatacatgcatttgtaaaccacatgaaaccagacaactattggggaactataagttgaacaaatttcagataagtgaacctcactagaactagaaaatatgtggacaagtatgaaaattttcttctattattttatttaaaagatgattaactgttcatgataaagttaataaagatgtattttgtagtttataatacacgtagaaggaaaacatatgacaacaatagcayagaagatgagactggggaaatggaaatacattgttctaagtttcttactttatgaacaagtataatatttaagggcagactttgataaattatgaatgcatattaaaaatcctagaataccagtaaaaataaccagaatctatagctcatgggccaacagaaaagataaaatagaatgctaattcttttattagaattagcatattagaatgctaaaatgtaaaagaagatagggtaaagggggaacaaagaacagatgggaaaaataacaagttggcagacttaaacccaatcatatta

SEQ ID NO: 166211 - DNA, 601 bp, Human
ttgtaaaccacatgaaaccagacaactattggggaactataagttgaacaaatttcagataagtgaacctcactagaactagaaaatatgtggacaagtatgaaaattttcttctattattttatttaaaagatgattaactgttcatgataaagttaataaagatgtattttgtagtttataatacacgtagaaggaaaacatatgacaacaatagcatagaagatgagactggggaaatggaaatacattgttctaagtttcttactttatgaacaagtataatatttaagggcagacyttgataaattatgaatgcatattaaaaatcctagaataccagtaaaaataaccagaatctatagctcatgggccaacagaaaagataaaatagaatgctaattcttttattagaattagcatattagaatgctaaaatgtaaaagaagatagggtaaagggggaacaaagaacagatgggaaaaataacaagttggcagacttaaacccaatcatattaataattacattaaatgtaaatgttttaagattcaaataaaaagacatagattagtagactggtttaaaaagccagagcctg

SEQ ID NO: 166212 - DNA, 601 bp, Human
tgaaaccagacaactattggggaactataagttgaacaaatttcagataagtgaacctcactagaactagaaaatatgtggacaagtatgaaaattttcttctattattttatttaaaagatgattaactgttcatgataaagttaataaagatgtattttgtagtttataatacacgtagaaggaaaacatatgacaacaatagcatagaagatgagactggggaaatggaaatacattgttctaagtttcttactttatgaacaagtataatatttaagggcagactttgataaattawgaatgcatattaaaaatcctagaataccagtaaaaataaccagaatctatagctcatgggccaacagaaaagataaaatagaatgctaattcttttattagaattagcatattagaatgctaaaatgtaaaagaagatagggtaaagggggaacaaagaacagatgggaaaaataacaagttggcagacttaaacccaatcatattaataattacattaaatgtaaatgttttaagattcaaataaaaagacatagattagtagactggtttaaaaagccagagcctgttatatattttc

SEQ ID NO: 166213 - DNA, 601 bp, Human
tcttctattattttatttaaaagatgattaactgttcatgataaagttaataaagatgtattttgtagtttataatacacgtagaaggaaaacatatgacaacaatagcatagaagatgagactggggaaatggaaatacattgttctaagtttcttactttatgaacaagtataatatttaagggcagactttgataaattatgaatgcatattaaaaatcctagaataccagtaaaaataaccagaatctatagctcatgggccaacagaaaagataaaatagaatgctaattcttttattagaattagcatattagaatgctaaaatgtaaaagaagatagggtaaagggggaacaaagaacagatgggaaaaataacaagttggcagacttaaacccaatcatattaataattacattaaatgtaaatgttttaagattcaaataaaaagacatagattagtagactggtttaaaaagccagagcctgttatatattttctactagacaaaaataatgtaaaatgatgacagagtcctatgtaaagatggaaggaaaaaaaaaggaatacattgacagaaagatataagtaaaattg

SEQ ID NO: 166214 - DNA, 601 bp, Human
aaaagatgattaactgttcatgataaagttaataaagatgtattttgtagtttataatacacgtagaaggaaaacatatgacaacaatagcatagaagatgagactggggaaatggaaatacattgttctaagtttcttactttatgaacaagtataatatttaagggcagactttgataaattatgaatgcatattaaaaatcctagaataccagtaaaaataaccagaatctatagctcatgggccaacagaaaagataaaatagaatgctaattcttttattagaattagcatattagaatgctaaaatgtaaaagaagatagggtaaagggggaacaaagaacagatgggaaaaataacaagttggcagacttaaacccaatcatattaataattacattaaatgtaaatgttttaagattcaaataaaaagacatagattagtagactggtttaaaaagccagagcctgttatatattttctactagacaaaaataatgtaaaatgatgacagagtcctatgtaaagatggaaggaaaaaaaaaggaatacattgacagaaagatataagtaaaattgtatttattttcagatcac

SEQ ID NO: 166215 - DNA, 601 bp, Human
tcagatcacataattatttacatagaatatcttgaataatgttgaaaataactattaaaaccaataagtgaatttgagaagtttgaggatacaattttaacataaaatgtattctatttttatataatgtaattaaaaagtaaattataaaacagttgctttatgtatttaacattagcattattaaagattattatttaaagatatgcaaggcctctctactaaacagcataaaaacatgactgaaagaaattaaagaagacctaagtaaatggatctttattagttattggaagaggcrgtgttacggagaggtcacatctacacaaattgccctctgcattcagttcagtcacacttttaaattatttcaaaatgcaaagagcctagaatatttaaaacaatcttgaaaaagaagaatgaatttgtaggacttacattacctggtttcaagacttcctacaaatctgtggtaatcaagacactgcagtaaggatcaaaacttagaacagtgcaacagagagagagaccagtgttttttcagttcttgtatctttgagaaagacacaaagtagatcaatgaggaaagtaaagtcttgtt

SEQ ID NO: 166216 - DNA, 601 bp, Human
agatcacataattatttacatagaatatcttgaataatgttgaaaataactattaaaaccaataagtgaatttgagaagtttgaggatacaattttaacataaaatgtattctatttttatataatgtaattaaaaagtaaattataaaacagttgctttatgtatttaacattagcattattaaagattattatttaaagatatgcaaggcctctctactaaacagcataaaaacatgactgaaagaaattaaagaagacctaagtaaatggatctttattagttattggaagaggcggygttacggagaggtcacatctacacaaattgccctctgcattcagttcagtcacacttttaaattatttcaaaatgcaaagagcctagaatatttaaaacaatcttgaaaaagaagaatgaatttgtaggacttacattacctggtttcaagacttcctacaaatctgtggtaatcaagacactgcagtaaggatcaaaacttagaacagtgcaacagagagagagaccagtgttttttcagttcttgtatctttgagaaagacacaaagtagatcaatgaggaaagtaaagtcttgttgg

SEQ ID NO: 166217 - DNA, 601 bp, Human
attggaagaggcggtgttacggagaggtcacatctacacaaattgccctctgcattcagttcagtcacacttttaaattatttcaaaatgcaaagagcctagaatatttaaaacaatcttgaaaaagaagaatgaatttgtaggacttacattacctggtttcaagacttcctacaaatctgtggtaatcaagacactgcagtaaggatcaaaacttagaacagtgcaacagagagagagaccagtgttttttcagttcttgtatctttgagaaagacacaaagtagatcaatgaggaaartaaagtcttgttggccaggcatggtggcttacgcctgtaaccccagcactttgtgaggccatggcaggcggatcacttgaggccaggagttcaagaccagccttgcaaacatagcaagaccctgtctctactaaaaacacaaaaaacagccaagcatggtggtgcacacctgtaatcccagctactcgggaggctaaggcatatgaatcacttgaacccaggagacagaggttgcagtgagctgagatcatgccactgcattccagtttgggtgacagaggaagactctatcacaaaaaa

SEQ ID NO: 166218 - DNA, 601 bp, Human
aaaaagaagaatgaatttgtaggacttacattacctggtttcaagacttcctacaaatctgtggtaatcaagacactgcagtaaggatcaaaacttagaacagtgcaacagagagagagaccagtgttttttcagttcttgtatctttgagaaagacacaaagtagatcaatgaggaaagtaaagtcttgttggccaggcatggtggcttacgcctgtaaccccagcactttgtgaggccatggcaggcggatcacttgaggccaggagttcaagaccagccttgcaaacatagcaagacyctgtctctactaaaaacacaaaaaacagccaagcatggtggtgcacacctgtaatcccagctactcgggaggctaaggcatatgaatcacttgaacccaggagacagaggttgcagtgagctgagatcatgccactgcattccagtttgggtgacagaggaagactctatcacaaaaaaaaaaaaaaaaaaaaaaaaaagtcttgtcaactaatggtgctgagcaactggatatccatttttttttccattccattttcagatcactttaatggttagaaatttgttccataacttattt

SEQ ID NO: 166219 - DNA, 601 bp, Human
atcaagacactgcagtaaggatcaaaacttagaacagtgcaacagagagagagaccagtgttttttcagttcttgtatctttgagaaagacacaaagtagatcaatgaggaaagtaaagtcttgttggccaggcatggtggcttacgcctgtaaccccagcactttgtgaggccatggcaggcggatcacttgaggccaggagttcaagaccagccttgcaaacatagcaagaccctgtctctactaaaaacacaaaaaacagccaagcatggtggtgcacacctgtaatcccagctactygggaggctaaggcatatgaatcacttgaacccaggagacagaggttgcagtgagctgagatcatgccactgcattccagtttgggtgacagaggaagactctatcacaaaaaaaaaaaaaaaaaaaaaaaaaagtcttgtcaactaatggtgctgagcaactggatatccatttttttttccattccattttcagatcactttaatggttagaaatttgttccataacttatttatttccataggtttttggggaacagatggtatttggttacatgagtaagttctttagtggtggttt

SEQ ID NO: 166220 - DNA, 601 bp, Human
gatttgggtaggcacacatttcttataacaccaaaataaaaaacaatgaaagaaattattaataaattaaactttattaaaagacttcattaagtaaatgaggaacaggccacagaatgagagaaatttttacaaaacacatatctgacaaaggacttctaagaagggtatatgaagactctgataactccataaaaggaccaacaacccagtaaataactggacaaaatatctcacattttcatcgcaaagacacataatacacagattggcccctgagctcatgagaaagtgctcggcrtcatcagtcattagggaagtacaggttaaaaccacagtgaaagacatctgcatatatcccagggcagctcagatcagacaccaccaagtgtcgcagagactgccgcagcctcgcctctcgtatacattggtgggtgttaaaatgttgtaacctctttgcaaaaggtctagcagctgcttataaaactaagtgttctcctaccccgctacccaacaattccactctagggcatttatccaggagaaattaaaacctacgtccacaaaaacgtattcaagagtgttcacagcagctttgctt

SEQ ID NO: 166221 - DNA, 601 bp, Human
aacccagtaaataactggacaaaatatctcacattttcatcgcaaagacacataatacacagattggcccctgagctcatgagaaagtgctcggcatcatcagtcattagggaagtacaggttaaaaccacagtgaaagacatctgcatatatcccagggcagctcagatcagacaccaccaagtgtcgcagagactgccgcagcctcgcctctcgtatacattggtgggtgttaaaatgttgtaacctctttgcaaaaggtctagcagctgcttataaaactaagtgttctcctaccccrctacccaacaattccactctagggcatttatccaggagaaattaaaacctacgtccacaaaaacgtattcaagagtgttcacagcagctttgcttgctttatttataattgctgcaattgggaattgcttgtatgtccatctgtaggaaagtggataaattacctgagggatatccatgtagagcctgttcctatctgtgaacttagcattgaaaaggaataatccacagacacacacagcctcgtggatgagtctcggtaacgtcatgctgagcttaaggagccggacacagcaagagc

SEQ ID NO: 166222 - DNA, 601 bp, Human
aagaggaactgcttctggggttgtgcaggcagtgagaaactgggaaggggcatgagggaatgttctagaccatgacggccatggtctatatcttaacaggttaggtcacataggtatctatctgtgtttgtcagaattcatcaaatgatgttgaagatggtacatttcactgtgtgtgtaaattccaccttaaaggaaaaaagaaccataaatggacattgaactcttaatggtatatgtgctgaaggacttggagagagtacactgatgtctgcagcttattttgaaatgcagcaaaaataataataaaatggatatggggtggagagatggatagatatatgataaaaacaaatacaggctaaaatgtcaattatatcatctgaggtataaagctattcattgtaaaactcttccaactctatgtggctggggtttttcataatatgttggaggaaaatagtaaatattatggatttttattccttgaaagcaaatttgggggaaagatcatgaaaactgtggcctccttatcccagatggtgaagatacaacctagtatggcctcagcgagatactgagtgcactctcagtttgcacc

SEQ ID NO: 166223 - DNA, 601 bp, Human
acaggctaaaatgtcaattatatcatctgaggtataaagctattcattgtaaaactcttccaactctatgtggctggggtttttcataatatgttggaggaaaatagtaaatattatggatttttattccttgaaagcaaatttgggggaaagatcatgaaaactgtggcctccttatcccagatggtgaagatacaacctagtatggcctcagcgagatactgagtgcactctcagtttgcacctggagggcagggtgagtctgggaggtctgtgaattgtcagtggacctcccggtccyctccagagccctgcaggatcgggtggatacactgacctgatggacaggaagaggaagcctctgggccagacctttggacactgttgccttactcttcttctctccagccaagcgagtggccttgggaggtgagtgtggtgtcgccttgcagccttgcactcagctttgcagccgtccctgtccagccagcttccacgcaagtggaagacacacagaatccacagcccaggcagctgctctcacctgtgtgtggagcacagggtgcccatcctcagagaccctgcccagcccctcgctgcc

SEQ ID NO: 166224 - DNA, 601 bp, Human
ctgttgccttactcttcttctctccagccaagcgagtggccttgggaggtgagtgtggtgtcgccttgcagccttgcactcagctttgcagccgtccctgtccagccagcttccacgcaagtggaagacacacagaatccacagcccaggcagctgctctcacctgtgtgtggagcacagggtgcccatcctcagagaccctgcccagcccctcgctgccatcccctctgctagaccaggcatgtgggtcagcgctgccctgtctggcccgaagttccatgtcagtagccgtggatcaaaygatgaaggcagagttatctaattacggagtgttttctctaatatttccacagcctgctgctgtcatggaacatggagattcattacttagaatgtcaaattaatagcgttcctggacctgaaacatcattgtgtcaacttctccaccttttccaggtggtggtttgagtttgtgcacatggcatgcctattgccccagcacggccacagctttccaaagtgccgcccagggctggggtctgcccacttcctcggaggtctgtccatgctccgggcaggctacagcctgcaggatgcagat

SEQ ID NO: 166225 - DNA, 601 bp, Human
aagttccatgtcagtagccgtggatcaaatgatgaaggcagagttatctaattacggagtgttttctctaatatttccacagcctgctgctgtcatggaacatggagattcattacttagaatgtcaaattaatagcgttcctggacctgaaacatcattgtgtcaacttctccaccttttccaggtggtggtttgagtttgtgcacatggcatgcctattgccccagcacggccacagctttccaaagtgccgcccagggctggggtctgcccacttcctcggaggtctgtccatgctcygggcaggctacagcctgcaggatgcagatgcccagattggagcagcaccctgtgccctcaagaggagcacagctcacacatccacgtaactcttgtccttagcagtagtgaggggcttctgcaggcagaggagtcggctccacggtcctccatgtaaactaccgggatcaggagcctagggttcaattctgctgtcacgtgtctgcactgtagcctgttctgccttctcaaccagccccttctagctcctggggcagtttctctttagctgaaacttcccttcatcttccaccaatacca

SEQ ID NO: 166226 - DNA, 601 bp, Human
agtgttttctctaatatttccacagcctgctgctgtcatggaacatggagattcattacttagaatgtcaaattaatagcgttcctggacctgaaacatcattgtgtcaacttctccaccttttccaggtggtggtttgagtttgtgcacatggcatgcctattgccccagcacggccacagctttccaaagtgccgcccagggctggggtctgcccacttcctcggaggtctgtccatgctccgggcaggctacagcctgcaggatgcagatgcccagattggagcagcaccctgtgccytcaagaggagcacagctcacacatccacgtaactcttgtccttagcagtagtgaggggcttctgcaggcagaggagtcggctccacggtcctccatgtaaactaccgggatcaggagcctagggttcaattctgctgtcacgtgtctgcactgtagcctgttctgccttctcaaccagccccttctagctcctggggcagtttctctttagctgaaacttcccttcatcttccaccaataccatgttgcgttacagtttccctcttctcacagaacgagccttgggagagaagtgtgttc

SEQ ID NO: 166227 - DNA, 601 bp, Human
gaatgcaagctcataggaaggggtaaatttactgggaagatctctgccagccaggtccttgatggcacagggccacgtgcaggtggagtccaggcgagacttgtccttgggaacacgagctggttttgaagctactgtagtcctgggttgcccgcccatgggtgttgtgaggacgctctccagcatcactgctgcccacgtgccctgaggggtcttaggttccaccccaggtcacattcagtgttttgtctgattcttcaccagaagggagcagcctcacgcagactgagcaggaacagtrgcattggtgttttccacagatcttttggaagaatttgaacttctgatcatgtatatatgacactttttaaagttttaagtgatgcatggaaacttgatattgtaaatttaaatatcagtcattttcagttttgtctctttgctgctcaaaatgaaaaatcttctcactcttcccctactccataatatggtcatggagttttgacctaattaaaagcatcagaattaagttgctaagtttgaatgggaatgtagtggtgtttaaggggacttaggagaccctgtcctcatgtcctttctg

SEQ ID NO: 166228 - DNA, 601 bp, Human
gctgcccacgtgccctgaggggtcttaggttccaccccaggtcacattcagtgttttgtctgattcttcaccagaagggagcagcctcacgcagactgagcaggaacagtagcattggtgttttccacagatcttttggaagaatttgaacttctgatcatgtatatatgacactttttaaagttttaagtgatgcatggaaacttgatattgtaaatttaaatatcagtcattttcagttttgtctctttgctgctcaaaatgaaaaatcttctcactcttcccctactccataatatgktcatggagttttgacctaattaaaagcatcagaattaagttgctaagtttgaatgggaatgtagtggtgtttaaggggacttaggagaccctgtcctcatgtcctttctgtcactataggttttgttactgtttaaagtccatctgcccagcttttagataattaattctaattttgagaacttgggagatgttgcaaaaactgttggagctgattttaagattggtgtaatatacctggtattactagagtcagtcagtgaagtcatagatgaagttgtgacatttggcccagggttcc

SEQ ID NO: 166229 - DNA, 601 bp, Human
aaataccatgatgctatcaagagaagagccatgggttagccagtctccatgtgacacccagtgagcttcactgctggtactcccactcttgttccttctcggatggagtcaggtctggccccaagctacagcaggatatggaggaagtgatggtgtgcgacttccgaggctaggtcataagaggccttgcagctcccagtgtcctcagtcacctgctgtgagggcagccagtaccatgtcagaggacatacaggcagccccaggagaggcccatgtggtgaggagccagggaagtcagccytgttggaaatagatcctccagccccagtcgagccttcggatgagtgcagctatgcagaagaccccaagtgacaactgctgagcccgacccttctgaattcaaggccatgaaagaaaggtcatttgtgttgtttggggccacgaagttggggattatctgttacctgtctgtagtgactggcacaagatgtgaggcactccccagtagttacttattcatcacacttcctttcatagctggtccttgtcctttcctctggtgtaaagtacagactgtgaagacccgccctctgttccttcc

SEQ ID NO: 166230 - DNA, 601 bp, Human
aggaagtgatggtgtgcgacttccgaggctaggtcataagaggccttgcagctcccagtgtcctcagtcacctgctgtgagggcagccagtaccatgtcagaggacatacaggcagccccaggagaggcccatgtggtgaggagccagggaagtcagccctgttggaaatagatcctccagccccagtcgagccttcggatgagtgcagctatgcagaagaccccaagtgacaactgctgagcccgacccttctgaattcaaggccatgaaagaaaggtcatttgtgttgtttggggccasgaagttggggattatctgttacctgtctgtagtgactggcacaagatgtgaggcactccccagtagttacttattcatcacacttcctttcatagctggtccttgtcctttcctctggtgtaaagtacagactgtgaagacccgccctctgttccttccagctgtttttggctgtctcttgtgtacaaatgctgtaggagatgcaaaggtgactcgcagcatcccccaagaatgcctgggcttggtgctgccagaaaggtatatgaggagccccgggtaagccagcactgcaggcagcaa

SEQ ID NO: 166231 - DNA, 601 bp, Human
ctgcaggcagcaaggtagccttcagctgtgtgggctggggagaacttcatggaggaggtagcatttgcaccagactttgaggtagatgggatttgaacacatggagtaaggggaaacaacatggactgaggctgggcctgtgtgtgaaacagcaagcaatcccttctggctggagcaggggagggtgtgaggaggggctgccagcctccctccaggccaagaaggccatcaggtctcactgggggacagtgaggagctactcaaggcatgatgggagccaggctggacttgaacaggactyattggactgtccaggtgctgggtgagagagggaggaggggacatggagccagcaccaggggacaagggggacctgaagcagctgtgaccgtggatggcagggaaaagaagaagaagggattcattttggcatagagttgggaattgcagcagtcacttgagaatgacagagatgggaaggttagggattagggtcagtggcatggacgtgagcgatgaacccatacaagtgggtgagaaaaaggctgaagaaggtgaggcagcatagggagtgggtgacgccagtgatggctgatgtggt

SEQ ID NO: 166232 - DNA, 601 bp, Human
ggaggggctgccagcctccctccaggccaagaaggccatcaggtctcactgggggacagtgaggagctactcaaggcatgatgggagccaggctggacttgaacaggactcattggactgtccaggtgctgggtgagagagggaggaggggacatggagccagcaccaggggacaagggggacctgaagcagctgtgaccgtggatggcagggaaaagaagaagaagggattcattttggcatagagttgggaattgcagcagtcacttgagaatgacagagatgggaaggttagggattrgggtcagtggcatggacgtgagcgatgaacccatacaagtgggtgagaaaaaggctgaagaaggtgaggcagcatagggagtgggtgacgccagtgatggctgatgtggtgtgaccagaggaaggggccaagggggcggaccccgcagggtccataatggtggtgattgccttgggggagttcaggggtcgcagaagaggacctgattatgccatcctcacttgtaaattctgcttggtctcctgacgctatcagggtcagacccagccctctcatggcccgctgtgtggcatgtgctgc

SEQ ID NO: 166233 - DNA, 601 bp, Human
attggactgtccaggtgctgggtgagagagggaggaggggacatggagccagcaccaggggacaagggggacctgaagcagctgtgaccgtggatggcagggaaaagaagaagaagggattcattttggcatagagttgggaattgcagcagtcacttgagaatgacagagatgggaaggttagggattagggtcagtggcatggacgtgagcgatgaacccatacaagtgggtgagaaaaaggctgaagaaggtgaggcagcatagggagtgggtgacgccagtgatggctgatgtggtrtgaccagaggaaggggccaagggggcggaccccgcagggtccataatggtggtgattgccttgggggagttcaggggtcgcagaagaggacctgattatgccatcctcacttgtaaattctgcttggtctcctgacgctatcagggtcagacccagccctctcatggcccgctgtgtggcatgtgctgctccctggctcttgcccatgcccctcctcctggccaagccacactccacctgcatcagccataggccctcccgccactgcccgcctgcaggtctcagcaccagcgttgcctc

SEQ ID NO: 166234 - DNA, 601 bp, Human
tctcctgacgctatcagggtcagacccagccctctcatggcccgctgtgtggcatgtgctgctccctggctcttgcccatgcccctcctcctggccaagccacactccacctgcatcagccataggccctcccgccactgcccgcctgcaggtctcagcaccagcgttgcctccccagaagcctccctgaccatggtccctgttgtgtgccccaccaccccctgttctctgtccccctggtattggttcgtctgcttgtggtaactgctgaatgccagccccaatgcccccgcctcccatygccatcagcgtcaccagcatcacaaaggtcagcacgaggtagctgctcacagaatatttattaagaataagaaattaataaagggactaattggtaaatcttaacatgcccacactgggtcttttccccatgtcacgtgagcctgaacttggaacatccatatttccagaagacatcaggctctttctctagtgaccttagaaatccccgcattgaagggagacggccctggcatggggcccctgccactgggtggggaggggtggggaccagactgtgccagggaccccaaggagttgg

SEQ ID NO: 166235 - DNA, 601 bp, Human
ttctctgtccccctggtattggttcgtctgcttgtggtaactgctgaatgccagccccaatgcccccgcctcccatcgccatcagcgtcaccagcatcacaaaggtcagcacgaggtagctgctcacagaatatttattaagaataagaaattaataaagggactaattggtaaatcttaacatgcccacactgggtcttttccccatgtcacgtgagcctgaacttggaacatccatatttccagaagacatcaggctctttctctagtgaccttagaaatccccgcattgaagggagayggccctggcatggggcccctgccactgggtggggaggggtggggaccagactgtgccagggaccccaaggagttggagggtgcagagcttcttgacctgagtggacagggagaccctctgagctcatcctctgtaacaggatgagcatggactcttcaggggacaaacttcgtgcctcgtgtgaaaaacgaaagggccccacgggctgtgtctgatggtgttacccactgcacagggaaggcacctttgcaccccagtcccagccaggagagcagcaggtcgcaatgtcttgctagcctg

SEQ ID NO: 166236 - DNA, 601 bp, Human
ttgacctgagtggacagggagaccctctgagctcatcctctgtaacaggatgagcatggactcttcaggggacaaacttcgtgcctcgtgtgaaaaacgaaagggccccacgggctgtgtctgatggtgttacccactgcacagggaaggcacctttgcaccccagtcccagccaggagagcagcaggtcgcaatgtcttgctagcctggcccctctgccctcaatgactttgcaagcaccttggcctccctgtcccactcccctgccggcacctgcgtgtccctgtcctgccgagctgcmagcctcacctgcgtgcctctcgtcctcatttgaataggtgagcaaccaaagtcagctgtgccgttggagccggattccatcactcaaaatccaggcacagctccttttgaattcctcagctgccccgaggcaggggctcaatgttgatactgagattaatccccaaagagcttctcatttctctgcagagaaattaaagcttgccagtttccttttgcccgtccttctgacagctctgtcagtaatgatatgcctgccgcgtggcataatccgtgtcccgtggtaaagaataattcatta

SEQ ID NO: 166237 - DNA, 601 bp, Human
ctgcttgccctgccctcctctgatttttttttgcacagcatgattctatttctgctattgttcagaaaccattagcacctattcagaagtcagttattcagctttgagctgaatgacaattatttgaatggtaaagggtgttaatgtataattattcacattcataccaggacagtcacagtttaatcatttctctgtaggcttccttaagtttgtgcttaaagtcttaggcataattcttttgttaaataagtttaggaggctctaagtattgggaaagtgagtataaatacgcctctgkgggagcttcaaggatgtggtgcctcacctccaggagcgagcctcctaggtgaaactgtcactaggcgccccacacttcagccaggaggaaggtccatttccgagggctggtagcataatctggcctccaggtgagctctgaggtcgtgttctggcgtgcccaggactagatggagcctaccggggcattcctatgtgtgacacagagccctgccaggcccggtcgggctcagagtgggcttaacccttcagaccctcgattcctctggacccctctttaagatgattgacgaccccaaag

SEQ ID NO: 166238 - DNA, 601 bp, Human
aaccattagcacctattcagaagtcagttattcagctttgagctgaatgacaattatttgaatggtaaagggtgttaatgtataattattcacattcataccaggacagtcacagtttaatcatttctctgtaggcttccttaagtttgtgcttaaagtcttaggcataattcttttgttaaataagtttaggaggctctaagtattgggaaagtgagtataaatacgcctctgggggagcttcaaggatgtggtgcctcacctccaggagcgagcctcctaggtgaaactgtcactaggygccccacacttcagccaggaggaaggtccatttccgagggctggtagcataatctggcctccaggtgagctctgaggtcgtgttctggcgtgcccaggactagatggagcctaccggggcattcctatgtgtgacacagagccctgccaggcccggtcgggctcagagtgggcttaacccttcagaccctcgattcctctggacccctctttaagatgattgacgaccccaaagagcttttgatgataagggctatattgtgcacatttgccatattggaaattaaacctaagacttttt

SEQ ID NO: 166239 - DNA, 601 bp, Human
tcagctttgagctgaatgacaattatttgaatggtaaagggtgttaatgtataattattcacattcataccaggacagtcacagtttaatcatttctctgtaggcttccttaagtttgtgcttaaagtcttaggcataattcttttgttaaataagtttaggaggctctaagtattgggaaagtgagtataaatacgcctctgggggagcttcaaggatgtggtgcctcacctccaggagcgagcctcctaggtgaaactgtcactaggcgccccacacttcagccaggaggaaggtccatttccgagggctggtagcataatctggcctccaggtgagctctgaggtcgtgttctggcgtgcccaggactagatggagcctaccggggcattcctatgtgtgacacagagccctgccaggcccggtcgggctcagagtgggcttaacccttcagaccctcgattcctctggacccctctttaagatgattgacgaccccaaagagcttttgatgataagggctatattgtgcacatttgccatattggaaattaaacctaagacttttttttttttttttttttttttgcgacggagtct

SEQ ID NO: 166240 - DNA, 601 bp, Human
gtataattattcacattcataccaggacagtcacagtttaatcatttctctgtaggcttccttaagtttgtgcttaaagtcttaggcataattcttttgttaaataagtttaggaggctctaagtattgggaaagtgagtataaatacgcctctgggggagcttcaaggatgtggtgcctcacctccaggagcgagcctcctaggtgaaactgtcactaggcgccccacacttcagccaggaggaaggtccatttccgagggctggtagcataatctggcctccaggtgagctctgaggtygtgttctggcgtgcccaggactagatggagcctaccggggcattcctatgtgtgacacagagccctgccaggcccggtcgggctcagagtgggcttaacccttcagaccctcgattcctctggacccctctttaagatgattgacgaccccaaagagcttttgatgataagggctatattgtgcacatttgccatattggaaattaaacctaagacttttttttttttttttttttttttgcgacggagtctcgctctgttgcccaagcttgagtgcagtgacacgatctcggcttactg

SEQ ID NO: 166241 - DNA, 601 bp, Human
ttaatcatttctctgtaggcttccttaagtttgtgcttaaagtcttaggcataattcttttgttaaataagtttaggaggctctaagtattgggaaagtgagtataaatacgcctctgggggagcttcaaggatgtggtgcctcacctccaggagcgagcctcctaggtgaaactgtcactaggcgccccacacttcagccaggaggaaggtccatttccgagggctggtagcataatctggcctccaggtgagctctgaggtcgtgttctggcgtgcccaggactagatggagcctaccrgggcattcctatgtgtgacacagagccctgccaggcccggtcgggctcagagtgggcttaacccttcagaccctcgattcctctggacccctctttaagatgattgacgaccccaaagagcttttgatgataagggctatattgtgcacatttgccatattggaaattaaacctaagacttttttttttttttttttttttttgcgacggagtctcgctctgttgcccaagcttgagtgcagtgacacgatctcggcttactgcaacatctgcctcctgggttcaagagattcttctgcc

SEQ ID NO: 166242 - DNA, 601 bp, Human
ccctgccaggcccggtcgggctcagagtgggcttaacccttcagaccctcgattcctctggacccctctttaagatgattgacgaccccaaagagcttttgatgataagggctatattgtgcacatttgccatattggaaattaaacctaagacttttttttttttttttttttttttgcgacggagtctcgctctgttgcccaagcttgagtgcagtgacacgatctcggcttactgcaacatctgcctcctgggttcaagagattcttctgcctcagcttcatacaccctgcatatgcmggctgcctcctcaagcagtacagctgggattacaggcacccgccaccacacccggctgattttagtgtttttagtagagttgcggtttcaccattttggccaggctggtcttgaactcctgatcttgtgatccacctgcctcggcctcccaaagtgctgggattacaggcctgagccaccacgccctgccctgagactttttaaatgtattaacttatttaaaaataacaacagtaaacctatggcaggatatcataggtaatatgcttctggaaatgagttttccaagacagacacttg

SEQ ID NO: 166243 - DNA, 601 bp, Human
gagaatctaaaaggcaaataacatcctagtattgctatggaaatgattttgacctcacaaaccccctaaaggggtctcaggaacccctgatgatccctagaccacattttgagaatctctgttctaaaaagtccatttcttttactctaaaatattactcacattgcctgatatgttgtgggctcctccttttttaaattttttttattatactttaagttctagggtacatgtacacaatgtgcaggtttgttacgtaggtatacatgtgctatgttggtgtgctgcacccatctattcrtcatttatattaggtatttctcctaatgctatccctcccccaaccccccaccccccgacaggccccagtgtgtgatgttccctgccctgtgtccatgtgttctcattgttcagttcccacctgtgagtgagaacatgcggtgtttggttttctgtccttgtgatagtttgcttagaatgatggtttccaacttcatccatgtccctgcaaaggacatgaactcatccttttttatggctgcatggtattccatagtgtacacatgccacattttctttttttttggcattttttttaatt

SEQ ID NO: 166244 - DNA, 601 bp, Human
aaggggtctcaggaacccctgatgatccctagaccacattttgagaatctctgttctaaaaagtccatttcttttactctaaaatattactcacattgcctgatatgttgtgggctcctccttttttaaattttttttattatactttaagttctagggtacatgtacacaatgtgcaggtttgttacgtaggtatacatgtgctatgttggtgtgctgcacccatctattcgtcatttatattaggtatttctcctaatgctatccctcccccaaccccccaccccccgacaggccccartgtgtgatgttccctgccctgtgtccatgtgttctcattgttcagttcccacctgtgagtgagaacatgcggtgtttggttttctgtccttgtgatagtttgcttagaatgatggtttccaacttcatccatgtccctgcaaaggacatgaactcatccttttttatggctgcatggtattccatagtgtacacatgccacattttctttttttttggcattttttttaatttattattattatactttaagttttagggtgcatgtgcataatgtgcaggttagttacatatgtataca

SEQ ID NO: 166245 - DNA, 601 bp, Human
ctaaaaagtccatttcttttactctaaaatattactcacattgcctgatatgttgtgggctcctccttttttaaattttttttattatactttaagttctagggtacatgtacacaatgtgcaggtttgttacgtaggtatacatgtgctatgttggtgtgctgcacccatctattcgtcatttatattaggtatttctcctaatgctatccctcccccaaccccccaccccccgacaggccccagtgtgtgatgttccctgccctgtgtccatgtgttctcattgttcagttcccacctrtgagtgagaacatgcggtgtttggttttctgtccttgtgatagtttgcttagaatgatggtttccaacttcatccatgtccctgcaaaggacatgaactcatccttttttatggctgcatggtattccatagtgtacacatgccacattttctttttttttggcattttttttaatttattattattatactttaagttttagggtgcatgtgcataatgtgcaggttagttacatatgtatacatgtgccatgcttgtgcactgcacccactaactcgtcatctagcattaggtatatc

SEQ ID NO: 166246 - DNA, 601 bp, Human
cttttttaaattttttttattatactttaagttctagggtacatgtacacaatgtgcaggtttgttacgtaggtatacatgtgctatgttggtgtgctgcacccatctattcgtcatttatattaggtatttctcctaatgctatccctcccccaaccccccaccccccgacaggccccagtgtgtgatgttccctgccctgtgtccatgtgttctcattgttcagttcccacctgtgagtgagaacatgcggtgtttggttttctgtccttgtgatagtttgcttagaatgatggtttcsaacttcatccatgtccctgcaaaggacatgaactcatccttttttatggctgcatggtattccatagtgtacacatgccacattttctttttttttggcattttttttaatttattattattatactttaagttttagggtgcatgtgcataatgtgcaggttagttacatatgtatacatgtgccatgcttgtgcactgcacccactaactcgtcatctagcattaggtatatctcccaatgctatccctcccccgtccccccaccccacaacagtccccagaatgtgatgttcgcctt

SEQ ID NO: 166247 - DNA, 601 bp, Human
ggccccagtgtgtgatgttccctgccctgtgtccatgtgttctcattgttcagttcccacctgtgagtgagaacatgcggtgtttggttttctgtccttgtgatagtttgcttagaatgatggtttccaacttcatccatgtccctgcaaaggacatgaactcatccttttttatggctgcatggtattccatagtgtacacatgccacattttctttttttttggcattttttttaatttattattattatactttaagttttagggtgcatgtgcataatgtgcaggttagttacatatgtatacatgtgccatgcttgtgcactgcacccactaactcgtcatctagcattaggtatatctcccaatgctatccctcccccgtccccccaccccacaacagtccccagaatgtgatgttcgccttcctgtgtccatgtgttctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgt

SEQ ID NO: 166248 - DNA, 601 bp, Human
ctttatagtagcatgattcacagctgaattctaccagaggtacaaagaagagctggtaccattccttctgaaactattccaatgaatagaaaaagagggaatcctcactaactcattttatgaggccagcatcatcctaataccaaaggctggcagagacacaacaaaaaaagagaattttaggccaatatccctgatgaacattgatgtgaaaatcttcaataaaatgctggcaaaccgaatccagcagcacatcaaaaagtttatccaccaccatcaagtcggcttcatccctgggatacaaggctggttcaacatacacaaatcaataaacatgttccatcacgtaaacagaaccaaagacaaaaaccatatgattatctcaatagatgcagaaaaggccttcaacaaaattcagcagcgcttcatgctaaaaactctcagtaaactaggtattgacggaacgtatctcaaataataagagctatttatgacaaacccacagccaatatcatactgaatgggcaaaactggaagcattcactttgaaaatcggcacaagacaaggatgcagtctctcaccactcctgttcaacatact

SEQ ID NO: 166249 - DNA, 601 bp, Human
gtacaaagaagagctggtaccattccttctgaaactattccaatgaatagaaaaagagggaatcctcactaactcattttatgaggccagcatcatcctaataccaaaggctggcagagacacaacaaaaaaagagaattttaggccaatatccctgatgaacattgatgtgaaaatcttcaataaaatgctggcaaaccgaatccagcagcacatcaaaaagtttatccaccaccatcaagtcggcttcatccctgggatccaaggctggttcaacatacacaaatcaataaacatgttccatcacgtaaacagaaccaaagacaaaaaccatatgattatctcaatagatgcagaaaaggccttcaacaaaattcagcagcgcttcatgctaaaaactctcagtaaactaggtattgacggaacgtatctcaaataataagagctatttatgacaaacccacagccaatatcatactgaatgggcaaaactggaagcattcactttgaaaatcggcacaagacaaggatgcagtctctcaccactcctgttcaacatactgctggaagttctggctagggcaatcaggcaagagaaaga

SEQ ID NO: 166250 - DNA, 601 bp, Human
actattccaatgaatagaaaaagagggaatcctcactaactcattttatgaggccagcatcatcctaataccaaaggctggcagagacacaacaaaaaaagagaattttaggccaatatccctgatgaacattgatgtgaaaatcttcaataaaatgctggcaaaccgaatccagcagcacatcaaaaagtttatccaccaccatcaagtcggcttcatccctgggatccaaggctggttcaacatacacaaatcaataaacatgttccatcacgtaaacagaaccaaagacaaaaaccayatgattatctcaatagatgcagaaaaggccttcaacaaaattcagcagcgcttcatgctaaaaactctcagtaaactaggtattgacggaacgtatctcaaataataagagctatttatgacaaacccacagccaatatcatactgaatgggcaaaactggaagcattcactttgaaaatcggcacaagacaaggatgcagtctctcaccactcctgttcaacatactgctggaagttctggctagggcaatcaggcaagagaaagaaataaagggtattcaattaggaaaagaggaagt

SEQ ID NO: 166251 - DNA, 601 bp, Human
ctatatttagaaaaccccattgtctcagcccaaaatctcctcttttttattttcgaaaaaattacagcagagttcactcttcttggtgtgcagcaggaggtgcacgtgctgtgcttgtccatcagtgtctgctttgtgcatctctgttgacctgcctctaacactgggacgagcatcagccaaatcagaaccaggtcagagcccctacgccctggtcagatcagaaccaggtcagaactcccctacaccacagtcagatcagaaccaggtcagaacccctataccaagcttgtccaatcckcagcctgcgagccacctgcagcccaggatagctttgaatgtggcccaacataaattcataaactttcttaacacattatgagtttttttatgattttttttaactcctcagctatcattagtgttagttattttatatgtggcctaagacaattcttccagtatggctcagggaagccaaaagattagacacccctgccctacaccttggtcagatcagatccaggtcagaggccctacatcctgtccccacagtggacaggttggaaatgtaaggtcgtgtggccactgggggcccagg

SEQ ID NO: 166252 - DNA, 601 bp, Human
actgggggcccaggatgggctctgcctcagaggcacttccttccacctggcctgttttaatcaacagtcattaaagggaaatctaaagatgtttaaaacgttgtgtattttctcgttagcagagccaagaatcagtctgcagggagcaaagagcttgagtgtggagttagaagtcggggtccgggaaagggtgcttgtttctgaggctaacatgcatcaggtgctccaagtgggctctcattgaccccaggatgccatcagcccccttgccctgcctggagtatatcacatgggccctggstgcctgggcctgtggagccacagctgctgaggtccggtgtttttaaagcctgagagaggccatctgggggtagcactacaggagatgggaagaggcccccaggaaaccagggagagcaagaaggtcttctaaggactcatgtcctcttaccaactaccatgtagttaagaatgccttacgaagggggacgggagagtcaagggatagaaaatcagtccttaaaatctgcactgtcctttccacatacaaagcacctttcacacaggtgagctcatttaccctcagatggcacttactgtt

SEQ ID NO: 166253 - DNA, 601 bp, Human
gtgcttgtttctgaggctaacatgcatcaggtgctccaagtgggctctcattgaccccaggatgccatcagcccccttgccctgcctggagtatatcacatgggccctgggtgcctgggcctgtggagccacagctgctgaggtccggtgtttttaaagcctgagagaggccatctgggggtagcactacaggagatgggaagaggcccccaggaaaccagggagagcaagaaggtcttctaaggactcatgtcctcttaccaactaccatgtagttaagaatgccttacgaagggggacrggagagtcaagggatagaaaatcagtccttaaaatctgcactgtcctttccacatacaaagcacctttcacacaggtgagctcatttaccctcagatggcacttactgttgtgggaacctcattttaccaggaggaaacggaggggcgacaggacagcgttctaggaagtagctcagctgtggacattttgtggtgagctctcagggacagcagcaggcatgggatgcctgcagagaggctttcaggagagcgctggccccacctgcaggcccccagggcgaccttggataggctgccgt

SEQ ID NO: 166254 - DNA, 601 bp, Human
agctcatttaccctcagatggcacttactgttgtgggaacctcattttaccaggaggaaacggaggggcgacaggacagcgttctaggaagtagctcagctgtggacattttgtggtgagctctcagggacagcagcaggcatgggatgcctgcagagaggctttcaggagagcgctggccccacctgcaggcccccagggcgaccttggataggctgccgtctgggcctgggagacttctcacctgcagagtggatgatgggggaccttgaggactgaacaggagaaagcacactgaacmgagcctggtacctagtaagcactcagtaagtcttggcacttactgtgataattgcattttaagcccagctaccaaaatttccagacctacgttaccatcttcaaatgagtgcccctacccgtttccctaacgttgctcaaacttgcattttctgaggagcgtctgttggatgcctttggcccttgcaccacgtacagctttccacgcttattggctggccactgggtaccaaggaccatggcgggcactctggaatgctctgttttggcaaactttcttccccaagaacagatttgactt

SEQ ID NO: 166255 - DNA, 601 bp, Human
cacactgaaccgagcctggtacctagtaagcactcagtaagtcttggcacttactgtgataattgcattttaagcccagctaccaaaatttccagacctacgttaccatcttcaaatgagtgcccctacccgtttccctaacgttgctcaaacttgcattttctgaggagcgtctgttggatgcctttggcccttgcaccacgtacagctttccacgcttattggctggccactgggtaccaaggaccatggcgggcactctggaatgctctgttttggcaaactttcttccccaagaacrgatttgacttttgaaaagtggtctgaaagtcagcctccccagccctggtcacagcagaaatagttttggacccaggtgagttgagtccacaaaataacaggccgtgtctacttgagctgaagccttatcagttggcccagtaggtcccatctgaagaagccctgtatttttgaaaaatgttaactctccctaaaaggttacattgaacggcaacacccgggaggctgctgttggccttgccagcaagctgaacctgcagttgagtggccacgcgtgtggtgcgaggcgtgcagcccatcc

SEQ ID NO: 166256 - DNA, 601 bp, Human
ccctggtcacagcagaaatagttttggacccaggtgagttgagtccacaaaataacaggccgtgtctacttgagctgaagccttatcagttggcccagtaggtcccatctgaagaagccctgtatttttgaaaaatgttaactctccctaaaaggttacattgaacggcaacacccgggaggctgctgttggccttgccagcaagctgaacctgcagttgagtggccacgcgtgtggtgcgaggcgtgcagcccatccctgagggctcccctgcatgggaaaggaggctgggaggttcgcyaggactgcatgtggccctcgcaccaagaacctgacccatggtggaggtggtgagtgctgtgtggtcggccttgatgtttatacgagagtctctgaggtgtagacatcagtgtctccattttggggagagggaggcggttttcttcccagcttaccattaccactgtgttcgaggagggactgatatttcgagtggggtcaccatcacactcacaccaccaaggctgctttccaccactcagctttctcatgcatcccgtttcccagaggtggccagtgcctgggccctgagtcggttgag

SEQ ID NO: 166257 - DNA, 601 bp, Human
cgcaccaagaacctgacccatggtggaggtggtgagtgctgtgtggtcggccttgatgtttatacgagagtctctgaggtgtagacatcagtgtctccattttggggagagggaggcggttttcttcccagcttaccattaccactgtgttcgaggagggactgatatttcgagtggggtcaccatcacactcacaccaccaaggctgctttccaccactcagctttctcatgcatcccgtttcccagaggtggccagtgcctgggccctgagtcggttgagactcatccagagcagagcygcagaagctgggctggctccagacagagatgacccaaagcctgtgtcagcatttgggtgcctgggcccaccgtccaggcctgagagagcatcagtgaggctcggagcccccatcagccaggtcaggccgtggctctgagcctagtgctcctttctaaatgggagttgcaacgccagctttgcaaagtggttgtcagggctcactgaggggctctggggagactttgggggaaggataatgattggggaagtagaaattggctcccaaaatgctagagcaggacttaagggactgatggcc

SEQ ID NO: 166258 - DNA, 601 bp, Human
ccaagaacctgacccatggtggaggtggtgagtgctgtgtggtcggccttgatgtttatacgagagtctctgaggtgtagacatcagtgtctccattttggggagagggaggcggttttcttcccagcttaccattaccactgtgttcgaggagggactgatatttcgagtggggtcaccatcacactcacaccaccaaggctgctttccaccactcagctttctcatgcatcccgtttcccagaggtggccagtgcctgggccctgagtcggttgagactcatccagagcagagctgcaraagctgggctggctccagacagagatgacccaaagcctgtgtcagcatttgggtgcctgggcccaccgtccaggcctgagagagcatcagtgaggctcggagcccccatcagccaggtcaggccgtggctctgagcctagtgctcctttctaaatgggagttgcaacgccagctttgcaaagtggttgtcagggctcactgaggggctctggggagactttgggggaaggataatgattggggaagtagaaattggctcccaaaatgctagagcaggacttaagggactgatggccaggc

SEQ ID NO: 166259 - DNA, 601 bp, Human
tgaggtgtagacatcagtgtctccattttggggagagggaggcggttttcttcccagcttaccattaccactgtgttcgaggagggactgatatttcgagtggggtcaccatcacactcacaccaccaaggctgctttccaccactcagctttctcatgcatcccgtttcccagaggtggccagtgcctgggccctgagtcggttgagactcatccagagcagagctgcagaagctgggctggctccagacagagatgacccaaagcctgtgtcagcatttgggtgcctgggcccaccgtycaggcctgagagagcatcagtgaggctcggagcccccatcagccaggtcaggccgtggctctgagcctagtgctcctttctaaatgggagttgcaacgccagctttgcaaagtggttgtcagggctcactgaggggctctggggagactttgggggaaggataatgattggggaagtagaaattggctcccaaaatgctagagcaggacttaagggactgatggccaggcacctgcccagtgtggcatcctcccatcgttggctcgagcgctgagctgcacctctgtgtcaggacttgct

SEQ ID NO: 166260 - DNA, 601 bp, Human
ccaccactcagctttctcatgcatcccgtttcccagaggtggccagtgcctgggccctgagtcggttgagactcatccagagcagagctgcagaagctgggctggctccagacagagatgacccaaagcctgtgtcagcatttgggtgcctgggcccaccgtccaggcctgagagagcatcagtgaggctcggagcccccatcagccaggtcaggccgtggctctgagcctagtgctcctttctaaatgggagttgcaacgccagctttgcaaagtggttgtcagggctcactgaggggcyctggggagactttgggggaaggataatgattggggaagtagaaattggctcccaaaatgctagagcaggacttaagggactgatggccaggcacctgcccagtgtggcatcctcccatcgttggctcgagcgctgagctgcacctctgtgtcaggacttgctctcagtgttctgtctggggaggtcatgtgcctactgggtggggcaggtccttgtgtgggaggagccagaagctcccttttttcttaaaagttattgggccagaggtcatgaattcacccttagcctatgatctccagt

SEQ ID NO: 166261 - DNA, 601 bp, Human
ggcacctcgttcgccatcacctcactcaggagggttccactggtgcttgccggcgaacgccaccattttttgcagcatatctcatagcttgttggaaacccacgttgagttggggctttgttcatccacaggtgctgtcacgcatccgttttcaggagacagagatgtcctctgtggccctccgttggccgaccctgttgggtgcagcagctgtcagtggacagaggtgcatcagtgcgttggttggtggcatcgtggcctcaccggcccacagttctgacagaggtgtctgtgtttcacyaactcagtctgtccctgcccattgtccgcacactcattccctccatgccccagtctggcaccctcaagtgcaagtgcgtgcatttaattcacgtagtgtgttggttgggtgcactcctggacctttggggagactgtcttcttccatgttagctgcttccttcttccctgtggggtcatagaggtcacagctgacatgctgaaacaaatgccattgttttcacttaaaccacattgtattccatagccgctgtgtcatatgcgtatatataatagtgtgtaaggcgtatggaaagaagag

SEQ ID NO: 166262 - DNA, 601 bp, Human
ggttgaagtagatgccgggtggggatctgtaggccctggttgtgtttacagaagatgctgcccttcactgtcttccagcctcccaggaaaggatggtccccaggctccatgctgacaccacccaccttgcttcacccagtaggcgcttactgtatgtctactctaggtcatccacagtgctgagtgttgggatagagccccgggaggtaggtgcctggtcctccgtgagtctggtggaggagccctccgtggtgacagccttctgtgagagcatggcaggtggtggggcctcgtagagggwaagattttgcagaaaatgtgacctagattcccttttaaataggaaatactggtccctagtgtcttgaactttggggagaaaactccctttgattaaagagaaggtaacttggaaatgtgttttccctcatctttttgttaatttattttttaaattaacatgtagtgaaattggctttttgtggggtatacagtcccgtgaatgttaacgcgtgtgtgtgtttctgtaaccacccccaaaatcagggtgcagaggagttccaccacctggacacccccacgccgccccctggcagccacg

SEQ ID NO: 166263 - DNA, 601 bp, Human
tacagaagatgctgcccttcactgtcttccagcctcccaggaaaggatggtccccaggctccatgctgacaccacccaccttgcttcacccagtaggcgcttactgtatgtctactctaggtcatccacagtgctgagtgttgggatagagccccgggaggtaggtgcctggtcctccgtgagtctggtggaggagccctccgtggtgacagccttctgtgagagcatggcaggtggtggggcctcgtagagggaaagattttgcagaaaatgtgacctagattcccttttaaataggaartactggtccctagtgtcttgaactttggggagaaaactccctttgattaaagagaaggtaacttggaaatgtgttttccctcatctttttgttaatttattttttaaattaacatgtagtgaaattggctttttgtggggtatacagtcccgtgaatgttaacgcgtgtgtgtgtttctgtaaccacccccaaaatcagggtgcagaggagttccaccacctggacacccccacgccgccccctggcagccacggcctctccccacccccattccagctctcagcaactgcgacgtgttc

SEQ ID NO: 166264 - DNA, 601 bp, Human
cctgactttctgatactgcaagattctcaaggctcatcttgtgtatttcctgtcccagtcctagggaggaaaaggccagttcttgaaggagtcttgtgtcttttattataaaatgcatgagaaaccatggactgggcactaggtttgctccttgctatgggggtggtgttgtttctaagtcttctcagttgacagaccacagaagtagctttctgtatactaacccacggacagataaatattgtaaacatttctgtatgcaattatctgtgtctatattaagctaaacattagttcctaytgatatctgcaactctaatccattaccacatggattcttctagcctcctctccttacttatctgtaaaatcccactcacaatgagaaacctggctcacactttctgccatccatttacttaattattcaagcccagtatacatatagaatagtatcagagagtttaacacctgtgctcatgggaaacaactttatcaactagagttcagtatttatgtacagttccttttgcctttagtcttacagactccactcactttcaagttacttttggagaaatcagctcccctcccccattca

SEQ ID NO: 166265 - DNA, 601 bp, Human
cactatgtaatattcctttttaccctctgggaattttatttgttcttaagtctgctttgtcttttattaatttttttttacatttgtgtttgcatggtatatctttttctatccgtttacttttaacctacctacaggtatcatttgaagtgaattctttatgacggcattttcttgtgcatgtttttaaaaatctattgtgacagtctctatcttttccttggcatggttagatcatttacatttaatgtaattattaatgtttcaatttaggtctaacattttattgtttgtgccctctttttttcctttttcttccttcttttgggctatttttaacttgttttagtgttttgttttatttgttgtggtttttactatatctcttcatatagtttttctagtgactgttttagggattataatactttctttcacagtctaattagaatcactgttttacctttttaagtggaatatagaaatcttatgactatatagatccttttagctctcccattatgttataatatcatgcattatgtttacataaattgaaaatctcatttcatatgtcataatttttgcttttggctaataa

SEQ ID NO: 166266 - DNA, 601 bp, Human
cattaggaagacagaggtaaagagcaaagacatttcgcccacctcttagggggagcacacctcttcccatcagaaagggaccatctccccctcactggtttgggctcctgcggcccctgttgtcccccacaccacaggattgcttagggaggagctgacgttcaagggctcagagataacaccaaaaagggatgattcctcactcgccctgaacatagttgtctcagcccattttctgctgctataacaacactgccatctaggtaattgataaagaataggaatttattgggctcacagytctggaggctgagaagtccaagagcatgacgccggcatctgctgagggccaccccgtggtggaaggcattccatggcgaggaagcatgccagacaggagaaaaggggccagagtccctcagtaaccaattccagcagtaacagcattcatccattcctgagggaggggccctcatgacctaatcacatcttaacactgtcacagtggcagttgtttccaacacaggaacacattgaaaccttagcagcaggtgatgcttttccttcctcaaagtggattagagcccctagggggctcccc

SEQ ID NO: 166267 - DNA, 601 bp, Human
cttctgcctcaccctcccgagtagctgggactgcagacgagcaccaccacgcctggctaatttttttatttttagtagagatggggtttcaccatattggctaggatggtcttgaactcctgacctcgtgatccgcccgcctcggcctcccaaagtgctgggattacaggcgtgagccaccgcgcctggaccagaaggctgctgttttaatggttgcccctttgggccacctgaagtgattgttccagctgctgaggactgatgtggtcacctcaacctcaagaacttctattttccacawgagttaatgtctatgagtggatttcactccattatagaatatgatgcttaacagcaaggattgcccttcttcaagaacgggtgtcattcagccatgtgattctgcacaggctagggttcgaagcactgtgctctttgagagctgcttcaactaattactgcattcgttcgctgcagggtgaaacagagttttcagatacatttgtaaaatcaggtgcctgattgctaaatactacattgtttgagctatacttcctcatatgttgcctggtacggaccagttaagaaatggtttcccatg

SEQ ID NO: 166268 - DNA, 601 bp, Human
ggtggggcagcgtggcctgtggtgcctgggggccacgtgggtgccgttgctctcccatctcacagcacccaggcctggcagctgggccgcgggccatctggcatctggcatgaggtggtaagtcacagcatgccatgtgcgcccggccaaggccacacgtgcctgtgtgtgtgggggcagaaagggtgccccgtctgcgtggcccattgggagaacccacacaacctcaagaatgcccctggaatattcacccagtgatggtgtgtggtcacgttggcagtgtcttctcccgaaagctctrtgaaagtttctagcatgatggaagcataccatctgatcagggagcacaaatatgatcactccatcatgggatgggaaattactaaatcagatagacctcactttttgaaaaattgctgtggctttactgtctatttccaaaactacttatatccctgctcacaggggagaggccggcgtgttcataccacagcctgctgctcctgctgcccgctgcagcagcctgggggcagagcctccgtttctaggagatgacagttacgtaggcttttgcacaaaactgcattgttagtccttaaaa

SEQ ID NO: 166269 - DNA, 601 bp, Human
gtgtagggcccatgagaactgtggatgcgaatggggttttgggggtgctcttcctgcatcagtgcagtgactgtttcaggcagtgtctactctttgtgccccccgaggagagtaagtccttgtcttctccccactgaggtggattctgctccctccgtgcacacacatgaagatgggagtggccccgtcagcgggcgccgactgctcgctcccttgtgtgtgcagctccccttttgctgtaaggacaagctccactaactgacatgtgcagcgtggcagcaccctcccccaccagcctttsgtgatgccagcagtttctcactctgcagtggagatgccgtcgctggttagcaatcctgcttgtggcgatattcggagacatttattgttctgcaaaccagcgtgactctcttctcctgctattaatctctatgagtgtctctgttccagtatggcctcagtcactgaaatgtataaagtagtatcacatgggatgtaaaaccctaatgtctgtaaagtccacacatcggcaccctgtcccatggcaaagccaagactggaggtgagcacagcatcaggcaggagggttctacaggcacca

SEQ ID NO: 166270 - DNA, 601 bp, Human
ccggagtaagggatggcttttgccatgcggagctttcctctatcctaggagcttgatttctccagaatcctccaggaaggactcaccagccggtgtaaggtggttggtcagcattcctggaaggctgtctccccaactcagcgggagaggatggtcagtttcccagtatattgagtagaaaactcctcacgacccaccccctccacaaagcacccttcctcttcatcctcagacagaatttgctaaatgcagttcaaaggcaatcgatacattgcacagagagtctccccacctttttctraacaaatgcattcctgaggagttagtttattcacggattgccatgagcgttaatgaccccccgaggcttgttctgcccgtcacccggatggctgctgataaagacttagcatcatgttctaagtgtcaaggttgtcagtggagctgaaccatttgaccagaagaaaaaaacgcacagggagctattgattacagcttctcggtgtcacttgttcaccaggatttaggtattgatgaggctgcgagtgaaaacaagctctttcccttgtgggctgctgcccagaagaacaaaggcgaagtt

SEQ ID NO: 166271 - DNA, 601 bp, Human
gaaacgtagttttcagttttgtaagcgaacgttgtatattactcaccggatgaaattaagttttctcctcccaaatcgtgggcctaaagcaattctctgaggatgccccacgtcacctcaggacactcgtccctcccccaacccgtgctgagacccccagggactcaagggcctcaggggaggggaagtccatgctgagacatagctgacacccacccatgccaacagcctgcccctggcacaggcccctgcttggtgggcacaggactcctgtcagtcagggccttggccttgaccccaragacctcgttgtccagatccctgactgacagtggctgcccccctgtcttccaggtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacac

SEQ ID NO: 166272 - DNA, 601 bp, Human
tgcccctggcacaggcccctgcttggtgggcacaggactcctgtcagtcagggccttggccttgaccccaaagacctcgttgtccagatccctgactgacagtggctgcccccctgtcttccaggtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagcwacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctgggaacaagcgtgtctgccctttctgtttccatattttacagcaggatgagttcagacgcccgcggtcctgcacacatttgtttccttctctaacgctgcccttgctctatttttcatgtccattaaaacaggccaagtgagtgtggaaggcctggctcatgttg

SEQ ID NO: 166273 - DNA, 601 bp, Human
tctagaggtgaggggtgtgtgtgtgttctggagttgaggggtgtgtgttctagaggtgagatgtgtgtgttctagagatgatgggtgtgtgtgttctagaagtgagaggtgtgtgtgttctagaggtaagggatgtgtgtgtgtgtgttctagaggtgagttgtgtgtgtgttctagaggtgagatgtgtgtgtgtttgttctagaggtgaggggtgtgtgtgtgtagtctagaggtgacaggtgtgtgtgtgtggtctataggtgagggatgtgtgtgtggtctagaggtgagggatgtrtgtgtggtctagaggtgagaggtgtgtgtgagtgtgaaggagggtggagaggtatccctctagaagtgagggtggggtagaggtgaactgggtaacagcccattgccacccagcagatgtttagtctgaatactcagaacccagaatgtgatctcaggttggaattccttgagtccagtccttccagaattcaaatttcagatcccctaaatctggaggatttctgaagtttgggtctttcttgccagtgctgcatttcttactgatttttgttccttctgtggccccccttttcttatg

SEQ ID NO: 166274 - DNA, 601 bp, Human
tgtgtgtggtctagaggtgagggatgtatgtgtggtctagaggtgagaggtgtgtgtgagtgtgaaggagggtggagaggtatccctctagaagtgagggtggggtagaggtgaactgggtaacagcccattgccacccagcagatgtttagtctgaatactcagaacccagaatgtgatctcaggttggaattccttgagtccagtccttccagaattcaaatttcagatcccctaaatctggaggatttctgaagtttgggtctttcttgccagtgctgcatttcttactgatttttgytccttctgtggccccccttttcttatgtttgtgatgtctttcttgtgctgatcatttttattgtcgcacatttcaggcaaataagaaacagcagagaaccacctgtgttacacaccacccagtatgagaaacaaagttacaaatgctatgggaaatattttttgaaaactagcatggacctcaagaggggcttgcactggagggtgcacctgctttgccagaggtggaagccttttgcagcattgggcctccctcctaacactacacatcctgctggctggcctggcctcacctggtccc

SEQ ID NO: 166275 - DNA, 601 bp, Human
tagaggtgagaggtgtgtgtgagtgtgaaggagggtggagaggtatccctctagaagtgagggtggggtagaggtgaactgggtaacagcccattgccacccagcagatgtttagtctgaatactcagaacccagaatgtgatctcaggttggaattccttgagtccagtccttccagaattcaaatttcagatcccctaaatctggaggatttctgaagtttgggtctttcttgccagtgctgcatttcttactgatttttgttccttctgtggccccccttttcttatgtttgtgatgcctttcttgtgctgatcatttttattgtcgcacatttcaggcaaataagaaacagcagagaaccacctgtgttacacaccacccagtatgagaaacaaagttacaaatgctatgggaaatattttttgaaaactagcatggacctcaagaggggcttgcactggagggtgcacctgctttgccagaggtggaagccttttgcagcattgggcctccctcctaacactacacatcctgctggctggcctggcctcacctggtccccgagctccacactggaactggactatgagactggccc

SEQ ID NO: 166276 - DNA, 601 bp, Human
tatgtttgtgatgtctttcttgtgctgatcatttttattgtcgcacatttcaggcaaataagaaacagcagagaaccacctgtgttacacaccacccagtatgagaaacaaagttacaaatgctatgggaaatattttttgaaaactagcatggacctcaagaggggcttgcactggagggtgcacctgctttgccagaggtggaagccttttgcagcattgggcctccctcctaacactacacatcctgctggctggcctggcctcacctggtccccgagctccacactggaactggacwatgagactggccccaccgttaggtctaaatgaagaggcacctgctgtatagttgactgaatttgtcacctcctgctcggtgccatttctgcttgtctccgtgagcctggggcaaggctgtattccttagctctgagaaatctgtgcagtgccttcagagagacaattccagtgtcagatttctgaatctgtcacctaagccatgacaattcgttgtcttttttgtaagcctacttctgcagttactatatgaaaaatctcttgtaaagctcttagacaaatgggcatacttcacaacaca

SEQ ID NO: 166277 - DNA, 601 bp, Human
cccgtcgttttatgcccctgagcgatgttctgtatggcagggttgcagatttcttgagctggtgtcgacagaaaaatgactctggtaagactcctgcacaaatcacaggagacttaagaactcctatttactatgcattaccatttgtgctaaatgctttcatatgcatttatttcacttgatcctctccaagtcctctgagataagtggcaagaatagttaataataacaatactagagaatacttaactttgcaggtgccagtctaagcactctctctctctctctctctctctctctmtatatatatatatatacacatatatatatacacatatatatacatatctatacatatctatatctatatatacacacatactcatttgatgcccacaacaacctcatgggatcctatcataatccccattttgataaatgaggaaactgaggcacagcaagattaagaaatctgctcagggggcatagctagtaagcagcagacagtctgactccagagcccattttctcaactttgcacaactctgccttactatcctcatttgtccagagggggaagctgaggcttagggaggttaaa

SEQ ID NO: 166278 - DNA, 601 bp, Human
cgtcgttttatgcccctgagcgatgttctgtatggcagggttgcagatttcttgagctggtgtcgacagaaaaatgactctggtaagactcctgcacaaatcacaggagacttaagaactcctatttactatgcattaccatttgtgctaaatgctttcatatgcatttatttcacttgatcctctccaagtcctctgagataagtggcaagaatagttaataataacaatactagagaatacttaactttgcaggtgccagtctaagcactctctctctctctctctctctctctctatmtatatatatatatacacatatatatatacacatatatatacatatctatacatatctatatctatatatacacacatactcatttgatgcccacaacaacctcatgggatcctatcataatccccattttgataaatgaggaaactgaggcacagcaagattaagaaatctgctcagggggcatagctagtaagcagcagacagtctgactccagagcccattttctcaactttgcacaactctgccttactatcctcatttgtccagagggggaagctgaggcttagggaggttaaatg

SEQ ID NO: 166279 - DNA, 601 bp, Human
tacttaactttgcaggtgccagtctaagcactctctctctctctctctctctctctctatatatatatatatatacacatatatatatacacatatatatacatatctatacatatctatatctatatatacacacatactcatttgatgcccacaacaacctcatgggatcctatcataatccccattttgataaatgaggaaactgaggcacagcaagattaagaaatctgctcagggggcatagctagtaagcagcagacagtctgactccagagcccattttctcaactttgcacarctctgccttactatcctcatttgtccagagggggaagctgaggcttagggaggttaaatgactggaagtggtaaggctgggtctcagtcctgtcctgatggattctgaagcctgtgctctgtaacaccactccaggccgccggcagatatttcgagatccaagtcacaaggaaagttagagtcacaagagctggcctgaatgttctgcaaacactcctcattcatccaactgtggtgctaggagctggagacacagcagtccccatcttcagggaggttatagcctcatgggggatatca

SEQ ID NO: 166280 - DNA, 601 bp, Human
ccacccgggctgtaatgcagtggtgtgatcctagctcattgcagccttgaactcctgtgctcaagcgatcctcttgcctcagcctcttaagtagctggactacaggcacacaccaccacactaggctgtttttaaaattatttttgtagacacatggtcttgccatgttgcccaggctggtcttgaactcctgacttcaaataatcctcctgcctcagcctcccaaagcactggcattacaggccacagtacctggccttggtgctttttttaattttaattttaattttatttttgattkactcaaaaaattgtatatatttatggcatacaatgtgatgttttatacatatatacattgtgtaatgatcaaatcagggtaattagcatatcaatcatcttaaacatttactatttctttgtggtgagacattcaaaatcctctctactagttattttgaaatatacaatacactattgttagctatggccactctattgtgcattacagccccagtacttattcctcctatgtaactgtaatattgttgaccaacctcttcccatctcccttatccattcccctctccagcctctggta

SEQ ID NO: 166281 - DNA, 601 bp, Human
atacactattgttagctatggccactctattgtgcattacagccccagtacttattcctcctatgtaactgtaatattgttgaccaacctcttcccatctcccttatccattcccctctccagcctctggtagccactattctacccccaacttctatgagatcagcttttgaagattccactttcaagtgagatcatgcaatatttgttttcctgtacctggcttatttcacttgacataatgtcctccaggttcatccatgttgttgcaaatggctcaatagtattgcattatgcatayatgccatattttctttctttttttttttgaaacggagtctctgtgtgtcacccaggccagagtgcagtggcacgatctcagctcactgcagcattcgccccccaggttcaagcgattctcctgcctcagcctcctgagtagctgggactacagatgcgtgccaccatacccggctaatttttgtatttttagtagagatggggttttaccatgttggctagtctggtcttgaactcctgacctcaggtaatccacccgcctcagcttcctaaaatgctgagattacaggcgtgagccact

SEQ ID NO: 166282 - DNA, 601 bp, Human
caacttctatgagatcagcttttgaagattccactttcaagtgagatcatgcaatatttgttttcctgtacctggcttatttcacttgacataatgtcctccaggttcatccatgttgttgcaaatggctcaatagtattgcattatgcatatatgccatattttctttctttttttttttgaaacggagtctctgtgtgtcacccaggccagagtgcagtggcacgatctcagctcactgcagcattcgccccccaggttcaagcgattctcctgcctcagcctcctgagtagctgggamtacagatgcgtgccaccatacccggctaatttttgtatttttagtagagatggggttttaccatgttggctagtctggtcttgaactcctgacctcaggtaatccacccgcctcagcttcctaaaatgctgagattacaggcgtgagccactgtgcccagtctattttatctattaatcagttgatggacacagattgattccatatcttggctattatgaataatgccattaatagcagtttttgctaggaatatgaggtcaacttgtagattagaaattttttttctttatagagtat

SEQ ID NO: 166283 - DNA, 601 bp, Human
actgcagcattcgccccccaggttcaagcgattctcctgcctcagcctcctgagtagctgggactacagatgcgtgccaccatacccggctaatttttgtatttttagtagagatggggttttaccatgttggctagtctggtcttgaactcctgacctcaggtaatccacccgcctcagcttcctaaaatgctgagattacaggcgtgagccactgtgcccagtctattttatctattaatcagttgatggacacagattgattccatatcttggctattatgaataatgccattaatakcagtttttgctaggaatatgaggtcaacttgtagattagaaattttttttctttatagagtatatggtaagtacatcccacatcccattgatctgctagggtctttagtctgtccttaaacattgtaaaatgtaatacattttaacattttatatatttttcaattgtataaaatttctgtttctggctaagcattatcactttcttaatcctttgtttccttgcatttactactaagataatggctaacaatttaatttttggagacggctcttctcccaataaagcaaaggtttttgt

SEQ ID NO: 166284 - DNA, 601 bp, Human
aattcaaaagccctcaccactggttctcagaattaacctagggactctataattaagacgtcattctcagagaacaaccagctcttcaactgggtcttgaataactggttgagaaagcttttatgatccacattttctgggaaagcacgagtttacatgtaaatgcaaacttaaactcattcttctcagcagtaaagagcactgctggcacaaactcaagataaaaaagttaaactgatttggtttaaagacaagccaacaaggccacagcctaaataaagctggacagccatgatggagmttcagaagcaagctgaggccttgtccttcagaacagtccctccgtgctacatggaggaaggtattactaaccccaaggagtgcaggtcccattgaaagtgtttaggagaacttcagtgaattccctgtgtccgtgttggcccccaggaccttctaagactcaccatataaggggttatttttcccgtctcttaggcaatagattgtgataaatttgcaaactacttaattacgtaagttataccaagatctgcattccccttctcagaagacaaattatacttatttttgcatgcatgaa

SEQ ID NO: 166285 - DNA, 601 bp, Human
tttttgctttaccctgctcctgccagcctggctcctttttcctaattaggactccacagcaacaaagtttgttgtagtgtaaatggtatcgaaatgaaagaatcaacctaggtcttcaacaagagaggacgggttccatgagttatggtctgtttatgtaagggaggccatgctggagctaaaaataatggcagagaagtgtgtgtgtgtgtgtgtgtgtgtgtctgtgtatacacacacacacagagacaggagctaaagcagactacaaaacacattggatagcagagaccctttgctktatttttaaaatcttgcagaaataaatatattctaaaagactagacctatatacaccaaaatgttaacagagctatctctaggggtgtgagatttggggtaattttttaaaatttttgtttatttgcattttctaatattttaaaatttgtatgttttggtggttacttaaaacttcaaatgaatatactgtagtgtagggtgaacaaattggcaggtagcattgtgtcgagcccctggagcacattgcagatatgtgtcactgtctggggacagactgcacaggtggctgacaccacgc

SEQ ID NO: 166286 - DNA, 601 bp, Human
acacacagagcagcactttctcatttgctcatgcccagttctctcctcactgtgcttactgtgcagcgagatgctggagtacagggactgaggttcctatgtctttggatctctgtgggatccctgtgcatgacaggtgctaaggtgggagcttgtttgaggtatttacagacacatcttgaccacagaccaataggaaaataataataactaccacttggtgagcagctatgggccagacactttatatatttataatcaggtatcatttgtgggccttgttgcttggacattttttttwaaaaaaacttggctcaagccctaaggtagttgcaagccatctctggactcaaacgcctgcctctggctctctctgccccagcccctaagactgtggacctgctgattctgcaaggggctggaatccaacattgcaaaaactgagtggttttcttgaacatttctgagtgtcgctgggtggaaatgacgtcagtggtcttttgttgcctaacacccttgattatcctgcttctctgccactctctgccttccagcagccccatgggctggatcattctcccagctgagcaaagcaccctaa

SEQ ID NO: 166287 - DNA, 601 bp, Human
tctgttatctgtaccttttactcataaattattgccagtgctctcaaaagttagatgttgtttatcaccccttttaaatacaaaacaaggcaaatgtccttttctggaaatataatctatgtacagaaaaatatacaaaccatgagtacacaggtggatgaagtttcccccatttagtgcatacctgcaaccagccctcagaccaataaacagaacatactcagcatccccaggggctcccattggcctcttttggtcaccacccccatagtaaccactctctagatttataatgccattwattagttttatctgtctttaagctttaaactcagtgacagagctgagttttgaacccagctttgcatggccttaacgcacgctctttccctcctgctaccaagctcttccttccttaattgaagctccagtagtacattttaaaaaacattcaattcttggccgagtgcagtggctcatacctgtaatcccagcactttggaaggccgaggcgggcggataacaaggtcaggagttcgagaccagcctggccaacatggtgaaaccccgtctctactaaaaatacaaaaattagccgcgt

SEQ ID NO: 166288 - DNA, 601 bp, Human
agctttctcaattgtaaattggagaagataaagcacctattccatttggttgttatgaggattacatgacatgatccttacaaaagatataatcaaatgtcttggtacgtaggaagtgcttgataaatgctggctaatattttcatttgttttagtttttctagatacaaggcctcactctgttatccaggctggagtgcagtggtgcgatcatagctcactgcagccttgaactcctgggcctcctgcctcagcctcctgggtagctgagactataggcatgagcgtctgcacccagatmatttttagatttttttttttttttttttttgtagagccaaggtctcgctatgttgcccaggctggtctcaaactcctggtctcaagcagtcctcctgcctcaacctcccaaagtgctgggattacaggtgtaagccaccgtgctgggccactaatatttttagaggaaatagtttgtgtattatttgaggtcagagactactgtatctccaggacttttcaggcaagccataaatggttgatggatgaaagttatttaaataatcccttaaatattattttctttctgtagaccagtgaa

SEQ ID NO: 166289 - DNA, 601 bp, Human
tccatttggttgttatgaggattacatgacatgatccttacaaaagatataatcaaatgtcttggtacgtaggaagtgcttgataaatgctggctaatattttcatttgttttagtttttctagatacaaggcctcactctgttatccaggctggagtgcagtggtgcgatcatagctcactgcagccttgaactcctgggcctcctgcctcagcctcctgggtagctgagactataggcatgagcgtctgcacccagataatttttagatttttttttttttttttttttgtagagccarggtctcgctatgttgcccaggctggtctcaaactcctggtctcaagcagtcctcctgcctcaacctcccaaagtgctgggattacaggtgtaagccaccgtgctgggccactaatatttttagaggaaatagtttgtgtattatttgaggtcagagactactgtatctccaggacttttcaggcaagccataaatggttgatggatgaaagttatttaaataatcccttaaatattattttctttctgtagaccagtgaagctcttacagtgcgtggaccacagcacccatcctgactgt

SEQ ID NO: 166290 - DNA, 601 bp, Human
tgctggctaatattttcatttgttttagtttttctagatacaaggcctcactctgttatccaggctggagtgcagtggtgcgatcatagctcactgcagccttgaactcctgggcctcctgcctcagcctcctgggtagctgagactataggcatgagcgtctgcacccagataatttttagatttttttttttttttttttttgtagagccaaggtctcgctatgttgcccaggctggtctcaaactcctggtctcaagcagtcctcctgcctcaacctcccaaagtgctgggattacargtgtaagccaccgtgctgggccactaatatttttagaggaaatagtttgtgtattatttgaggtcagagactactgtatctccaggacttttcaggcaagccataaatggttgatggatgaaagttatttaaataatcccttaaatattattttctttctgtagaccagtgaagctcttacagtgcgtggaccacagcacccatcctgactgtgccttaaagtcgtaagtaaatgtcttaacccaaatcgttctttccaaagataaccatctcctttcagaagttttcagttcacaaaca

SEQ ID NO: 166291 - DNA, 601 bp, Human
gctggctaatattttcatttgttttagtttttctagatacaaggcctcactctgttatccaggctggagtgcagtggtgcgatcatagctcactgcagccttgaactcctgggcctcctgcctcagcctcctgggtagctgagactataggcatgagcgtctgcacccagataatttttagatttttttttttttttttttttgtagagccaaggtctcgctatgttgcccaggctggtctcaaactcctggtctcaagcagtcctcctgcctcaacctcccaaagtgctgggattacagrtgtaagccaccgtgctgggccactaatatttttagaggaaatagtttgtgtattatttgaggtcagagactactgtatctccaggacttttcaggcaagccataaatggttgatggatgaaagttatttaaataatcccttaaatattattttctttctgtagaccagtgaagctcttacagtgcgtggaccacagcacccatcctgactgtgccttaaagtcgtaagtaaatgtcttaacccaaatcgttctttccaaagataaccatctcctttcagaagttttcagttcacaaacat

SEQ ID NO: 166292 - DNA, 601 bp, Human
tgggcctcctgcctcagcctcctgggtagctgagactataggcatgagcgtctgcacccagataatttttagatttttttttttttttttttttgtagagccaaggtctcgctatgttgcccaggctggtctcaaactcctggtctcaagcagtcctcctgcctcaacctcccaaagtgctgggattacaggtgtaagccaccgtgctgggccactaatatttttagaggaaatagtttgtgtattatttgaggtcagagactactgtatctccaggacttttcaggcaagccataaatgkttgatggatgaaagttatttaaataatcccttaaatattattttctttctgtagaccagtgaagctcttacagtgcgtggaccacagcacccatcctgactgtgccttaaagtcgtaagtaaatgtcttaacccaaatcgttctttccaaagataaccatctcctttcagaagttttcagttcacaaacatgaacatattatcagaggcagatgtaagtgtgctcattggattctggtttggccttatttttatttatatgtatctgtcttagtttttgtacaaaaagcaatcacgctac

SEQ ID NO: 166293 - DNA, 601 bp, Human
tgagcgtctgcacccagataatttttagatttttttttttttttttttttgtagagccaaggtctcgctatgttgcccaggctggtctcaaactcctggtctcaagcagtcctcctgcctcaacctcccaaagtgctgggattacaggtgtaagccaccgtgctgggccactaatatttttagaggaaatagtttgtgtattatttgaggtcagagactactgtatctccaggacttttcaggcaagccataaatggttgatggatgaaagttatttaaataatcccttaaatattatttkctttctgtagaccagtgaagctcttacagtgcgtggaccacagcacccatcctgactgtgccttaaagtcgtaagtaaatgtcttaacccaaatcgttctttccaaagataaccatctcctttcagaagttttcagttcacaaacatgaacatattatcagaggcagatgtaagtgtgctcattggattctggtttggccttatttttatttatatgtatctgtcttagtttttgtacaaaaagcaatcacgctacacataacgtcctgctgtgagctttcttcacttgctggtgtaatg

SEQ ID NO: 166294 - DNA, 601 bp, Human
tttcttcacttgctggtgtaatggggccaccctttaaagtttgttcatacttctgtcctagtctgttagtggctgtagagcaatctgtaggatggtcacactacctttttttttgggaggcggggggcagagtctcgctctatcgcccaggctggagtgcagtggcgcaatctcggctcactgcaagctccgccttccgagttcacaccattctcctgcctcagcctcccgagtagctgggactacaggggcctgccaccacgcccagctaatttttttgtatttttttgtagagacgggktttcaccgtgttagccaggatggtctcgatctcctggccttgtgatccgccttccttggcctcctaaagtgctgggattacaggcgtaagccaccacgcctggcccacaccaccttttatgtaatcctttctgagtcatgggctggcttggttgtatgttgttatagtagttgttttgctattataaacaatgctgaaatataatccttgattatatactttaagctgttgtgcaagtatttgtgtaggatagattcccagaaattgagttgctgagtcaaagaatgtgtgtgtatttta

SEQ ID NO: 166295 - DNA, 601 bp, Human
atggggccaccctttaaagtttgttcatacttctgtcctagtctgttagtggctgtagagcaatctgtaggatggtcacactacctttttttttgggaggcggggggcagagtctcgctctatcgcccaggctggagtgcagtggcgcaatctcggctcactgcaagctccgccttccgagttcacaccattctcctgcctcagcctcccgagtagctgggactacaggggcctgccaccacgcccagctaatttttttgtatttttttgtagagacggggtttcaccgtgttagccaggrtggtctcgatctcctggccttgtgatccgccttccttggcctcctaaagtgctgggattacaggcgtaagccaccacgcctggcccacaccaccttttatgtaatcctttctgagtcatgggctggcttggttgtatgttgttatagtagttgttttgctattataaacaatgctgaaatataatccttgattatatactttaagctgttgtgcaagtatttgtgtaggatagattcccagaaattgagttgctgagtcaaagaatgtgtgtgtattttaaattttgatatgttctgaga

SEQ ID NO: 166296 - DNA, 601 bp, Human
agtttgttcatacttctgtcctagtctgttagtggctgtagagcaatctgtaggatggtcacactacctttttttttgggaggcggggggcagagtctcgctctatcgcccaggctggagtgcagtggcgcaatctcggctcactgcaagctccgccttccgagttcacaccattctcctgcctcagcctcccgagtagctgggactacaggggcctgccaccacgcccagctaatttttttgtatttttttgtagagacggggtttcaccgtgttagccaggatggtctcgatctcctgrccttgtgatccgccttccttggcctcctaaagtgctgggattacaggcgtaagccaccacgcctggcccacaccaccttttatgtaatcctttctgagtcatgggctggcttggttgtatgttgttatagtagttgttttgctattataaacaatgctgaaatataatccttgattatatactttaagctgttgtgcaagtatttgtgtaggatagattcccagaaattgagttgctgagtcaaagaatgtgtgtgtattttaaattttgatatgttctgagaaattttgatatgtttca

SEQ ID NO: 166297 - DNA, 601 bp, Human
tctgcctgcctcactctgccttcctctttgtgtttctcttagtatttttcattacagttgcacatagtaggtgcaccatctatgcctgtaggatccgttcttccatctacaagggaagagaactaatcagagtgcacagtaactatatgctaggcatttgctgtgtgcactacataaaatagtatgtttatctgaataaccagtacattaaagagagtcaggctgggtgtggtggctcatgcctgtaatcccagcactttgggaggctgaggcgggtggatcacctgaggtcaggagttcragacctgcctgaccaacatggtgaaaccccatctctactaaatacaaaacattagccaggagtggtggtgcgtgcctgtaaccccagctacttgggaggctgaggcaggagaatcacttgaacccagtaggcagaggttgcagtgagccgagattgcaccagtgcactccagcccagtcaacaagtgtgaaactccatctcaaaaaataaaataaaataagagagagagagagagagagaaagagagcacatgcactggtgagctggcttgtcatccccatatagttcttattctctttt

SEQ ID NO: 166298 - DNA, 601 bp, Human
aggctgggtgtggtggctcatgcctgtaatcccagcactttgggaggctgaggcgggtggatcacctgaggtcaggagttcaagacctgcctgaccaacatggtgaaaccccatctctactaaatacaaaacattagccaggagtggtggtgcgtgcctgtaaccccagctacttgggaggctgaggcaggagaatcacttgaacccagtaggcagaggttgcagtgagccgagattgcaccagtgcactccagcccagtcaacaagtgtgaaactccatctcaaaaaataaaataaaataagagagagagagagagagagaaagagagcacatgcactggtgagctggcttgtcatccccatatagttcttattctctttttcatttagtaatagaacccttgaattttagatggttcatggctatcaagaataatgatcctagcctctctacccactgtggccaagtgacatgtgcaatttctgggtttagcacttgaaaggaagggacttacattccctttctccttttatgctggctggtatatgggcccacaagatgtggaggtgagcgtcttcaactgggcgtggcagagtaaca

SEQ ID NO: 166299 - DNA, 601 bp, Human
gctgggtgtggtggctcatgcctgtaatcccagcactttgggaggctgaggcgggtggatcacctgaggtcaggagttcaagacctgcctgaccaacatggtgaaaccccatctctactaaatacaaaacattagccaggagtggtggtgcgtgcctgtaaccccagctacttgggaggctgaggcaggagaatcacttgaacccagtaggcagaggttgcagtgagccgagattgcaccagtgcactccagcccagtcaacaagtgtgaaactccatctcaaaaaataaaataaaataagagagagagagagagagagaaagagagcacatgcactggtgagctggcttgtcatccccatatagttcttattctctttttcatttagtaatagaacccttgaattttagatggttcatggctatcaagaataatgatcctagcctctctacccactgtggccaagtgacatgtgcaatttctgggtttagcacttgaaaggaagggacttacattccctttctccttttatgctggctggtatatgggcccacaagatgtggaggtgagcgtcttcaactgggcgtggcagagtaacaca

SEQ ID NO: 166300 - DNA, 601 bp, Human
ccaacatggtgaaaccccatctctactaaatacaaaacattagccaggagtggtggtgcgtgcctgtaaccccagctacttgggaggctgaggcaggagaatcacttgaacccagtaggcagaggttgcagtgagccgagattgcaccagtgcactccagcccagtcaacaagtgtgaaactccatctcaaaaaataaaataaaataagagagagagagagagagagaaagagagcacatgcactggtgagctggcttgtcatccccatatagttcttattctctttttcatttagtaatrgaacccttgaattttagatggttcatggctatcaagaataatgatcctagcctctctacccactgtggccaagtgacatgtgcaatttctgggtttagcacttgaaaggaagggacttacattccctttctccttttatgctggctggtatatgggcccacaagatgtggaggtgagcgtcttcaactgggcgtggcagagtaacacagcaaaaggaagccgggtgcctctgtaccatggcatcactctaccagccctgaagagttactgagagagaaataaacatctgtcttctctaag

SEQ ID NO: 166301 - DNA, 601 bp, Human
gcaccagtgcactccagcccagtcaacaagtgtgaaactccatctcaaaaaataaaataaaataagagagagagagagagagagaaagagagcacatgcactggtgagctggcttgtcatccccatatagttcttattctctttttcatttagtaatagaacccttgaattttagatggttcatggctatcaagaataatgatcctagcctctctacccactgtggccaagtgacatgtgcaatttctgggtttagcacttgaaaggaagggacttacattccctttctccttttatgctrgctggtatatgggcccacaagatgtggaggtgagcgtcttcaactgggcgtggcagagtaacacagcaaaaggaagccgggtgcctctgtaccatggcatcactctaccagccctgaagagttactgagagagaaataaacatctgtcttctctaagccactgtcatttagacagaagccagattttatttgatccaatgtgggtaggttcatattctcccttcagaagcaaagaaactctggctcagagaagtttatgaaggactcacccaagaccacccagctagtgcaggcagaacc

SEQ ID NO: 166302 - DNA, 601 bp, Human
tcttctcacttttcctcggtatttttttttttttttttttgagatggagtctcgctctgttgcccaggctggagtgcagtggcgtgatctcggctcactgcaccctccgcctcccgggttcaagcaattcccctgcttcagcctcccgagttttcctcagtatttctgagcactttgcagtgtcaggcttccagctggcactctggagtcatcatctcattttactccaaccacattcctagaaggaagacagtttgattgtcatcaatgatgctgaggttcagaaggattaagtgatcayttaatgttactcagaggccgaagcaaaacggagatttgtctgtgtgtaaagttctcattcttcctaccacaccacactgccttaaaatgtctctgggtctcacaccacagcaggtaagtaaggggtttgcagttcctgacctgttcttccctgtgtgtgggcattctttcagtgactgttggtagacatttttgacaattctggctgattcctttgaatgtcaaggataaaactctctttcactctgccaagtttttcaccaactttcatcaccctggcaggaatttttctaatctattt

SEQ ID NO: 166303 - DNA, 601 bp, Human
caattcccctgcttcagcctcccgagttttcctcagtatttctgagcactttgcagtgtcaggcttccagctggcactctggagtcatcatctcattttactccaaccacattcctagaaggaagacagtttgattgtcatcaatgatgctgaggttcagaaggattaagtgatcacttaatgttactcagaggccgaagcaaaacggagatttgtctgtgtgtaaagttctcattcttcctaccacaccacactgccttaaaatgtctctgggtctcacaccacagcaggtaagtaaggrgtttgcagttcctgacctgttcttccctgtgtgtgggcattctttcagtgactgttggtagacatttttgacaattctggctgattcctttgaatgtcaaggataaaactctctttcactctgccaagtttttcaccaactttcatcaccctggcaggaatttttctaatctattttttaaacattctagctgtgaatagtcatagataatttacaaaagagaaaccacaaatagcaaatatacaaaattatttaatcactctaataataatggaaaacaaattcaacaaggtgtcattt

SEQ ID NO: 166304 - DNA, 601 bp, Human
tacattaaaacatagcagaaaaatgttttagagatgttattcaatgcttgatgtcactgtaaattgataaagtgctttgggaaaacaatttgacaatatgtgtcaagaattagaaaaatatcacagtctttgacctaggtcacactttagggtacttttggtgccctattccaaacaagtgatttgaaatgcacatacagcctatatgctcaaatatgttctccagagcattctttataatactgaaatactgggaactggactcaaatatccactgacaagtaaacagttacatcaaagkgtacacttactggagggagtagaatatagcccttaaagacaatggtaggataatcatacagcaagcagaagaccccatgaataatccaaggggaaaaaaccaaccttagcgcttataggttataatattggccaaaaattcagtagacttttaatctgcaggattggtgatgatatgagaaaacagacatatagtactggaatgaggactcagtgtggcactaagggccaaaggcaaacatcagatcttttaacttagctggaaggctctatcctaaatgccccaggccacagagacagg

SEQ ID NO: 166305 - DNA, 601 bp, Human
gaaaaatgttttagagatgttattcaatgcttgatgtcactgtaaattgataaagtgctttgggaaaacaatttgacaatatgtgtcaagaattagaaaaatatcacagtctttgacctaggtcacactttagggtacttttggtgccctattccaaacaagtgatttgaaatgcacatacagcctatatgctcaaatatgttctccagagcattctttataatactgaaatactgggaactggactcaaatatccactgacaagtaaacagttacatcaaagggtacacttactggaggragtagaatatagcccttaaagacaatggtaggataatcatacagcaagcagaagaccccatgaataatccaaggggaaaaaaccaaccttagcgcttataggttataatattggccaaaaattcagtagacttttaatctgcaggattggtgatgatatgagaaaacagacatatagtactggaatgaggactcagtgtggcactaagggccaaaggcaaacatcagatcttttaacttagctggaaggctctatcctaaatgccccaggccacagagacaggactactcatctctactt

SEQ ID NO: 166306 - DNA, 601 bp, Human
aatatccactgacaagtaaacagttacatcaaagggtacacttactggagggagtagaatatagcccttaaagacaatggtaggataatcatacagcaagcagaagaccccatgaataatccaaggggaaaaaaccaaccttagcgcttataggttataatattggccaaaaattcagtagacttttaatctgcaggattggtgatgatatgagaaaacagacatatagtactggaatgaggactcagtgtggcactaagggccaaaggcaaacatcagatcttttaacttagctggaagkctctatcctaaatgccccaggccacagagacaggactactcatctctacttgtttaggaatagtggggtaaagggcttttaatctgcaaaggtttcaaatgaaataaacaactgttgatgtaaatccacccattttattaatagttttgtggtaaatttagggacaatctgtatgttttggtatttaattattggcaatattttagagaatgtagcatataagaacagctgttggattaaacctgtgatgccagtatatgggttactattaagtaactaattctttttcttttttttttt

SEQ ID NO: 166307 - DNA, 601 bp, Human
acagagacaggactactcatctctacttgtttaggaatagtggggtaaagggcttttaatctgcaaaggtttcaaatgaaataaacaactgttgatgtaaatccacccattttattaatagttttgtggtaaatttagggacaatctgtatgttttggtatttaattattggcaatattttagagaatgtagcatataagaacagctgttggattaaacctgtgatgccagtatatgggttactattaagtaactaattctttttctttttttttttttttttttggagacaggttatcgytctgtcacccaggcatggagtgcagtggtgtgatcatggcatattgtaacctcaacctcctgggttcaagtgatcctcctgcctcatcctttcaagtggctgagactacaggagcaagccagcactactggaaaattttcttttcccttccttccttcctttttttttttttttttttgatggagtcttgctctgtcacccaggctagagttcagtggcttgatcttggctcatcactgcagcctccacctcctgggctcaagtgattctcctgcctcagcctgccaagtagctgggccc

SEQ ID NO: 166308 - DNA, 601 bp, Human
gtggggtaaagggcttttaatctgcaaaggtttcaaatgaaataaacaactgttgatgtaaatccacccattttattaatagttttgtggtaaatttagggacaatctgtatgttttggtatttaattattggcaatattttagagaatgtagcatataagaacagctgttggattaaacctgtgatgccagtatatgggttactattaagtaactaattctttttctttttttttttttttttttggagacaggttatcgctctgtcacccaggcatggagtgcagtggtgtgatcatgkcatattgtaacctcaacctcctgggttcaagtgatcctcctgcctcatcctttcaagtggctgagactacaggagcaagccagcactactggaaaattttcttttcccttccttccttcctttttttttttttttttttgatggagtcttgctctgtcacccaggctagagttcagtggcttgatcttggctcatcactgcagcctccacctcctgggctcaagtgattctcctgcctcagcctgccaagtagctgggcccacaggtgtgagctaccacgcctggctgatttttgtattt

SEQ ID NO: 166309 - DNA, 601 bp, Human
tgtatgttttggtatttaattattggcaatattttagagaatgtagcatataagaacagctgttggattaaacctgtgatgccagtatatgggttactattaagtaactaattctttttctttttttttttttttttttggagacaggttatcgctctgtcacccaggcatggagtgcagtggtgtgatcatggcatattgtaacctcaacctcctgggttcaagtgatcctcctgcctcatcctttcaagtggctgagactacaggagcaagccagcactactggaaaattttcttttcycttccttccttcctttttttttttttttttttgatggagtcttgctctgtcacccaggctagagttcagtggcttgatcttggctcatcactgcagcctccacctcctgggctcaagtgattctcctgcctcagcctgccaagtagctgggcccacaggtgtgagctaccacgcctggctgatttttgtatttttagtggagatgaagttttaccatgttggccaggctggtctcaaactcctgacttcaggtgatccttctgccttggcctcccaaagtgctgggattataggtgtgaa

SEQ ID NO: 166310 - DNA, 601 bp, Human
ctattaagtaactaattctttttctttttttttttttttttttggagacaggttatcgctctgtcacccaggcatggagtgcagtggtgtgatcatggcatattgtaacctcaacctcctgggttcaagtgatcctcctgcctcatcctttcaagtggctgagactacaggagcaagccagcactactggaaaattttcttttcccttccttccttcctttttttttttttttttttgatggagtcttgctctgtcacccaggctagagttcagtggcttgatcttggctcatcactgcascctccacctcctgggctcaagtgattctcctgcctcagcctgccaagtagctgggcccacaggtgtgagctaccacgcctggctgatttttgtatttttagtggagatgaagttttaccatgttggccaggctggtctcaaactcctgacttcaggtgatccttctgccttggcctcccaaagtgctgggattataggtgtgaaccaccatgctcagccaagtaactgattttaggcttgggatttttagtaggaagttataagagaattttactaagttttgaaccagtattggaattt

SEQ ID NO: 166311 - DNA, 601 bp, Human
gctcagccaagtaactgattttaggcttgggatttttagtaggaagttataagagaattttactaagttttgaaccagtattggaatttgtaaaagaattaagattaaattttatacatttattaggtttactacaatcaagtaattgagaaagttttgctaatttaaagtcatttaaaatattttttaaaaaagatgtaatattttaatatttaagttgaaaataacctgaagccttgcccagtggctcatgcctgtaaccgtagcactttgggagttcagtgcgggaggatcacttgarcccaggcattcaagaccagcctaggcaacatggcgagaccccgcctctacaagcaaacaaacaaaaaattggctgggtatgttggtgtgcacctatggtcccagctactcaggagtctgaggcaggaggattctctaaacccgggaaggtcaatgcttcaacgagctgtagtcatgccactgcactccagcctgggtgacagaatgagaccctgtctcaaagaataataataataataataacttaacctgaaataacttgagtttaaaacatcacaggaattaagtaagtgtgacaaat

SEQ ID NO: 166312 - DNA, 601 bp, Human
atctaaggataatttgcagggcagcagcaggtcctgttgtctagagaagctttttgctcaggaaagaatgtcttgagatggtatttcaatgacgtgtgtgctcaggattgcagaaataggaattagttatattgagcaggttcagcatgcatgtgttcattgcattcctggaaagagaactcaaactatcaaagttggttttctatggaaagtgcaaatggggagactaagagacttttactttccactttataacttcctatatactatgtacatttctccacagtgtgcacaatttgctttttttttttttatactggtagcagtagaatttattcaaatgtgccttaatataggcactggggcttgcctatggtgctctcgatatataaggcccggacattctgccagtttttctgccagtttttcttgagcaatgtcaccaagaagttgacaggcaggtgactgttacacacaagctcattgtctgtccttttcacgtggccaacagccacagccagacataacaccttcttcatgtggaaattgattacggacttcatctcatccactttggccaccatgttttccttgtgtgtga

SEQ ID NO: 166313 - DNA, 601 bp, Human
attgtctgtccttttcacgtggccaacagccacagccagacataacaccttcttcatgtggaaattgattacggacttcatctcatccactttggccaccatgttttccttgtgtgtgagcagggaggggcaatttcctgccttatttaggactgggccgaggattcgtgggatctgcttgatcagagactctgaggccaaaaatgcatcatactcttggccagtttcttgaccagtttcttattcttgttgagttttttcagtacctcgttttccatgtggtggaaatccacaggcttgrccttgtcacagtgctgctggttacccaggacacacatggagaacttggggcagggagtggacttaagcctgacggtgcccgagaagcgcttgtccttctggggagtcatagttcttgaagctgatctgcaactccaccatctccagaaacttggggtgcttgcgctggtttcggtgcaggacttcgcgcaccgcctcctacggggtgtcacgggagactttgctgctcatggcttctcgctccgcgctaaccagaaaagagactaatactgcacatatatttttgagcgtagattccata

SEQ ID NO: 166314 - DNA, 601 bp, Human; identical to SEQ ID NO: 18531

SEQ ID NO: 166315 - DNA, 601 bp, Human; identical to SEQ ID NO: 18532

SEQ ID NO: 166316 - DNA, 601 bp, Human; identical to SEQ ID NO: 18533

SEQ ID NO: 166317 - DNA, 601 bp, Human; identical to SEQ ID NO: 18534

SEQ ID NO: 166318 - DNA, 601 bp, Human; identical to SEQ ID NO: 18535

SEQ ID NO: 166319 - DNA, 601 bp, Human; identical to SEQ ID NO: 18536

SEQ ID NO: 166320 - DNA, 601 bp, Human; identical to SEQ ID NO: 18537

SEQ ID NO: 166321 - DNA, 601 bp, Human; identical to SEQ ID NO: 18538

SEQ ID NO: 166322 - DNA, 601 bp, Human; identical to SEQ ID NO: 18539

SEQ ID NO: 166323 - DNA, 601 bp, Human; identical to SEQ ID NO: 18540

SEQ ID NO: 166324 - DNA, 601 bp, Human; identical to SEQ ID NO: 18541

SEQ ID NO: 166325 - DNA, 601 bp, Human; identical to SEQ ID NO: 18542

SEQ ID NO: 166326 - DNA, 601 bp, Human; identical to SEQ ID NO: 18543

SEQ ID NO: 166327 - DNA, 601 bp, Human; identical to SEQ ID NO: 18544

SEQ ID NO: 166328 - DNA, 601 bp, Human; identical to SEQ ID NO: 18545

SEQ ID NO: 166329 - DNA, 601 bp, Human; identical to SEQ ID NO: 18546

SEQ ID NO: 166330 - DNA, 601 bp, Human; identical to SEQ ID NO: 18547

SEQ ID NO: 166331 - DNA, 601 bp, Human; identical to SEQ ID NO: 18548

SEQ ID NO: 166332 - DNA, 601 bp, Human; identical to SEQ ID NO: 18549

SEQ ID NO: 166333 - DNA, 601 bp, Human; identical to SEQ ID NO: 18550

SEQ ID NO: 166334 - DNA, 601 bp, Human; identical to SEQ ID NO: 18551

SEQ ID NO: 166335 - DNA, 601 bp, Human; identical to SEQ ID NO: 18552

SEQ ID NO: 166336 - DNA, 601 bp, Human; identical to SEQ ID NO: 18553

SEQ ID NO: 166337 - DNA, 601 bp, Human; identical to SEQ ID NO: 18554

SEQ ID NO: 166338 - DNA, 601 bp, Human; identical to SEQ ID NO: 18555

SEQ ID NO: 166339 - DNA, 601 bp, Human; identical to SEQ ID NO: 18556

SEQ ID NO: 166340 - DNA, 601 bp, Human; identical to SEQ ID NO: 18557

SEQ ID NO: 166341 - DNA, 601 bp, Human; identical to SEQ ID NO: 18558

SEQ ID NO: 166342 - DNA, 601 bp, Human; identical to SEQ ID NO: 18559

SEQ ID NO: 166343 - DNA, 601 bp, Human; identical to SEQ ID NO: 18560

SEQ ID NO: 166344 - DNA, 601 bp, Human; identical to SEQ ID NO: 18561

SEQ ID NO: 166345 - DNA, 601 bp, Human; identical to SEQ ID NO: 18562

SEQ ID NO: 166346 - DNA, 601 bp, Human; identical to SEQ ID NO: 18563

SEQ ID NO: 166347 - DNA, 601 bp, Human; identical to SEQ ID NO: 18564

SEQ ID NO: 166348 - DNA, 601 bp, Human; identical to SEQ ID NO: 18565

SEQ ID NO: 166349 - DNA, 601 bp, Human; identical to SEQ ID NO: 18566

SEQ ID NO: 166350 - DNA, 601 bp, Human; identical to SEQ ID NO: 18567

SEQ ID NO: 166351 - DNA, 601 bp, Human
gcgaagcagctgtgcgattgctgggaagtgcctaaagaagatccccatccaactccaggagccccatggatttccttatcacctctgtgtggtcagcagccatggtccagcctaccttccctagtgctgtgatctgtccaccactacaggcccgaccctcgtctaattgaatctgtacagcagaatagacatagcaaatgagggttacttcttgagtcaaatacatttgattgggaagagctgcctggaaagtgttaagaattatgagaccacattgggacttgatgggaaacggtgcagygacccataaacaacatctgccacgaatgtgaaagataaaagtcgctccagtggccagcctctagaaagaagaatcctgggtgaagattgattgcattgtcattgtcttaaaatgaatatgagtcgtggcttttagtgtttcgttttcttctattttttttctcctttcagagaaaataaaactagcatggtgatcttcctattgaaggaggcatattgagaaacatcctaattctagactagcatttactttttatttagaaagacttatgcaatgtgtataaaattacaagatttgtga

SEQ ID NO: 166352 - DNA, 601 bp, Human
agattctattaaaacagaagtcagagcacattgctcttctactaataccattgaagagtttcctgcaccactcacatttaaagcccgagactatatagctccttccaaagccctgcatctttcctggcctcctttcccacttttgtgtctctcatccctcatttctgtgttataaatagtgtcatagataaacaaagctggacactcctaaagtggtagggacagattttaatcaacaatggattttacagaagtaactgggcattttaaagggagaattagggagtaggaaaaagtagtrtgtgggggctcagtagagtcagggaagtaaaacattacaaaaggttagttggcgtaaacccgatggggccagctgtgtttgctagctggaaattactgaagctatgattccatcccgtcacagagactggaaggcaaaggctctattctcaggtattggctagagcaaacagtagatttttttggcagccttgagtcttgtcttctcaagcaagcactttaagcggagctagagtcatcttagggatatggcattgagctgttagaaactgttagtgtttgttcaagtctttgtaagcca

SEQ ID NO: 166353 - DNA, 601 bp, Human
tcccgtctcagaattcctactacttttttagtccttacaacaaggcttaacacttcaccatttcctaatggcagactttgtctcatccattagattctaaagtttctgagtgaaaagagtatttttatatctatttttatgcccctggagcaatacatacatagcaaaaaagatcttaaagatccttttctttccttttccttgtaatgtatttgtgaagaaatcagggtatttattcgatagagtatcatacattttaggttttgctgattgcatcactagagtatcatttaacatgttyctctgttctttttcttttttgtgctggtgcatctagaggctagatcagatttagattagagtttttggcaagaatgtttcatagatggtggtatgtattaccagcagaaggtaatctgattgtctctcttcttgtaatgttaatactacctattaatgaggaaatgtgaggttgataatccattataaagtcttttgtcagcttattatctattgcttttagttgccataaatgatcatcattgccgtggttaattagaagttacgtatgataagtattcttctcattccttctgaattt

SEQ ID NO: 166354 - DNA, 601 bp, Human
aagtttaagggaaatgaataggtcacagaatcactgtgagggaggtagggagaagcagaataactttgcccttgaccattatggttaaatatatgactccatcactaaacataagtaccccatgtctgtttcacctctcctttgaaaggaaaaaagtataatttttcagaaggcacagtttcttcatattaacttagaattgaattggctttccatctcttatttctgtcaacattatcaggcttgctaaactgggaatgggcattttatcattctgtcttcttatatcttagtagctagytaagagactcagtggaaactgcctagatgagtatatttaattgatgatagatgaaaagacaaggatttcaaaaattctgaacaggtcaatacattgaaatgggcctggttacctgaaaattatctactgatgaataaacttagaatgctgtcaggacctattgtttgcctacttttcagacatctcctgttctttcttgcctaagagaaattcccttttgttccagcattggccttccctttcctgattagactaagccaattctggtcattccttttctcttcctaatgattgctttag

SEQ ID NO: 166355 - DNA, 601 bp, Human
gcctccttaccttcctttcaaatccactccccagtcatgtctattttaccttttaaatgtctctagaatctgccctcttttctccttctctactgtcatcacctagctttaagctacaatttttctgaatagttacatggcatcttcactaacctcatctggttaatttccatgtcattttcctacaaaaaaaaaaaatgtctgtggctttctgtggctgtcatgaaaaacaaaacaaccaaaattcttaaatgaactacaggccctgcattgtgtgccacatctacatgcccagtccaayttaaaacatgttcctctgtctgtgtgtactggcttttgttttttctgtcacaccaagttctgtctaattacacggcctttgaaaatactatttcttacgctaaaacattgccaaccccccttgacctagagcatttcctctgaattattagcttttgtagcaatctatatttcttctttgtagcacttaaaacagtaaaaatttaacatttatgtgtaattatttctttgctaaactagtagactaagttttatgagggcagagactatgtatacttttgctcacagttttgtgaatgta

SEQ ID NO: 166356 - DNA, 601 bp, Human
acaatttttctgaatagttacatggcatcttcactaacctcatctggttaatttccatgtcattttcctacaaaaaaaaaaaatgtctgtggctttctgtggctgtcatgaaaaacaaaacaaccaaaattcttaaatgaactacaggccctgcattgtgtgccacatctacatgcccagtccaatttaaaacatgttcctctgtctgtgtgtactggcttttgttttttctgtcacaccaagttctgtctaattacacggcctttgaaaatactatttcttacgctaaaacattgccaamcccccttgacctagagcatttcctctgaattattagcttttgtagcaatctatatttcttctttgtagcacttaaaacagtaaaaatttaacatttatgtgtaattatttctttgctaaactagtagactaagttttatgagggcagagactatgtatacttttgctcacagttttgtgaatgtagaacagtgtctggttcctgggaattactcatatatgtttgctaagtgaatgaatggatgggtagaagaatggctttctgtgcagccattgaaagagatttaaaggtaggcaagta

SEQ ID NO: 166357 - DNA, 601 bp, Human
caaggtgcccactggactgagagctgtgcggttatctccctgaatgtaagaagacatttttgggtggtagaagatttacatctcaaaggagcagagaaaggatttacagttgcaagctttctgaagtaactgctctaagagagggtttatgcttgttaccaggttttggctagaacaaataataaaatctcctggaagcatctccttgaagggtgataggatcacatgaggggtgcagctgtgacctgttagaaactgtgctaatgtgtttcttcaggtctcttaatgtgtgtgtgtgtgkggggggggcgggggggaagagggtagacaaaatcagcacaaatccttattagcaaaataaagttgaatctattataaagacttctaagaaatgaaacaatgctgaaatgagaagaaaatggcatatataaaagtagtaactaagaatagatcacatctcagtaatttttcaaattttaagatatttgtttgatgtgtacttgaacccccttgttttttaacacacaagtagaaacataggtacaaaattcacaattttttggtgctaattgttaggtttagaaatgccaaatgatttcta

SEQ ID NO: 166358 - DNA, 601 bp, Human
tatgaaaagccattgtgcatgaattcagcaaacttaaaattctgctacatataagttattgggtaatagggatgtgaagtatgatgcctgtttaaggaagtcacaggctagcagaattctagacaagaataaaagtgttaaaacatataaaaaggactttctccttgaacttttcaaatttctgaagaaaattacaaaagacaatacaatttacattattaatactaggacagactctcttgatggcattaaaagtcaaaattcgatttgaataactcactattttggctttatgtttatwtgctagttatataacccatcttaaacatacttctaaattttgagcaaataccatcacagtcattatggaactcatatgtgtatatgcctgttatatttacatatgagcatatagcatgtgtgatgtgtctatatatctgtatttaattattgaatgtgaattacagtaggtgtttgaagaactgcaatgatgaagataaaaatatgttttatattttgaacaaaattatagctttccctagggcattgtgtgttttttttgttgttttaataagaaaccatagaatttgaatgggtgaaa

SEQ ID NO: 166359 - DNA, 601 bp, Human
attgctggtttctctacttggttatgtgtgttcttcagaatctttctatgtcctaagtctggcagaagaatcaaaatttgacgtgcagacttggatatccacttagaagggaaaaatggagaactaaatgacattctcccccaggtcacgttcttagagaattttgtggccctgattatagtctgatgttagcttaaaaagcccataaatcccaaacaccccatgcaatgaggagaaattttgcttagaactccaggatttagacctagacatctctcttttcaacatgtcatccacacayatggtttcaggtcttttatttcagacgacattatcctttgagaaaccctccaacctctgtgctttcagtgtcatcagatttcctttaattactgtgtgtgagtcacttttttggagtcttagtccttcaaaggtatttcattcccaggacttactcacctataaaatgttcgctgatctcatacatcaggcaatctgaactgttagctcccattgagaccgaagtaccatttccacttaagcaactgtcatcttaatattgagttagaagagtcagtggcacttttaatcttaccggata

SEQ ID NO: 166360 - DNA, 601 bp, Human
gctggtttctctacttggttatgtgtgttcttcagaatctttctatgtcctaagtctggcagaagaatcaaaatttgacgtgcagacttggatatccacttagaagggaaaaatggagaactaaatgacattctcccccaggtcacgttcttagagaattttgtggccctgattatagtctgatgttagcttaaaaagcccataaatcccaaacaccccatgcaatgaggagaaattttgcttagaactccaggatttagacctagacatctctcttttcaacatgtcatccacacatatrgtttcaggtcttttatttcagacgacattatcctttgagaaaccctccaacctctgtgctttcagtgtcatcagatttcctttaattactgtgtgtgagtcacttttttggagtcttagtccttcaaaggtatttcattcccaggacttactcacctataaaatgttcgctgatctcatacatcaggcaatctgaactgttagctcccattgagaccgaagtaccatttccacttaagcaactgtcatcttaatattgagttagaagagtcagtggcacttttaatcttaccggatataa

SEQ ID NO: 166361 - DNA, 601 bp, Human
taaaattgaactccagatctgtctttctgcctgggtgctcttttcaccctgcaacactctctgtcaacagtgaatcttcagataaagtgaatgttttgttaaataatgcattgccctggaatagtactttgaagtttataaagtctcatttgatttacagaataactctgtgatgtaagtgtacttatccctgttttccgtgagagaaaactaaggcttggtaagattcagtaacttaaaaaaaattaagtaacttgcataatatgatacaacttattaatgcattccagtattcataaaytcaaaatgtcatgcatgtataagatcaagaactcttaagagaggctgggcgcagtagctcacacctgtaatcccagcactttgggaggctgaggcaggtggatcatctgagatcaggagttcaagactagcctggccaacatggtgaaatcccttctctactaaaaatacaaaaaattagccgggcatggtggtgggcacctgtaatcccagctactcaggaggctgaggcaggagaatcgcttgaacccaggaggcggaggttgcagtgagtcaagtatcgcgccattgcactccagcc

SEQ ID NO: 166362 - DNA, 601 bp, Human
aaaaagtatacttctgcctgtaaatattttctctctagattttttaaagctcactagcaagctttattaacagtaagactaataagaatattcagattccaaaaaatcactgagataatggacttcagtaatctagttggtaactggtttcctcaatgacatttttgtagatacctcttttcacagcagaagaaaagtaatgccacttaaatgctcctaagaggtctatttcctatattcaatcacaaaataaaataaatatgaatatatacaaaacaaaatgggagaatgggtttatgtwtgtcttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatgtatgtcttttaaataatcaatagagacagaattttgttttgctctgtttctttcaaaatgagtgaattgtcctcttaaagtgtaagtgattactctggttctgaagtgggaactatgagtagaatt

SEQ ID NO: 166363 - DNA, 601 bp, Human
aggggttctcaaacactcaggctcatgtcgattccttatctatccatacgtggcacttcatgaactcatccattgtccactgctgtaaggcacagaccccagccaccctttagataatgctgaacactcccctagacacctgttgctctaccagtgatcgctatgcactttatttaaatgcccctttccttactatagatcgttagcatgaggaaggggccctgttcccaaggcaaccaagatcaatgcttgttactcctgctgctgcatttagtcaaactccaactgcattcgggttcayactcttgtgttcacaggtgtaaatattaagatttctccttgtcttgtttgcttttctactatgtcttgctgacttatatatattctcctgaattctctaatttgacagtatatttctaagtaacctgatatgtttccctttccaaatacattagctatctctccagcaactaagtttggaagtagatgtccatctctgcctatgaaataccctttaggacctttgctaagagagccccatggggtagaaaggaccatagattgccagcattcagaacgaggacagtaaatgcagtctccc

SEQ ID NO: 166364 - DNA, 601 bp, Human
ctatgcactttatttaaatgcccctttccttactatagatcgttagcatgaggaaggggccctgttcccaaggcaaccaagatcaatgcttgttactcctgctgctgcatttagtcaaactccaactgcattcgggttcacactcttgtgttcacaggtgtaaatattaagatttctccttgtcttgtttgcttttctactatgtcttgctgacttatatatattctcctgaattctctaatttgacagtatatttctaagtaacctgatatgtttccctttccaaatacattagctatckctccagcaactaagtttggaagtagatgtccatctctgcctatgaaataccctttaggacctttgctaagagagccccatggggtagaaaggaccatagattgccagcattcagaacgaggacagtaaatgcagtctccctctggaaaagggtgttgaaagaatgattttatgtcattgaaaatgtactataatcaaatatattatcaattaatatatttattaatacactaataaatatatataaattaatatatatataaatggaccagcctatgaacctaacttagaaataaaattt

SEQ ID NO: 166365 - DNA, 601 bp, Human
tcaaactccaactgcattcgggttcacactcttgtgttcacaggtgtaaatattaagatttctccttgtcttgtttgcttttctactatgtcttgctgacttatatatattctcctgaattctctaatttgacagtatatttctaagtaacctgatatgtttccctttccaaatacattagctatctctccagcaactaagtttggaagtagatgtccatctctgcctatgaaataccctttaggacctttgctaagagagccccatggggtagaaaggaccatagattgccagcattcaraacgaggacagtaaatgcagtctccctctggaaaagggtgttgaaagaatgattttatgtcattgaaaatgtactataatcaaatatattatcaattaatatatttattaatacactaataaatatatataaattaatatatatataaatggaccagcctatgaacctaacttagaaataaaatttatttttagattaaaaatatgctttgagttatacacaaataacttttcattttttggaatagaacataatcttaaactgttaactctctatagtgctgagagaaggttttgctga

SEQ ID NO: 166366 - DNA, 601 bp, Human
aatatatttattaatacactaataaatatatataaattaatatatatataaatggaccagcctatgaacctaacttagaaataaaatttatttttagattaaaaatatgctttgagttatacacaaataacttttcattttttggaatagaacataatcttaaactgttaactctctatagtgctgagagaaggttttgctgaaaacaaagaaataaataatatttgtgtttggggaacaaagacagagattatctgctctaaaaattgaccatgctggtttcagtagaacagacagattstgagactgctgacttccaaagtattgacaaagctttaatttcctcaaaaaaggcaagcagacctttccagatcaccacaactaaagtagctcatcatactggcgcaggttcccgcaaaccctaatctctaccctctataaaaccctgtacttcacttttcaatctaattcccctcagcgttgtaaggacccctaacagatactgcattgatactccagagaaaacacatgatatatgcttgtttttaaaaatatgttactgtaataatttcttataaggagttaattttgttttataatt

SEQ ID NO: 166367 - DNA, 601 bp, Human
agttatacacaaataacttttcattttttggaatagaacataatcttaaactgttaactctctatagtgctgagagaaggttttgctgaaaacaaagaaataaataatatttgtgtttggggaacaaagacagagattatctgctctaaaaattgaccatgctggtttcagtagaacagacagattgtgagactgctgacttccaaagtattgacaaagctttaatttcctcaaaaaaggcaagcagacctttccagatcaccacaactaaagtagctcatcatactggcgcaggttcccrcaaaccctaatctctaccctctataaaaccctgtacttcacttttcaatctaattcccctcagcgttgtaaggacccctaacagatactgcattgatactccagagaaaacacatgatatatgcttgtttttaaaaatatgttactgtaataatttcttataaggagttaattttgttttataatttatgtttaatctagggatagtaaaagtactgatattttaatatgtaaacatataattattctttgctgtaagagacagataagaaattttaacttttcaatagtagttttttat

SEQ ID NO: 166368 - DNA, 601 bp, Human
ggtgttttggaaattacacagaatgtgaagctgtaaaataatccttcaaaaacaatcaattgtattaaatgccatatcaaccatagtgtcaagcctatactagtgctgggtatactagtcttcctgcctgtaggagtttattgtattctagtaggtgagacaagcacaaaaggagtgtgtttataggcaataataataatgcatactggatctgaagtctgcagagagacaggagcgtacaagtatacctgaaagtggagaggtatgaagtctgggaaaggctttccagaagttggacccrgagcagggtatggaagggtgatcaggagctcccaggccagagcaggagggaagacaggttccagacaaaggtaaaagtagatgcagagacacgggagtgaaacagcatcttagacacaaagaactttgggtcatctgacgttgctggaatgtgaaatgcatagggaaaagtggcaagaaattagaagagaggtcaaaggtggggagcaagccataaagatccttgctaggacttgattcctaaagcactcagaatgctcttcagtcaagctgtaacctgactggattttcatttcctaat

SEQ ID NO: 166369 - DNA, 601 bp, Human
ttcagtcaagctgtaacctgactggattttcatttcctaatgccgctcagtcttgggcttgagtacatggaaaagctactagccttatgaagaaagtatggggctgtaggtggccagagtgagctaggattgcagcttaggaaggccagaatgactttttaaaaaatgtatagacttttaaattttctaaaacttaatattccataggaaataggatgtactctaattagaaatgaatgtcccacgtaggtgatagtatgtatggtaccaggtttggtgaccaaactctaagtccaggcaractggtaatggcacatcctagttttgttaccctcgctgagtttctaaacctctctttgctctcctcatctgtaaaatggtatcatagtggtatcataaaggtaccatacctttatataaataaaggtacctggttaagtagtcaataaatgttagctattatcattatagtcctcatgaaaggataaatttccctaaatacaatattttgtctagttacacataatatgaaaaggacgtggttacttttcaaagatgttgtagtttctcattatttttagacacagaactgttttgagtg

SEQ ID NO: 166370 - DNA, 601 bp, Human
ctaaccactcccactcccacaggcttcctgcctttcacgctgttccccactgctctcttcatggccctgacatgtttgtttattatgttctaggaattctgggaaaagaaggaatcattagaagtgctgggatttgcacattccatttcccgtttagtactaatttcttttatgttaattgactgttttacttgtaaaacgaaaaggataccctaaatagatacatgacctaaaaaagcatttgatgaaaaccattcaaatataatgtttaataatatggacagaatattctattagcaamataaaatcaaaccttccctagacccagaagagaacattctagccttcctatttctcccaatagaaacattattcttttcatccagtttggaaacccttcaccttatctccatttcttttcattacatattaattattcttttttccatctttaaaaactttcaaaactctttcttctcatggggtcatctgtcctcccccacacttttcgagtctcatttctttgcaagtacgtcttatccttgtttcacaatttaactgtgatgtacccctaataataactgaaagtaaagtaaaatct

SEQ ID NO: 166371 - DNA, 601 bp, Human
accttaaaaaatatatatattcttattaaattatagcttttggagaatataaactttctgtgttcccaacaaaatggatagttttgctgccaggttaccctccctttgtttatcatgagtctttagaggtttaagtaaaacaaaagagagacaacacattgttgcacaaaatagttgagaattccaatgggaatgaaaggaaaccttttatatatgtatacatacacacacacacacacacacacacacacatacacacacacacatatatatgaaaacaccctcaagactattcaaaaayttataatagagaattttatacgagaaatagttttcagctttatattttaaattgtgtttaaaaggactttttaaaatcaaagctcttcaatcccttttcatttcatgatttattttatctagtactttctttatggtttctagacttttgcagctacattctggactcagggaaaaacagataataattgggacaacgcaaaaggaaattcagattaacatttaaagtgtatatatatatataatgctatatatattttatatctataatgctatgtatataatgctatatatatatatc

SEQ ID NO: 166372 - DNA, 601 bp, Human
atagaacccttgttttttatttttgcctttttttctagtaaatagcatttattaaacattaatattagagaattatatttgatactcagatgtgtcaccaattagctgaattactttaagaggcaacacacttaatctctgtgacctctttttccctatccataaagtgtaagatttgaacttacactctctgagtaaatcatgtctggtttccctttcggttctgagattctgtgagtctatatatctgataaaataattcggcatggttatacatctctgcttaagcagaggaaagcartttctcaaaggcaagcccagacccttgtgaagcagtcattcagtttcatcttccttaaaattagattctgattgaatgctattttcaagtctcatccagtatctggaaatactcatttctttcattatcagactactctttggaagtcttaccacccaacaaccagcactacaatattgtcctatgttgtgatggcctctaaggcattatcagacttggctattttacatttctttttaaaaattattatttcaacttttccactgtaaatgtcctcaacattacaaaagcttcttgtac

SEQ ID NO: 166373 - DNA, 601 bp, Human
atatttataaatgagaacatatgattaagtgcttaccattatttgtcaatcaaaagtaatattaataataaaaactactttaaaagtaggtatatttaatatgagatatattaataaatatacttaatggtaaaatgttttacccatatattatatttatttttaaatagtaaatatgaataatatagcctaaataaagttgcaccaaagtattatatatactgacaacatagtactactaattgttctatgaagaagcaatattttgtgcttgactgcattacatattttatattcaggrtgatacttctctaaattcgtttcaaatgtttagtcaagtttaaataaaaacagaatttaattaagtcagccaattaagctcattaagtcagctaatcaggctaaaagtttatatgctaaaatttaatattaattattgggactaggtagacaatatttaccaatttggtcagttttgttggtcatacctttcatttggaatgggtcatttcattaaaatatgaatgttcatggataccaacatagcactttaatctgcatttttaaatatattacatgcaaagataaagttacatgataa

SEQ ID NO: 166374 - DNA, 601 bp, Human
ttttggaatgtaagtaatgccagcagtcatcattttaaggaatcacactggcattggagaatgtttaaagggccattcagtggacataatctcccttcctactttctcatgttcataaatcactcagattagcagagttgaattgcatatgttgatctcggtggaaattaagggtacatgtgtcaaaatactcccttaggaatacagaaagcaatttgttttaaaatgagattttttgtttttgaatgaaaggtgaatgattgtaaaataaaataagcaaactgtgatgctgatactaaggatgatttgactcctgacatttttagcatatgatagtttctctgtcacataggagctcagagttaccttgactacaagtctaattatagatggaaaggaataaagtatgactctttttgttcagctcttttaatgaaattttccttgtgatagcaaagattcctaaattatttgataaaattcaattttgaatcatagaattggtaccccaaatgaactgtattggtgagctgattaatatgtctcagaaaatcacgtgtgtaaaggcaaacacatttatatgtgtatcaaattaacacat

SEQ ID NO: 166375 - DNA, 601 bp, Human
tgtgtaaaggcaaacacatttatatgtgtatcaaattaacacataatgtatgtgtaattgaattagtgtattgtgtgtgtatgtatatgtgcatgtgtgtacacacatacatatatgtatactcttacacatatatgcataatttttctcaaaagttaattcagtacatggtaagataattcacttttgaggaaataacctgcgaccttagcttatgtttttatttttattttctcaaatatgctatttaaaataataaagtgtgatcataagttgtagaggacaaagagttacattattyagaaagttactgattttcctttatttgctatacttaagtacatgtgtttttcaaacatgtaaccttgtaccttggtacacactatttctaatatagtaattgctgcctttgtctccaatattagtatataattattctaaacttatgccacctttttatttcatattcttctccataattacgatctataattttcttttgttttttgttacttactgctttttggtgataataatgaatttaatttagtaagagtaaattattgtcctgatttagccgacattgcacaatttaattcct

SEQ ID NO: 166376 - DNA, 601 bp, Human
ccttgctgatgtcatactgttgctatggagagaaagtgagtgctgcatgacattgctggaaaaatcaacactgatgtatttctgtacagcaaataacctacctcatagcttttttttattagtgtaggcttgctaaaaattgtcaatactaatactaaaatggacatgttcctttgcccaaacaactttgctatgtaaaagtcttgtgaaggtgtacttaaatggttccttcctaataatgctaaagagaatgaaatatataataacccatgtgaagtaaggaagcagaatacatattttrtaaactattagatattttttctatcattgggaacttttttcttggaaatatccactgttttaaaatctatttttaacattgagtcattcaactgtacagcactacttccgtcacatctcaacccttaaaaaagattagtgctgatttcattttgagtcattcctgaggcattcttttcaaccctgctataaaagcctagttgccaagtcagacatcagggatacactttgaatgtcttagtggggacacatgattctagattcatctggctgtaaggaaggaggcagttaaccaaaaaca

SEQ ID NO: 166377 - DNA, 601 bp, Human
gttatatttcatctgttctttccaaatagtaggatgtaggaggtgttatatacgcctacaaaccagattctttaaaatactttcataccttgccattcatttacccttttgtgttttatagcatatatataatattcagaggtgaacattatctatatacccaaatatacaaatatacccaaactcttactggtccccgagaataattctatggacacataagaaattattttcctgcagtttctattttcttctgtttgtgaataaaaatgctgtaactaaaggtatttaacttgagaakaaaaaagcattctgatattatcaattttcatattgcagaaaataggctgttactcatatgttgaaattagtgggcccattaaaatgtcatctctaatgacggtaaagacagtagcctaaccaaaagccatttcaatggctagcatagtctgtgtatgatcctaccagtctatggggaccaccagcctagaattaaaagagaaatacagaaatgtaccaaatgcacatttgtacacatagttcatgtgatgcactaatgagattagtctgtctccttacaacacatagggcaaatctcatt

SEQ ID NO: 166378 - DNA, 601 bp, Human
ctcattaatcagttatgttccatggctctaatcatgttaacttggttacttgacatattttgtcagtggctaaactgctgctgaacatcctatttactctccttatattatagaaattgcagaacaataagcagtaacaagagctgggtttttttaggtaatgaagaactagtaatgtgtgtgggaaatgggaatttatattctggaaagttctgagaggtatttgatcatttttaaaaaataatagcacctgcctcattaagattttacaatttctaaaaaattagatacttttttttttctatccagtaatcttaaagcattttttaaaaaaccttcataggaccatttttcaatgtatatttcatctattttagtttttctcaccatattcctgaaagtacatcagagaaatttccatgctgggagcagggaatagtgagtggtccctgataatagaaaaatgtccattgatccacaaagcagttaatgcaagcacacaacttaggaactttaattggtggtgttattagattcccatgtactatgctgcattccttttctccacacattagctgctactatagttgtgttttccata

SEQ ID NO: 166379 - DNA, 601 bp, Human
cacaacaactcaagccctaagtgagtgtatgtatagcctgtgagtcagatatgaggtaaagaagttgtatttattaataaaaaagaaaagagagaagacaggagaggctttagggaattctggaggaatggcattcagaacagtggagtagagagagttctttttccaaagatacgctaaaagagatggagaaggtacagatacagcctcctttggcaaagccagtaaccaattagctgtagtagccacagtgacttattaagaaaatagagggctaggaacctaaaagggctttttttttaattttattttttttacttatttattttttgagactgagtctcactctgtctcccgggctggagtgcagtggcgtgatctcagctcactgcaaactctgcctctggggttcaagcaattctcgtgcctccgcctcctaagtagctgggattacaggtgcccaccaccacacctggctaatttttgtatttttagtagagatggggtttcaccacgtaggccaggctgttctcaaactcctgacctcaagtaatccgcccgccttggcttcccagtgctgggattacaggcatgagccacc

SEQ ID NO: 166380 - DNA, 601 bp, Human
ggctggagtgcagtggcgtgatctcagctcactgcaaactctgcctctggggttcaagcaattctcgtgcctccgcctcctaagtagctgggattacaggtgcccaccaccacacctggctaatttttgtatttttagtagagatggggtttcaccacgtaggccaggctgttctcaaactcctgacctcaagtaatccgcccgccttggcttcccagtgctgggattacaggcatgagccaccgtgcccagtcctaaaagggctttttgttttctattacaaaaatccaaatgtttgacaggaaaaaggagctgatttttaaaatattatataaaccacaggttgaagcagatgcatgttgcaattagtttgttttttcagtcagtaattataatagctataatttagtgacacctactttatgatatgtactggactgggtattttaatattagctgtcttctttaaatctacaaagtaatttctaaaggttattgtcactatctttattaagttaagtagaatttacttaaaggcacaaagtagaattatttcttaggggcacagaaatagggtttgatgtgtatttgaattgaggag

SEQ ID NO: 166381 - DNA, 601 bp, Human
cctgagctcaagcagtcctcccactttagcctcccaagtggtgaggactataattgaatgccaccacacccagctaatttttttatttcttagagagatagggtctcactctgttgcccaggctggtctcgagctcctgggctcaagcgatcctcctgcctgggcctcccaaagtgctgggattacaaatgtaagcctccactcccagcctcaagtttttaaataatggtttatctctccctgaaatactcttgtattttatttcctaaataagacgtttcattgtacaagcatatgaaaytatttatatttaatgtgtggtacacgagaatttagcagtaatgaactgtattaatttttcttctgtgaggcagaatgccactgtgccctaacagatttggttgacttataatttgctttgtttattttactgagattggccctattacttggtaattattttctgattgaagatttcacctgggataagctgatttcactggcaagaattgaaaacctactttgaaacattaaaccaagactatttgtaaacatgacagaatctcttagcatcattttggaaagacttcatctccccttg

SEQ ID NO: 166382 - DNA, 601 bp, Human
tgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggaggtgcgtgtagggtttcttttaagcartaaagtgtgaaatgctacaatccacgttagcaaaacctgaagggaataagaattaatgggtgaaaaaattcatcaatgaaaaggacttatcattagaaaaaaattactcagatttgggctatcagataacatctttgaagatttttttttgttttggttttggtctattactgcataaatttagtgtctgttctattggtgagccagaactacaaggaccaaaaaatatttggatcatttggggaaaggaggcatatgaaattcaggataaaaattcttacaattgaatatttttcattt

SEQ ID NO: 166383 - DNA, 601 bp, Human
aattaattcatagttctgggtttgaattttttcctcaactttaggtctgttagtctttaggtaacacagataaatgaatgccctttcaaatacttattaataatttcatgtgaatgcaacagtgatcactaatattaatctctttctggaaaagtataatttattaatctttttcatgattaattgatgcaattttaatagcagtatttaatttttttctaaaagtagtaatttctttttctgaatatatggcaggatatgcggctgtacattaacctttatttataataaatgtaaggaygtaaggattctttatagaataatataatttatttatcataaaaagtgttatatgtcattggaaaaatattttaagatttcaggggttctttcaactttttaatcatcttttagaaacaaaaacaaatttgtatcaaagctactaggatcaataggtaatgtatatttaccttatttttctaaaagtattgtttccagtaatatgttctcaacatgttctcaactccagattttaaaaacaagcaatcaagcttgaaataattctatcatttgctatctgaatttagagcaactgacaaag

SEQ ID NO: 166384 - DNA, 601 bp, Human
actgttcatctgagcagctccattcacatccacttctatacctaggattatttgcaaattcaggcataccagctgtcattctgcccaccttctctccaaaaggcatatcacaatacacatgagtgacaatgacattttcatatgctctaaaatatttctaaagcaaattattccctctgtgctttactgctgctaataaagtacttgtaatgtacctcaaaattttcagtagaagtcaagacaccacagctacacactatatgatcattgttaaatccagcctcctttatgtggtatcagyacattttccagtctaaatcagaaatcagggtcagctaatccagtccccagccccccattccacctgacatacacacgtatcctttcctgattattttacaaaatcttacaacacattctgcaattataaacatcctcacttttattctttttgaccaaaatattctctgcccacttctacacttaatgaattccaccttacctttaagtgcatacaccaacgtttgctcccgtgggaaaccttttaagtagaccttaatcctaccctatcccagccctatccttgggaaggattctgggc

SEQ ID NO: 166385 - DNA, 601 bp, Human
atatattctgatcagaaataagaataatttggaaatcattcagtcacagagtttctgtcatttttttcttctctcattttaggaaaccaaatatgaacagtgaaagagagagtcctattcttatagggtcactgaaattaggagaatgagactgatatcttagttctgtgtaacaaggaataatcaatgagtggtttattatgggggctattttatactgaatatccagaatttactcaggagatgatagattagatagatagatagatagatagatagatagatagatagatagatagaagagggaaaaggacagaggaacacagagtgccaggcttattgcccattcttcctatttatttaaaacatttaaaagcgttgtattaaaatgccatgtatgttgtcgtattttccaaagagagtaaagtaaaaatcttgttgagaagaaggctgtctcaaatttaccctttaatgacttgggttagctggctttacaggcatcttatcaaaaggagaagaaaacagtcctaatgcaagttcccagtcacttcatcactcagaaagctacttggaatgtgcatgtggtataatttatgtagag

SEQ ID NO: 166386 - DNA, 601 bp, Human
atattctgatcagaaataagaataatttggaaatcattcagtcacagagtttctgtcatttttttcttctctcattttaggaaaccaaatatgaacagtgaaagagagagtcctattcttatagggtcactgaaattaggagaatgagactgatatcttagttctgtgtaacaaggaataatcaatgagtggtttattatgggggctattttatactgaatatccagaatttactcaggagatgatagattagatagatagatagatagatagatagatagatagatagatagatagatgtgggaaaaggacagaggaacacagagtgccaggcttattgcccattcttcctatttatttaaaacatttaaaagcgttgtattaaaatgccatgtatgttgtcgtattttccaaagagagtaaagtaaaaatcttgttgagaagaaggctgtctcaaatttaccctttaatgacttgggttagctggctttacaggcatcttatcaaaaggagaagaaaacagtcctaatgcaagttcccagtcacttcatcactcagaaagctacttggaatgtgcatgtggtataatttatgtagagca

SEQ ID NO: 166387 - DNA, 601 bp, Human
tttaggaaaccaaatatgaacagtgaaagagagagtcctattcttatagggtcactgaaattaggagaatgagactgatatcttagttctgtgtaacaaggaataatcaatgagtggtttattatgggggctattttatactgaatatccagaatttactcaggagatgatagattagatagatagatagatagatagatagatagatagatagatagatagatgagggaaaaggacagaggaacacagagtgccaggcttattgcccattcttcctatttatttaaaacatttaaaagckttgtattaaaatgccatgtatgttgtcgtattttccaaagagagtaaagtaaaaatcttgttgagaagaaggctgtctcaaatttaccctttaatgacttgggttagctggctttacaggcatcttatcaaaaggagaagaaaacagtcctaatgcaagttcccagtcacttcatcactcagaaagctacttggaatgtgcatgtggtataatttatgtagagcacggcttgattgtctttttttatttctttgcatctagtgatgttattgcatgagcttcttgtaactattatgaatc

SEQ ID NO: 166388 - DNA, 601 bp, Human
ctgatatcttagttctgtgtaacaaggaataatcaatgagtggtttattatgggggctattttatactgaatatccagaatttactcaggagatgatagattagatagatagatagatagatagatagatagatagatagatagatagatgagggaaaaggacagaggaacacagagtgccaggcttattgcccattcttcctatttatttaaaacatttaaaagcgttgtattaaaatgccatgtatgttgtcgtattttccaaagagagtaaagtaaaaatcttgttgagaagaaggcygtctcaaatttaccctttaatgacttgggttagctggctttacaggcatcttatcaaaaggagaagaaaacagtcctaatgcaagttcccagtcacttcatcactcagaaagctacttggaatgtgcatgtggtataatttatgtagagcacggcttgattgtctttttttatttctttgcatctagtgatgttattgcatgagcttcttgtaactattatgaatcctcatgaggcaattcgacctttcccttttacactaaatgtgtggatatatcttttagatttccacatggaagag

SEQ ID NO: 166389 - DNA, 601 bp, Human
tattgcccattcttcctatttatttaaaacatttaaaagcgttgtattaaaatgccatgtatgttgtcgtattttccaaagagagtaaagtaaaaatcttgttgagaagaaggctgtctcaaatttaccctttaatgacttgggttagctggctttacaggcatcttatcaaaaggagaagaaaacagtcctaatgcaagttcccagtcacttcatcactcagaaagctacttggaatgtgcatgtggtataatttatgtagagcacggcttgattgtctttttttatttctttgcatctrgtgatgttattgcatgagcttcttgtaactattatgaatcctcatgaggcaattcgacctttcccttttacactaaatgtgtggatatatcttttagatttccacatggaagaggcactggattggcctggagtatacttgttaccaggccaggtttctggggtggctctagaccctaagaataacctggtgattttccacagaggtgaccatgtctgggatggaaagtaagtaatattttttcttcaataagcaaatgaaaataaaaatagtgtacataattttttcactaaactaaga

SEQ ID NO: 166390 - DNA, 601 bp, Human
attaaagatagttaagccagtaccttagtgaaaatgttcaagacttcaaggagagtgcttatgaaaagtgatcaactaagaaaggttgctgatggactataacaacgcacttttgttattttcacatcctgggtgcagaactatgccaagaccattgtcctggacagtgtggttggggcagtttggccactacatgtgaagaaatagtaacttggccttaaggttttaatatagactacttttattactcaaatttgctcttttcatgagcatcaaaggcttaagaataactctaggactrtctattactcctgctttatcctctggattttccttttctacctccttagagggatttttagtaaaaacatagaacggttattgagtgtttcctctgagttaccatcattattcaggttttacagatgtagaaaccaagagaagttaagtattgtgcccaaattagcaagtggcaaagccaggcttcagttgcttcccatctaactccagagttggcccacttagccactttatgatactgcttttaatggaattgtaagcatgttcatgattgtatttttaaaagcttgccccacaattt

SEQ ID NO: 166391 - DNA, 601 bp, Human
tctagatgttataaagttcttcattattttacctaaatctgagtcctgttacttcaccttttagtaatacaggattaatttattcccatttatccatgtcaattatttgcatatttgaagaaagccttatcttttgcaaactgaatattctccaagctctcaagcaatcttatgctgacatgatttatttcaactgaaggaattttggtctctctcccctttaagtgtttcgcctagaagtggtcatagtacctcacatattatttgatcagtgttacaattagttcccttgatgtgtatkctacacatctgttagtataagagaattgtattccctttttttagcagttacatcactgtgttgccttatgtagaatttgtaatctatgaaaatctccaaatatgtgtcaaaaattgtgctgatatttttactggaagtttatgcttatgcagtgttttaaaaatattgaattcagggctttattccaattatgttccactttattacatttagcattgtttcaatttacagacattattttaatcttaattagccagagactttgtgttagttctcccagctttgtattaggtctctttg

SEQ ID NO: 166392 - DNA, 601 bp, Human
gtggtatttatagttctaggcctaaaatggcactaaatagtcatactgaattttttttgtctgcccatctcttttcctgcctcacagggactttttacaatgtgtctattttcagaagtaagtgtttttaacataatattaagttatattccatcgagagtctctggcctttgtatatctttgcttttctaacattgaggttacattttcacttatattcttgcatgaaaacctacagttatttctctagcttcttaatttatataattatattatatttcatatcttccttcagttgctrttatttaatttgaattcccttaattttgattcatggcatagaattttattttctccttactctagctcttttgtgtgtgtgaatatagcaaagcatttcttcccagccttatctaaactgtttgattagctgctaatgtgaaaaatcattaatggagaattcaaactgctaaaataaagaactgatgaattccagcccataggccacagttcagtcttttcaactgagtgcttttccagagaaacaaagaaaaatcaaaagtgctccaggcactgtgtgaaatgttcagggtattattat

SEQ ID NO: 166393 - DNA, 601 bp, Human
tttgacaagtaacttttggctcctcgttacttatgcaaatttctgcagctggcttgaatatctcctcagaaaatgggtttttcttttctatcacatcatcaggctgcaaattttccaaacctttatgctctgcttcccttttaaacatacgttccaattcaaaccatatctttgtgaattaataaaactgaatgctcttatgagcactcaagttacaccttgaatgctttgctgcttagacatttcttccaccagatcatcttccacctaaatcatctctcttcagttcaaagttccacacatctctagggcaggggcaaaatgccaacagtctgtttgctaaaacatagcaagacctttattccagttcctagcaagcttatcatctccatctgagaccatgccagcctggacttcattgttcatatcactatcagcatttttgtcaaagccattcaacaaggctctagaaagttacaaactttctgacatcttcctgtcttcttctgagccctccaaattgttctaacttctgcctattacccagttccaaagtcacttccacatttttgtgtatctttatggcagcaccctatttctg

SEQ ID NO: 166394 - DNA, 601 bp, Human
cactgctaataaagacatacccaagattgggtaatttataaaggaaagaagtttaattgacttacagttcagcatggctggaggagcctcaggaaacttacaatcaggcagattgcttcagaaggggaagcaaacacgtccttcttcacatgatggcaagaaggagaagtgccaagcaaaagggggaaaagctccttataaaactatcagatctcatgagaactcactatcatgagaacagcagaaagggggtaaccaccccatgattcaattactttccaccaagtccctcccatgacaygtggggattatggaaactacaattcaaaataagacttgaatttatggaacttatgtaaagtctcagtactctacataaataggagaacaaaaaaaaattattaaattatattctttggccattaaaaaatacaccacacaatttgggtggggacacagccaaaccatatcaaaccttaaaaagagatagtgaatgaagaaactttaacctattacatatgaatgtgaaggttacaatatactgagtctcagatgtgctgaacttgttagtcattattatagtcaccttggaaaaataaaa

SEQ ID NO: 166395 - DNA, 601 bp, Human
cacattgtaccccataaatgtatacaattaaaatttgtcaatttgtcctttaaaaaattagatttagattctgtatagagtggggctaataatcttaagttcccaggtgattttaatatgtagtcaagcttgttacatattacatatgtaatatatatcttacatacttgattaagtgagttgctgctcagccagatctaatgatccaaaaaaattcttcagcagaaaaattcttcaggacaaccaaactcatcaagtaatcaccattaagtaaaagagcttctctttttccgtctcaaastgaatactaaacaaatgtcatttttagcattccttatcatgcgtatgtaatttggctttgaaaactgctcattatttagtcttatttcgagatggcacttggcagccaaaaaaaaaaaaaagttgactgatatttatggtcattgaaagaagtgagggaggcacttgcttacagatctcctgaaccattgtaacttgacagcttcaggaattatacccttctccatctgcttaagcacagggaaagctagcttcttcgcaaggtggatagccaccgttttgagtgcagctgcttgggaga

SEQ ID NO: 166396 - DNA, 601 bp, Human
agtcaagcttgttacatattacatatgtaatatatatcttacatacttgattaagtgagttgctgctcagccagatctaatgatccaaaaaaattcttcagcagaaaaattcttcaggacaaccaaactcatcaagtaatcaccattaagtaaaagagcttctctttttccgtctcaaagtgaatactaaacaaatgtcatttttagcattccttatcatgcgtatgtaatttggctttgaaaactgctcattatttagtcttatttcgagatggcacttggcagccaaaaaaaaaaaaaagttgactgatatttatggtcattgaaagaagtgagggaggcacttgcttacagatctcctgaaccattgtaacttgacagcttcaggaattatacccttctccatctgcttaagcacagggaaagctagcttcttcgcaaggtggatagccaccgttttgagtgcagctgcttgggagatgataataatgatgcttagaattttttaacagcattctcaagattgtgtgtcaggggtgaaatgtttgaacctgtttcattggtgctctatttattcaccagaagcaccctcattccagaa

SEQ ID NO: 166397 - DNA, 601 bp, Human
tcaacatgtgaatttggatttgaggcacaaacattcagtccataacaatccacatctgaaatatttctcttagaactcaatgctagggaaagctagtatgtaaatgatgaagtcacatttgtcccttggaccagatatgaagcttcactcaaataactacatgggccctcccaaccattttcttaactgtctgtatttgcctttatttcctctgttcctaacttgttgttgttgttgttgttgttgttgctgttgttgttgttgtttgagacagggtctcactctgtccctcaggctggartgcagtggcacgatcttggctcactacagcctccacctcccaggctgaggtgatcctcccaccttagcctcccaagtagctgggaccacagtcacacaccagcatacttggctaatttttttaaattttttgtagagatgggattttgccaggttgcccaggctggtcttgaattcctggactcatgcaatccacctacctcagccttgcaaagtgctgtaattaacaggtgtggccatcgtgtctgggcctaagtcttatttctatttttttacttatttttttatgtttttttcttaa

SEQ ID NO: 166398 - DNA, 601 bp, Human
acattgattttcattttatcttaattatgatcatctgctccagtattaaataattaatatttgtcttcacacatcgacaaatggtatatgtctgataaaatcagtattcaaaatactcatttcacatttttaaaaacagtagtgaccaatttttttaaagataaaatatgtaaaaataagtgtggcttatgcctaaataccaggataaataatcaataaaatcttgaacttttttctcattttcaaaatagattttcttgactctaagaaaatctgaaaaataattcagactaataaaatacatataacttatattacaaaacaacttaccatattttctttaaataatgaaaatatatttaatttctgaaatttacatacaattacaatttttttaaattgtaattgacatagtaattgtatatatttgtagagtacaatgtgatattttgatgtatgtttacaatgtggaatgactaagtaaggctaattagcaaacccatcacctcacatacttatgttttatggtgaaaacatttaaaatatgctcttttcacaatgaagtgaaatgagatcaataacgaggaatttttgaaaaatt

SEQ ID NO: 166399 - DNA, 601 bp, Human
cattgtctaggtttcaattttcatgagaagaagactaaaatataaatcttggcattcaatctgtacttgaatagctttagaaaaacttttaagaagatgtgataactttcttagcaaggttgatgggagtgttctattttattttttattttatattttatttagaataaatgtctttgtctattcctagatcaatttcttcagatgcaaattagcacgtgtgcagttctaaggttcttagtagaactgcacctgcatatgatggcaggtttttaaattcactatagttagaatacaaaamataaatcagtcgctttctggtttcatccaagtagagaaaacatcacaacatgttaagtgtactcttaaagttctcttagacccaacagacatcttgtttgctttctttattgctatgactgtgctaagcaacaagacttgaaaatagcacttcctggaatttattcaagttctaaagatttggttaagaaactaaaagctacttttggcttcaaaagtgttttcccactgtttattctaacgtgctttttataaacacagcaactgtgttcagtgtgcccatggcccttctgtcttctca

SEQ ID NO: 166400 - DNA, 601 bp, Human
aacccttacaactccagagctcttcaaaagcataactctgttagcttctaatttgaatattaccaaaaggaagactacctgatggagagccacgtctgtgacccaataattcccatctttatctatactcaagccatgtggcaagtaaaacctgcaaaataaaaatatttgttgtttattttgatttttttaaatcagaatgaataaccatcatcctgattaaccaccgccacctaaccccccgccacacacacatacacacacacacaaacacacactcacacacacacacacacacacwctctctctctctgtcccatacccttcccaggctctggtaaccatccttctgtaccatacatctatgagttcaattgttttgatttttagatcccacaaataattgagaacatgtcatgtttgtctttctgtgcctggcttatttcatctataatgatctccagttccatccatgttattgcaaatgacagagtcttattctttttgtggctgaataatactccattgtgtatatgtaccacattttctttatccatttatctgttgatggactcttaggttgcttccaaatcttggctat

SEQ ID NO: 166401 - DNA, 601 bp, Human
acccttacaactccagagctcttcaaaagcataactctgttagcttctaatttgaatattaccaaaaggaagactacctgatggagagccacgtctgtgacccaataattcccatctttatctatactcaagccatgtggcaagtaaaacctgcaaaataaaaatatttgttgtttattttgatttttttaaatcagaatgaataaccatcatcctgattaaccaccgccacctaaccccccgccacacacacatacacacacacacaaacacacactcacacacacacacacacacacaatctctctctctgtcccatacccttcccaggctctggtaaccatccttctgtaccatacatctatgagttcaattgttttgatttttagatcccacaaataattgagaacatgtcatgtttgtctttctgtgcctggcttatttcatctataatgatctccagttccatccatgttattgcaaatgacagagtcttattctttttgtggctgaataatactccattgtgtatatgtaccacattttctttatccatttatctgttgatggactcttaggttgcttccaaatcttggctatt

SEQ ID NO: 166402 - DNA, 601 bp, Human
acagtaaactgaaatcagtttataaatctctcagaattttcattaaatagattattatcacaaagattaattttgggtgaaggaaataatatggtctgttgactcctgtgtaaaaagagattcctcttcacgatgaaggtcaagttttacataagggggttgtgcttctgtttgtgcatacccactccttatctcctcttacatttcagttctccatcttctactattacattctttagagatgtttccatctgaatgtagggactctgtttttatgtctgtgcagggaagcttagacagwaggacaataaagaaaatggttctatcaaatgctatcaaaaagctgtgagagaaaaatacacattgtcattccccaagtcattccccctgtaatcaaaggacagacttgtggtccctcattatctgcttttatacacacccttcggacaggcatattttttgtcgtcttctgtgtggcagctcatatggaaaagaaagagaatgatccccatccttccataccaaaagaaaaaaaagtgagcccagatttatgtcatttttccaaccttcacagtgatgattaaaatgacaatacttgagc

SEQ ID NO: 166403 - DNA, 601 bp, Human
gtcttttgccatccattaactgaacctcccaaaaaagatgaacatttaatgacaagcccgcaggatttcagcaaggcagcattttgatttctggctctgtgttttcctctacatatttgtcacagcttatttgaaagtatgaaaaaaaatgagcctccttggcatggctatctcatttttcttttcagtgtgataaacttgatgatttctaaagtacgatagtatctccagagcatgtattcttctgccccgcctaaactgagctaggaacagtagtttgtctcattagtaccctttgaamtcagcacatcagggttaggcagatgctggctgataagcccatggtctggatactcactagtcatatttttgataactgtgtatccaggcaggccttctggccttaaaggtgaaagatgttatctatatcctgccaactgccagacccagggcacctttggaggcttccagagacaatggaaatgtcagcagcacaataatttaaggcttctcttccaagaactagtttggtgatccccaaaagaaagtcacaaaaggatctcccctgtctcttgtgtcctcataatggagatgacaatga

SEQ ID NO: 166404 - DNA, 601 bp, Human
gaaggattcaagtaaaggctcaccactctaatgtgtagcttcttattttggcagcactttgatatgcctcatgatattgttgcatctgaagatgggactgtgtacattggagatgctcataccaacaccgtgtggaagttcaccttgactgagagtatggttttcacagtattattgttcacattttccctcagtttgattgcttaaaagcatatgaaacaaaaacatttgcatttccttatctttttactgatgagagtaggaatcaaagtataaagcagttgttaaaagacctatttgrtgtccattaagtggaaagaaacgatttttttgctggcacttatccccttgtttccacaggaaattcttgatgcctgaagtactgtctgttacattaaaagtcaacattaattccagcttagttccagaaggagagagggggctttggcaaagcagaggggctgacttctttccataaagcctcattccccatatggccctttagctctcagtagctgctgagcatctagagataccagcatccgtttgagacatattatcccaaatatgaatatttggaaatattcaaagaagaagcact

SEQ ID NO: 166405 - DNA, 601 bp, Human
caaagttaaattttcaaatgttctttttggagattctgacttttctctctccttgttgtgttgttacagaattggaacatcgatcagttaaaaaggctggcattgaggtccaggaaatcaaaggttggtcagattcctcttattactataaaaccaaagtctggctgtgttgaattcttttatggcccttgattgcaacttaaaaaattaccaggctaaaaatataatctggtaaattatcagtgacttctgctatgtactgagcctttaaacctgtatgttgccacttccctttttttttgataaatggagcagtcataatgagctcaaattactgatttcaagtgatagaaagtgattgaggatacaaaaactttgtaactagtgagccagagatattccgagaagaaaaaaagtcagccactttggggagtacattaaccccaggcaagtaaaaaaatatgatttggcatattggaaaaaccttttcttaataggccctaatataaaggagtgaaaaatatctttggtgggtcagtgctataatggtatggaaagattagctgtttctttagcttctatcgtagtaccattcagcttc

SEQ ID NO: 166406 - DNA, 601 bp, Human
agaattggaacatcgatcagttaaaaaggctggcattgaggtccaggaaatcaaaggttggtcagattcctcttattactataaaaccaaagtctggctgtgttgaattcttttatggcccttgattgcaacttaaaaaattaccaggctaaaaatataatctggtaaattatcagtgacttctgctatgtactgagcctttaaacctgtatgttgccacttccctttttttttgataaatggagcagtcataatgagctcaaattactgatttcaagtgatagaaagtgattgaggatayaaaaactttgtaactagtgagccagagatattccgagaagaaaaaaagtcagccactttggggagtacattaaccccaggcaagtaaaaaaatatgatttggcatattggaaaaaccttttcttaataggccctaatataaaggagtgaaaaatatctttggtgggtcagtgctataatggtatggaaagattagctgtttctttagcttctatcgtagtaccattcagcttccacgatttactgagggccttttgtgtgtaaagcactatagcaggtctaagggaaatgagactgcacc

SEQ ID NO: 166407 - DNA, 601 bp, Human
ggaacatcgatcagttaaaaaggctggcattgaggtccaggaaatcaaaggttggtcagattcctcttattactataaaaccaaagtctggctgtgttgaattcttttatggcccttgattgcaacttaaaaaattaccaggctaaaaatataatctggtaaattatcagtgacttctgctatgtactgagcctttaaacctgtatgttgccacttccctttttttttgataaatggagcagtcataatgagctcaaattactgatttcaagtgatagaaagtgattgaggatacaaaaamtttgtaactagtgagccagagatattccgagaagaaaaaaagtcagccactttggggagtacattaaccccaggcaagtaaaaaaatatgatttggcatattggaaaaaccttttcttaataggccctaatataaaggagtgaaaaatatctttggtgggtcagtgctataatggtatggaaagattagctgtttctttagcttctatcgtagtaccattcagcttccacgatttactgagggccttttgtgtgtaaagcactatagcaggtctaagggaaatgagactgcacctgacct

SEQ ID NO: 166408 - DNA, 601 bp, Human
aaccagttacttcctagtatgccatttgccttcagccttcagttctgtctgtgatgaactgggatacaattgctgtattaagaatgtccttcccttcctgtccaagttattccaattccaagtggtctctagacttctcttctgttagggggagacagatttgtacatacatgtatatgtgcactcacacaggaatgtagctaacctccatttctaaacgcattgctttaaagaagaagaaaaactgtcatacatcagcttttagaaaatttgtttatttccaaatatctatagagatgcyacaagggcttgcactcttataagattttaaggcatgttcattctacccagaatacacctggcattttatatgacaaaagaatggtcattctaggtgcctcctgttttccagaaacctagtgttctggctaatcttagagcttcttcactcttcattcatcatagatgctccaaattactgggatttttaataaaagaatttaggataaagagtgaaagtggcagaatttggattattcttcaggctttcagtggaattcttagactcttaagttataactattgttttaggcattttacc

SEQ ID NO: 166409 - DNA, 601 bp, Human
tcaagggcctttggaggcaagtaaaatgagccccgtgaacttggaacctgcctttgaaagagtgtttggcctaattatcctcaggagtttgattgggatttttttcactgtatttgtttttttgtttttaatgctctctaccatttttgacattattgtctatgttccaaatattgcccctagttaatatcacagtacaaaatagtatctggagactctgaaatttggatagttagattaaaatataacctttaatactatcttttagcaattggcttaagtccaattaatgagtccataygaaattgtaggtagtagagtcagtataaattagctgaaggatcagaggaggagatacctgctgttaggaagaggcccagtcctcaaagtacctgggtcagtttttcaggttgtgtttttctcccattaggctcctagctacatgaccatgggcaagttacttaatctctccagaccagttttctcataaaaaagtggggataaaatagttaccttacaaggttgtacaaagatgaaataatgtacataagcatttatcaggatacctggaacctaggaagtactcaataccaccaatggt

SEQ ID NO: 166410 - DNA, 601 bp, Human
ctacatgaccatgggcaagttacttaatctctccagaccagttttctcataaaaaagtggggataaaatagttaccttacaaggttgtacaaagatgaaataatgtacataagcatttatcaggatacctggaacctaggaagtactcaataccaccaatggttatgatgaataatcattggtaataaagtaacaaaaggcataagaagttataaaaaacacttgtcttaaaccttagttttcaagaaaaattaattctataacaaaccatttgatagtttttgaatagtcataatttagmtcatcagccttccataactgaacaaggcagagtccaataccagagttagtattttatgaaatcattatcacaatataggatccaagagctgagtttattttaggacatctaaataaataaacaacccaattcatgtttcttaccgctcagtagcagtcccttggctgggtccccaggtcctagagcaagtctatagctgtgtgtgggaagaaatccatggatcagggagagggggagcatttgatcaagaaacagcatctgatcctatttcaggtcaaggcagccatggcagggattcag

SEQ ID NO: 166411 - DNA, 601 bp, Human
ttgtcttaaaccttagttttcaagaaaaattaattctataacaaaccatttgatagtttttgaatagtcataatttagctcatcagccttccataactgaacaaggcagagtccaataccagagttagtattttatgaaatcattatcacaatataggatccaagagctgagtttattttaggacatctaaataaataaacaacccaattcatgtttcttaccgctcagtagcagtcccttggctgggtccccaggtcctagagcaagtctatagctgtgtgtgggaagaaatccatggaycagggagagggggagcatttgatcaagaaacagcatctgatcctatttcaggtcaaggcagccatggcagggattcagtgcccttggcaaagccctgacacagaaaaaggcatggaaacagaaaacagaaaattcagtttaatatgttgtaaaagggaatttttattagactttattttgcttttcatgtgccatcaataaatctctataaaaatatagttaactcttcccaaaaaggatttctattaagtccatgttacagatctggaactgtcataagtaggggcaaagagaaataaa

SEQ ID NO: 166412 - DNA, 601 bp, Human
tcatgtttcttaccgctcagtagcagtcccttggctgggtccccaggtcctagagcaagtctatagctgtgtgtgggaagaaatccatggatcagggagagggggagcatttgatcaagaaacagcatctgatcctatttcaggtcaaggcagccatggcagggattcagtgcccttggcaaagccctgacacagaaaaaggcatggaaacagaaaacagaaaattcagtttaatatgttgtaaaagggaatttttattagactttattttgcttttcatgtgccatcaataaatctctayaaaaatatagttaactcttcccaaaaaggatttctattaagtccatgttacagatctggaactgtcataagtaggggcaaagagaaataaacatagtcattgtcttcatggtgttatatagatgcttcaaaagagcaagaatccatatcttgagtactgatatgtccccagcacaaataatagtttctgatactagtggtttaataaattgttgttgaaagaatgaatgaataaatcaaccgagctcacagaatagataacatatgaaagagacatgaaacaaaaaagttatagtagagg

SEQ ID NO: 166413 - DNA, 601 bp, Human
gttgttaagcacatgtgacacagcactgttacatgatgctgactttacaggaatgtgttaggaaggtagagacccaggtagaaccctagaaaattgccattatttgaccgtgttttacttagaaaaattgcagtttcatatgtagtagtagtagatcagcttctcactttttttctgaatttgttcttgatagatcttatccagtctaaggttattaaaaaccctaatggaccttccatttattcatcattccttattatgtattgactccatatcagacactgtgctaggcacatggggwtacaaaactaaggaatgtccttgcagaacttacaatctaatttgttggctttctaacagtcttaccagattcttcttcccttcttgcctatttctttccacatcactgtcttctccctttcctctcatctgcgctatctttttccatgatgctgacttcagtcctggttaaagacctaacaggacaaccccaggcctgactttcctgaccatagcccttgagggagtgatgaagcctgggaaatagtacagggagagacacagcaagggaaaaaatgaaacccattgggagttctgtctc

SEQ ID NO: 166414 - DNA, 601 bp, Human
gtttcatatgtagtagtagtagatcagcttctcactttttttctgaatttgttcttgatagatcttatccagtctaaggttattaaaaaccctaatggaccttccatttattcatcattccttattatgtattgactccatatcagacactgtgctaggcacatggggatacaaaactaaggaatgtccttgcagaacttacaatctaatttgttggctttctaacagtcttaccagattcttcttcccttcttgcctatttctttccacatcactgtcttctccctttcctctcatctgygctatctttttccatgatgctgacttcagtcctggttaaagacctaacaggacaaccccaggcctgactttcctgaccatagcccttgagggagtgatgaagcctgggaaatagtacagggagagacacagcaagggaaaaaatgaaacccattgggagttctgtctccccataaggaaagagagtctgtcctttatggagataggcagtcctgttgggaacatttaggtcacctactatgcttggaaaatactcagggtgtcatgtgctttcccttcacttatgtcttacataaagaag

SEQ ID NO: 166415 - DNA, 601 bp, Human
cttaataatgtatttctaaaaccattttgtttatttatcttctcatatgtaatgagctagattatttatattaaactgatctaaattagatttggaattatatgtcagtgacatatagtacagttaattttcttttctttcttcttcctccctctcccttcctctctccctccctcctttccttcctcccttccttccttttgttgcctgggcattttaacctaaatctctaaaaatgtaaatagtttgcttcaaatgatttttgtcacctttcttaagaaaaggaaatgaaggccagctygctgtgttacacagtttttattttagagaagctcaccaacactgcctcaaccaggcacaacattagcatgaataattaactaataaattcaattctacaagatggctatgcaatattttgtgaagcatctctccccgcaccatttgtattcatggcccttcaaatttaaaataattgaaattaatttattgacttgaagaaagattgaagcctggtactattttaataagtcctatttgaaatataaatttcagtttgaaaagtaaaatcttacatggttaccctaagcccgttcacatg

SEQ ID NO: 166416 - DNA, 601 bp, Human
ggccagcttgctgtgttacacagtttttattttagagaagctcaccaacactgcctcaaccaggcacaacattagcatgaataattaactaataaattcaattctacaagatggctatgcaatattttgtgaagcatctctccccgcaccatttgtattcatggcccttcaaatttaaaataattgaaattaatttattgacttgaagaaagattgaagcctggtactattttaataagtcctatttgaaatataaatttcagtttgaaaagtaaaatcttacatggttaccctaagcccrttcacatggtcttgcaaaaattcacaaaataagcataattaaaccttgggcttgatttattcagcatccctcaggcaggcacttttctccctcaaggtgagttggaggaaatatttatattcgttctttggggtatttcccagagcaaggccagctgtagccaggtgttcgcacacacagaatctggcagcatgataactagaaacactgatgtacacgcactgttttttagtgagatggcctggcagtgcctggaagttggcctcctggcttctgtcagcaggaatcagagatgaagac

SEQ ID NO: 166417 - DNA, 601 bp, Human
aaatttaaaataattgaaattaatttattgacttgaagaaagattgaagcctggtactattttaataagtcctatttgaaatataaatttcagtttgaaaagtaaaatcttacatggttaccctaagcccgttcacatggtcttgcaaaaattcacaaaataagcataattaaaccttgggcttgatttattcagcatccctcaggcaggcacttttctccctcaaggtgagttggaggaaatatttatattcgttctttggggtatttcccagagcaaggccagctgtagccaggtgttygcacacacagaatctggcagcatgataactagaaacactgatgtacacgcactgttttttagtgagatggcctggcagtgcctggaagttggcctcctggcttctgtcagcaggaatcagagatgaagaccctgagtccaagtggtcttcactgtgcttcatgaccctgtagcttctcaccctccaagggaaaaacggttctgtgattcataacatgattttattccttacagaatgatgaaattgagcccacagcattttcttatgaaaagttctatgaactgacacaaaagatttgtc

SEQ ID NO: 166418 - DNA, 601 bp, Human
tggactgagggaaatcttctttgcctataatatgaaaatagcaaactagagtccaggagggatagcagaggcacttaatgtgagctgccacgtggtgagacactactactggctcaattgcttgtatgtggcaagactagataaaacctcttggctttggttagttttacctccctttccctattcctaatgagaagcaaaattgatttttagttttaccttcattctttgtttgacttcttacaaagatgataactagggtcctgcagaattgggagatgggtggagggcaggagagagrgataaaaacaaggaagagagggaaaaggccttaggtggccacaggaatcaaggagtagctttactttcttgttgctggtaatcttcccccttcctcacacatatcataggatcacatcagggctcaacctgacttttttctttttgcagatgaaagaatattttaaaaggacccatgatctctttccttttacaagatctttatgctttaaatgcacaggcaaagagagagaaggagggtatttagtcttatgagtaagcttatccttgccaattattccttctatatttttaaaatatt

SEQ ID NO: 166419 - DNA, 601 bp, Human
atttgtgttacctttttgaagcatgaagattttagggagagctgaagattgttatctagtgggagcagaagcaaaaacaaatgcaatttcgcattgtctgcacttcatgcttatttgctgcgaatgtaattttcagaataggggattatgatacatccattttagggcttggttttcctggctttgttttgccataggcaggatggtctaatgaatgtcataccctctgactaaattttaatagtgtttaattgggaggacatctgaaacactgaacatgcttctatccttgtgagacttrggtacttttctttttactgatgtgcaaatatgttaaaatgcatacctttatatgttaggtaaagtgattcttatacttgagcacatcagaattactcagaagtcttatgaaaaacacagattaataggttccaccccagagatcagcagattcagtagatctagggagggacctgagaagctgcatttctagcaagttgacaggtgttggtgaggctgatgctgccatccacagatcacacttcaggtagtaccttgtcagaataaacacatgtatgtatattttaaaatgcacaaaaat

SEQ ID NO: 166420 - DNA, 601 bp, Human
ctcagaagtcttatgaaaaacacagattaataggttccaccccagagatcagcagattcagtagatctagggagggacctgagaagctgcatttctagcaagttgacaggtgttggtgaggctgatgctgccatccacagatcacacttcaggtagtaccttgtcagaataaacacatgtatgtatattttaaaatgcacaaaaatgtctgagttctgtctcctttcctaattttatctcttctctctcctgtagctgaatcccttttttctctcattttttaattcatatggatttgccycatcatctccatgagttcaaaatatttaccaacaaacatatttttaaatttaaaaaacttaattttaataaggaagataaataaagtggccacctatgaacataacagtgctggggtctaaaaaggacctttttcatcctttatccatcttctaccatgatattatttatggagatgtgagaagggatgtgcctagaaagatgggtttgttgttgttgtcagtttgtttgtttttaaaacaatgcattctcaccagaaagacggagctccttgtttccttgagtagtgggctccattgca

SEQ ID NO: 166421 - DNA, 601 bp, Human
atgaggaaatgacatccaagtgctctgttggccaaaagcattcattctgtgtatagctcacttttccaatgcccattccaaagcaaatagggaagggaaatccatatgaacttttaacagttgctttttaaatacctttccaacaatgtttttcagtccgtgcatatatttgggtaaagagttgtcaccaaggtcctatttattgaccaggttttgctcacacctgcttatctgtcattattccaaacttccattgaggtttgctttatttattcacttattcattatttttgtaagggcygaccagggacacagtgctgtcctctaatcctcagtgaacagaaaggaagtttagtggacccactgccaacacacatacacacacaaacacacactattggagctgagtaagttagtaaactgggtttttcatcattgccatgaagttaggatgataccattgcagggacagcattgctcctggtgcctcatgtcatagcaggagctccttaggtgtcaatttgaaaacaataatgtcaccaacctcttaagtcccgtaatcattcatggactctctgcccagagaattctatattgttta

SEQ ID NO: 166422 - DNA, 601 bp, Human
agctaattgctggacctttgtccctttcaaagaagctttggaaacaaagggttgttcgcacaaatatttgtcaaaggaaaggcatggggagaaattttaaaatcagtcccacagcagtgagaaatgcctgcggaacatgggagggagagctgggggtacctgagctagagcctttggcgttatgtctcagtggagaatgtaaagagatgaaagttcaagttccataggtcccgtatgtccgtgaatctcaaggtctcagtttcctcctttttaaaatctatttttttctttgtatctaatrccagtgagtgtggttgaatggtctgtatgttatctggaccctctttttaggtatacctggccctctacactccatgatttcacccctgatatttttccaagcccaatagttttccctttagttgtagttgtacagtttacactttctgctatggctgaagatacctattttaagcaagaatgcttcattccttccctctctgtcaatattctgaatatcataatttatttcacattgcttatgattacagcaaagggaggtacagcttggtagaaaatctaacacttcgcattggcagga

SEQ ID NO: 166423 - DNA, 601 bp, Human
aaagaagctttggaaacaaagggttgttcgcacaaatatttgtcaaaggaaaggcatggggagaaattttaaaatcagtcccacagcagtgagaaatgcctgcggaacatgggagggagagctgggggtacctgagctagagcctttggcgttatgtctcagtggagaatgtaaagagatgaaagttcaagttccataggtcccgtatgtccgtgaatctcaaggtctcagtttcctcctttttaaaatctatttttttctttgtatctaatgccagtgagtgtggttgaatggtctgtakgttatctggaccctctttttaggtatacctggccctctacactccatgatttcacccctgatatttttccaagcccaatagttttccctttagttgtagttgtacagtttacactttctgctatggctgaagatacctattttaagcaagaatgcttcattccttccctctctgtcaatattctgaatatcataatttatttcacattgcttatgattacagcaaagggaggtacagcttggtagaaaatctaacacttcgcattggcaggaggtgatatgattcttgtcacttccctgt

SEQ ID NO: 166424 - DNA, 601 bp, Human
gaagatacctattttaagcaagaatgcttcattccttccctctctgtcaatattctgaatatcataatttatttcacattgcttatgattacagcaaagggaggtacagcttggtagaaaatctaacacttcgcattggcaggaggtgatatgattcttgtcacttccctgtgaccttgagctaggaactggcctcctgggcctcagtttccctgcttgtaaggtggtggggctcatgcagtaatttggctagtatttcccttccctaccttcattctttgaagtttgtagagggctgacygggtgccaagcactgtgccagatgctaggaattcaaaacaataagaaatgtccccagccttgaaggcagttgcgatctgttcaaggagaaagacaagtgattcaacaattccttggcagtgtgataaatgtcatgattgaggtgtgtccttgtttatttccaaattccttctaagttttaaaggtctatgaagtgaccattgacacatctaaaaagggtagcttgaccatttcacaagtgatggaaattttaacgtctgtcattttcaagcgtgggtgagaatggagtacaaagccattc

SEQ ID NO: 166425 - DNA, 601 bp, Human
tcattctttgaagtttgtagagggctgaccgggtgccaagcactgtgccagatgctaggaattcaaaacaataagaaatgtccccagccttgaaggcagttgcgatctgttcaaggagaaagacaagtgattcaacaattccttggcagtgtgataaatgtcatgattgaggtgtgtccttgtttatttccaaattccttctaagttttaaaggtctatgaagtgaccattgacacatctaaaaagggtagcttgaccatttcacaagtgatggaaattttaacgtctgtcattttcaagygtgggtgagaatggagtacaaagccattcttataaacttctggtaagaccctacattggtacaaccatcttggggaatattttggcaatagtttataaagtgaaaaatatgcctcttatacagcccagcattttcacttctaggtatgtaccctagagaatctctcatctatttcccaaactctggataccagagcggcacagttctcagatctctgctccacctatattcactctgtacctgagctcatccaagccaatggctttacatttcttctattaaactctccagtcctaacct

SEQ ID NO: 166426 - DNA, 601 bp, Human
acagcccagcattttcacttctaggtatgtaccctagagaatctctcatctatttcccaaactctggataccagagcggcacagttctcagatctctgctccacctatattcactctgtacctgagctcatccaagccaatggctttacatttcttctattaaactctccagtcctaacctccagcttacactacagacttgtagtagaactctccatctggatgttgaatgggcatttccaatgtatatatacaacatatttcgatccttcctacccctagatatgttcctttcaaagcytataaaatagtaccgttatttacccagtcaaaaccactgggctcatgttggacttgtttcattctttcacatcatgtctggttcatttgcaaaacctgtaagatccagcctcaaaagaaatcctaaataaatcacttctcaccatctccaacattactgactatccaaaccttcatcatccctctccaggcaatgccttctccttcctactcagtgccctacaatttatggtccacacagcagccagagtaaaccttttaaaaccaaatctaatcatgttattccaccctttgaaaccct

SEQ ID NO: 166427 - DNA, 601 bp, Human
tcacttctaggtatgtaccctagagaatctctcatctatttcccaaactctggataccagagcggcacagttctcagatctctgctccacctatattcactctgtacctgagctcatccaagccaatggctttacatttcttctattaaactctccagtcctaacctccagcttacactacagacttgtagtagaactctccatctggatgttgaatgggcatttccaatgtatatatacaacatatttcgatccttcctacccctagatatgttcctttcaaagcctataaaatagtacygttatttacccagtcaaaaccactgggctcatgttggacttgtttcattctttcacatcatgtctggttcatttgcaaaacctgtaagatccagcctcaaaagaaatcctaaataaatcacttctcaccatctccaacattactgactatccaaaccttcatcatccctctccaggcaatgccttctccttcctactcagtgccctacaatttatggtccacacagcagccagagtaaaccttttaaaaccaaatctaatcatgttattccaccctttgaaaccctccaaaggcttccca

SEQ ID NO: 166428 - DNA, 601 bp, Human
caacatatttcgatccttcctacccctagatatgttcctttcaaagcctataaaatagtaccgttatttacccagtcaaaaccactgggctcatgttggacttgtttcattctttcacatcatgtctggttcatttgcaaaacctgtaagatccagcctcaaaagaaatcctaaataaatcacttctcaccatctccaacattactgactatccaaaccttcatcatccctctccaggcaatgccttctccttcctactcagtgccctacaatttatggtccacacagcagccagagtaarccttttaaaaccaaatctaatcatgttattccaccctttgaaaccctccaaaggcttcccaacacatttagaataaaatctaaaatacttagtgaggactaaagcccaagtgatgtagcctttggctccatctccaatctcacttcaagctacctttttccttggtcacttgctctgtcttgctgtcattgaatgatgttggcacgcatacatctgcatcaaggtctttgcacttgatgatccttctgcctggactggtgtttcctgggtgtgcacgtggcttgctcctcacacatgtac

SEQ ID NO: 166429 - DNA, 601 bp, Human
accatcctctggctcactacttcatcagttcttcccataacacttatctcactggcagacagttcggcgggaagtcttcggtagaaatgtacagacaggttctcctggctggttgcaggtgaggaactcaagatggcaatttgttttttgtgtgtgatgcccttcagtttaatttacttttctctgaaaaacaggaaatagtaatcaggatgaaaaggaaatttgtttattccctttaatggattatcatggtcatttaacgttgagaaaagaaggacagtatctctttcggaaaaatctkcagtcatccaaaagactttactgtgaaaagacttttctttactgtaaatttaaaatatgcctccaaaaccacaaaaaagaaaacatgcatattgtaagaaggcgtgttgagttttttgttgattataggtacttgttactagcaccatgctctaaccaattgagctaactggccattgattataggcacttgtaaattagctttttttttttttttttagtatttattgatcattcttgggtgtttctcagtttctcagagagggggatgtggcagggtcataggataatagtggagaga

SEQ ID NO: 166430 - DNA, 601 bp, Human
ttcggcgggaagtcttcggtagaaatgtacagacaggttctcctggctggttgcaggtgaggaactcaagatggcaatttgttttttgtgtgtgatgcccttcagtttaatttacttttctctgaaaaacaggaaatagtaatcaggatgaaaaggaaatttgtttattccctttaatggattatcatggtcatttaacgttgagaaaagaaggacagtatctctttcggaaaaatcttcagtcatccaaaagactttactgtgaaaagacttttctttactgtaaatttaaaatatgccyccaaaaccacaaaaaagaaaacatgcatattgtaagaaggcgtgttgagttttttgttgattataggtacttgttactagcaccatgctctaaccaattgagctaactggccattgattataggcacttgtaaattagctttttttttttttttttagtatttattgatcattcttgggtgtttctcagtttctcagagagggggatgtggcagggtcataggataatagtggagagaaggtcagcagataaacacgtgaacaaaggtctctggttttcctaggcagaggtccctgccgc

SEQ ID NO: 166431 - DNA, 601 bp, Human
ctggctggttgcaggtgaggaactcaagatggcaatttgttttttgtgtgtgatgcccttcagtttaatttacttttctctgaaaaacaggaaatagtaatcaggatgaaaaggaaatttgtttattccctttaatggattatcatggtcatttaacgttgagaaaagaaggacagtatctctttcggaaaaatcttcagtcatccaaaagactttactgtgaaaagacttttctttactgtaaatttaaaatatgcctccaaaaccacaaaaaagaaaacatgcatattgtaagaaggcrtgttgagttttttgttgattataggtacttgttactagcaccatgctctaaccaattgagctaactggccattgattataggcacttgtaaattagctttttttttttttttttagtatttattgatcattcttgggtgtttctcagtttctcagagagggggatgtggcagggtcataggataatagtggagagaaggtcagcagataaacacgtgaacaaaggtctctggttttcctaggcagaggtccctgccgccttcggcagtgtttgtgtccctgggtacttgagattagggag

SEQ ID NO: 166432 - DNA, 601 bp, Human
gttgcaggtgaggaactcaagatggcaatttgttttttgtgtgtgatgcccttcagtttaatttacttttctctgaaaaacaggaaatagtaatcaggatgaaaaggaaatttgtttattccctttaatggattatcatggtcatttaacgttgagaaaagaaggacagtatctctttcggaaaaatcttcagtcatccaaaagactttactgtgaaaagacttttctttactgtaaatttaaaatatgcctccaaaaccacaaaaaagaaaacatgcatattgtaagaaggcgtgttgarttttttgttgattataggtacttgttactagcaccatgctctaaccaattgagctaactggccattgattataggcacttgtaaattagctttttttttttttttttagtatttattgatcattcttgggtgtttctcagtttctcagagagggggatgtggcagggtcataggataatagtggagagaaggtcagcagataaacacgtgaacaaaggtctctggttttcctaggcagaggtccctgccgccttcggcagtgtttgtgtccctgggtacttgagattagggagtggtgat

SEQ ID NO: 166433 - DNA, 601 bp, Human
tttgttttttgtgtgtgatgcccttcagtttaatttacttttctctgaaaaacaggaaatagtaatcaggatgaaaaggaaatttgtttattccctttaatggattatcatggtcatttaacgttgagaaaagaaggacagtatctctttcggaaaaatcttcagtcatccaaaagactttactgtgaaaagacttttctttactgtaaatttaaaatatgcctccaaaaccacaaaaaagaaaacatgcatattgtaagaaggcgtgttgagttttttgttgattataggtacttgttaytagcaccatgctctaaccaattgagctaactggccattgattataggcacttgtaaattagctttttttttttttttttagtatttattgatcattcttgggtgtttctcagtttctcagagagggggatgtggcagggtcataggataatagtggagagaaggtcagcagataaacacgtgaacaaaggtctctggttttcctaggcagaggtccctgccgccttcggcagtgtttgtgtccctgggtacttgagattagggagtggtgatgactcttaactagcatgctgccttctag

SEQ ID NO: 166434 - DNA, 601 bp, Human
ctttttttttttttttttagtatttattgatcattcttgggtgtttctcagtttctcagagagggggatgtggcagggtcataggataatagtggagagaaggtcagcagataaacacgtgaacaaaggtctctggttttcctaggcagaggtccctgccgccttcggcagtgtttgtgtccctgggtacttgagattagggagtggtgatgactcttaactagcatgctgccttctagcatctgtttaacaaagcacatcttgtaccgcccttaatccatttaaccctgagttgacacascacatgtttcagagagcacggggttgggggtaagattatagattaacagcatcccaaggcagaagaatttttcttagtacagaacaaaatggtgtctcctatgtcaacttcttactacacagacacagtaacaatctgatctctctttcttttccccacatttcccccttttcttttcgacaaaaccgccatcgtcatcatggcccgttctcgatggtcactgtctctttggagctgttgggtacacttcccagatggggcggcctggcagaggtgctcctcacctcccagatgatgggc

SEQ ID NO: 166435 - DNA, 601 bp, Human
ttgggaggccaaggcaggcggctggaaggtggaggttgtggcgagccgagatcacgccactacactccagcctgggcaacactgagcattgagtgagcgagactccgtctgcaatcccagcaccccgggaggccgaggctggcagaccactcgaggtcaggagccggagaccagccccgtcaacagggcgataccccatctcctccaaaaatagaaaaaccagtcaggcgtggtggcgcacacccgcaatcccaggcacttggcaggccgaggcaggagaaccacggaagtccggggcagrgaggctgcagcgagccgagaccacggcagtatagtccagcctcggcaacggagggagaccgaagaaaggagggagggggagggggagagggagagggagagggtaaattagctttatttgatgtaaaagttcaaaaatttagttctctgagagtagaaattattaaaatcgtttttgttttatagaaactggcaaatatttgagatttaaaatatggcaaaaatgatgaaagtgaaaaataagaaatgtagttacattatgtttttttcttggttataaattaaacaatactttattttt

SEQ ID NO: 166436 - DNA, 601 bp, Human
gaagttgaaaaaagtaagtgaaacacacacatttataatggaagcatacataacatgtgtggacatttcagctgttgagaattcaatttattttaaaaccactgatttttgggggaagggtgtaggggtgatgttacaggtacttttcagagcaagattgccacatttccatttaaatttaatttccatatcaattaattcatgcagcaggaaaagcatatctatatattcaaatgccagaatttggagagggcccaaggaaaattgagaggaaagtagaagcattttagaatttctcaakatataaggaaccagcattttataattttatacactctaaagtcctcataagtttcccttttcagtttgccccgtgctctatacctatctagggatactaggtacatatgagtgtgtgactgtgtatatgtgaatagagagatctagagacaaatgattttatataaacatgtttccttttattctcccaggatgatttccttgaaaatattttctttcagagtatatcctagttcagtgaattaatggtatcaaatattggcatgattacacttcattttccccccaagtattctaaatg

SEQ ID NO: 166437 - DNA, 601 bp, Human
gatggtaattaaaatatgtaaggcattactgatacgataatccagtaaaacaaactgcagaaataatggaataaattaacaagaaaacaatgttaataataattactaccatcgttgtaccaacagtggaccaggcagcttacattatggccttatctaacctgtatacagcctgatgaaatgggtattattattattattattatttttgagatggagtcttgctctgtcacccaggctggagtgcagtggcgcgatctcggctcactgcaagctctgcctctgaaatgggtattattamaccaatttttcagatgagaggactgaagcttagagaggtaacatattttgcacatgatcccacagcgggcaaccgattgcactaagattcaatcccagagctacctgattcaagtcaagacttttgtacgttacagtactgccctttcaattcacaggaatatggtgaaaacatagatatgcaaaaatacttttttaaaaaggagaaagaatagaatgaatgaaagtcaaagatgtgatgtttcctaaacacacacagtcatctgaaattagcatctgtatggcttcatgtattattctt

SEQ ID NO: 166438 - DNA, 601 bp, Human
cccttctaaattgcttaggatacgagtctgtgctgggtgaccagaacttgacacatacacaatattaaatttaaaaggacatttaaattactcattagtcagggccagtgttaaccactacccatttggccagtgtcctctaaatattatcatttattgtgttattgcagctggggagggagaaaatgacagcatcccaggggtaagatttaatcttgaattcatcaggaaaatgacccctgaacatcccgagtctagccctcatttgagaactagtcctgctaattatataccttccccstaaagtacagtaagcataaaaatgtttccagatattcagccaaggaaaatagttattcatatacttaccttttatcaggcatagtctaggccataatgacctaaaagtgtaaaacacacttgccttctgcccttaggcagctcatggccccctgtagtttagggaaagggatcggaaacagcaaacaagcaagtattcaaataactatataattacaacttacggtgagtgcaattatgaacataaacacgaatgctgaagaataatgaagtagaaagaataaggaaaccagaacgcaaa

SEQ ID NO: 166439 - DNA, 601 bp, Human
aaggacatttaaattactcattagtcagggccagtgttaaccactacccatttggccagtgtcctctaaatattatcatttattgtgttattgcagctggggagggagaaaatgacagcatcccaggggtaagatttaatcttgaattcatcaggaaaatgacccctgaacatcccgagtctagccctcatttgagaactagtcctgctaattatataccttccccgtaaagtacagtaagcataaaaatgtttccagatattcagccaaggaaaatagttattcatatacttaccttttrtcaggcatagtctaggccataatgacctaaaagtgtaaaacacacttgccttctgcccttaggcagctcatggccccctgtagtttagggaaagggatcggaaacagcaaacaagcaagtattcaaataactatataattacaacttacggtgagtgcaattatgaacataaacacgaatgctgaagaataatgaagtagaaagaataaggaaaccagaacgcaaagggtcaagaggaattggccatgcacagaggttgatgaatcactttccatgcggagggaccacagtaacaacagc

SEQ ID NO: 166440 - DNA, 601 bp, Human
ccaggggtaagatttaatcttgaattcatcaggaaaatgacccctgaacatcccgagtctagccctcatttgagaactagtcctgctaattatataccttccccgtaaagtacagtaagcataaaaatgtttccagatattcagccaaggaaaatagttattcatatacttaccttttatcaggcatagtctaggccataatgacctaaaagtgtaaaacacacttgccttctgcccttaggcagctcatggccccctgtagtttagggaaagggatcggaaacagcaaacaagcaagtaktcaaataactatataattacaacttacggtgagtgcaattatgaacataaacacgaatgctgaagaataatgaagtagaaagaataaggaaaccagaacgcaaagggtcaagaggaattggccatgcacagaggttgatgaatcactttccatgcggagggaccacagtaacaacagcaagggctgtgagtagagtggcttgagtgagggtggagtgagacgagatgaggcaggtaggtgggaactgggtgatgtaggattttggaggccattatgagaaattcaaatattcagtgaaat

SEQ ID NO: 166441 - DNA, 601 bp, Human
agtagagtggcttgagtgagggtggagtgagacgagatgaggcaggtaggtgggaactgggtgatgtaggattttggaggccattatgagaaattcaaatattcagtgaaatgtgacactactgaaaaagtttagagaagggggcagtgtagcctgattcaagttttaaaagattgctgtggttgccatatggagactagtttaggaggaaacaggagtggaagcaggaaaagcagtgaggacaggctgctgctctaggccagacgagagtccccgatggtcaaaccagacaatgcatcaragaggactgagtggcttcaagacatattgagaaatgggacagcctactgatggatggaatgtgggaatgagagagaaagaagaagtgagatgaccctctagtgtccttgtttgaggaactgggtaggtgatggtaccatttactggcatggggaagaccgaaagagaaagaattcaggagtttcaaatgggatgactatttgagatgcctgtgaagtattcaaggggaggtgttcatatagcattgccatctgactctttctctgggttcatttcctaactgtctaactttgggtaagtt

SEQ ID NO: 166442 - DNA, 601 bp, Human
gcctggaattccttgaggaggtggaagagggtgggattgctgtggtgcaaaggtgtggcccttcacaggagcaggaacacctgattagtgaagacagtggatgaagatgcaggtaggcagatacatttggtgataggaagaggggagagtatttgtctgatgagcaaagccaaaggaatattgcctttacacactatcttttctgatatagggaattgtgactactctgagaatattgaacgtctattaagactcaagagtattgttttaatacaaaaattagccaggcgccatggtacgygcctgtaatcccagctactcaggaagctgaggcaggagaactgcttgaacccaaaaggcggaggttgcagtgagccaagattgtgccactgcactccagcctgggcaacagagcaagactgtgtctcaaaaaaaaaaaaaaaaaaaaaagttgctaaagccttcatcaatattgtcttagtgtcttagtcagttggtgctgctatcacaaaaataccattggcttaaacaactgaaaactatttgtcaccattctagagtctaagaagtctaagatcaaggttccacgcaatcagttcct

SEQ ID NO: 166443 - DNA, 601 bp, Human
tttctttcttgtcatttttgtatttttcactaatctcacatggcaagaatggcaaatcccaagcctctattcactgcataaggagcaagagagagggaaattggctaagttaccatggtttctcctcttcatcttcattaagctggaattaaattatagccttcagatgtaaataggcaaccagtccattgtctagctttaaacatagcactcagatcaagcaagatgtcctggttgcttttagccaataaaaaggcattcctgattaaacacattggataccctttttgtaatgttgctrttttgtaactgaatcaggtttctgctatctgaactcagattttatgttcatttattccgtttggggatagcaggagtaggtgtcttagaatcaaagtatgttaatgtttctagctaccgcatcttactctatttaacatcccaacatttgctggaaactgaggagtacaagaaacaaggaggacccaaatttatgtacaaaagttatctcttatgcatgaagcatttattcagagatacttaatttatttattcagagatactttatttattcagagatactttcgtattcttaaaaaca

SEQ ID NO: 166444 - DNA, 601 bp, Human
aagttaccatggtttctcctcttcatcttcattaagctggaattaaattatagccttcagatgtaaataggcaaccagtccattgtctagctttaaacatagcactcagatcaagcaagatgtcctggttgcttttagccaataaaaaggcattcctgattaaacacattggataccctttttgtaatgttgctattttgtaactgaatcaggtttctgctatctgaactcagattttatgttcatttattccgtttggggatagcaggagtaggtgtcttagaatcaaagtatgttaatktttctagctaccgcatcttactctatttaacatcccaacatttgctggaaactgaggagtacaagaaacaaggaggacccaaatttatgtacaaaagttatctcttatgcatgaagcatttattcagagatacttaatttatttattcagagatactttatttattcagagatactttcgtattcttaaaaacaaacaaatatagatgtcagcaatatgccagatattagatcacaggattagatccccaattcccaggccccactctgtcactgatatgtctaagatcaaggaaagtgg

SEQ ID NO: 166445 - DNA, 601 bp, Human
gactgccatcagaaaaatccacttcatcatcagtggcttaactcacatctggggaccccttccccattagaaagaaaatgcaaaacatttgttatacttttgggaaagtttaaaatgtaggtggagcatttctaatcagaaaaatgcaacatccgaaaagttccaaaattcaaaaccttttgagtgctgacattggatagtcatacctttgctttttgaagtttcactgtacataaactttctttcatgaacaaaattactaaaaatattgtataaaattaccttcaggctgtgtataagwtgtatataaaacataaatgaattttctgtttagacttgggtcccatccccaggatacctcattatgtatatgtaaatgttccaaaatctgatatccaaaacatttctggtctcaagcatttcagataagggatattcaaactgtactgtacaggatgtttctatgatacactgaaataccagttaacctagttcagtgaattaatgataattgctttttatttttaattatttattttttaacagataggatctcgctctgtttcccaggctggagtgcagtagtgtgatcatagctgac

SEQ ID NO: 166446 - DNA, 601 bp, Human
ccagacatccattgattggatggtgcccattccatactggagggaaagtgggcagggagaatgctgatagggagtggcaaggagttcatttttcttgttctggaaagaattctggggtcatcctgagaaggtcatgggaaatgagtcaaaggagtatttgaagaaaattatagtcttggcagaagaattcattgaaagtgggcatgctaagggcaaggtaagaattatgatactcatgcttctgttataacacacctatcacattgtgttaataaagtattaacaaccagagaaagaggtyattgcagatgagaccacacctcatcatcagtgtgtccctggaaccatgcctagttaaaatctagtagtctattttctcaggaagtaaagcgctgtttaatgaatgataggggcaaggaaatctagattaagttggaaattgtcaaaaggaaggaagaatagaaataagttggcagcttgaggccaggtgcagtggctcatgcctgtaatcccagcactttgagaggccgaagcgggcagatcatgaggtcaggagatcgagaccatcctggctaacatgttgaaaccccgtctctactaa

SEQ ID NO: 166447 - DNA, 601 bp, Human
tttcttgttctggaaagaattctggggtcatcctgagaaggtcatgggaaatgagtcaaaggagtatttgaagaaaattatagtcttggcagaagaattcattgaaagtgggcatgctaagggcaaggtaagaattatgatactcatgcttctgttataacacacctatcacattgtgttaataaagtattaacaaccagagaaagaggttattgcagatgagaccacacctcatcatcagtgtgtccctggaaccatgcctagttaaaatctagtagtctattttctcaggaagtaaagygctgtttaatgaatgataggggcaaggaaatctagattaagttggaaattgtcaaaaggaaggaagaatagaaataagttggcagcttgaggccaggtgcagtggctcatgcctgtaatcccagcactttgagaggccgaagcgggcagatcatgaggtcaggagatcgagaccatcctggctaacatgttgaaaccccgtctctactaaaaatacaaaaaattagccaggcatggtggcgagcccctgtagtcccagctgctcaggaggctgaggcaggagaatggcgtgagcccggga

SEQ ID NO: 166448 - DNA, 601 bp, Human
tagattttatctgatctaagaagttggttaggtggctgctctctgctgagaaacgtagaggtagaactgaaaaacagcagtatagaaaagctttggagttgcccctggctggaatagaatgatccacaggaaataaggagaaggtctgccacatagcacacaggaccctggtgagggttggtggtgtgtactaagttgatgtagcttgatctcattacttcttcagcagtgcccagaaactcagcaacaactgtggacaaagtacagcttagggagttgcaagcctgaaattatcacaatktatatggtctgggaccaaaagtttgaagaccattaagttatgacactgtaacagttggctattgatgtgtaacaagcaatcacaaaagtcagtaatttaaataagtaagcatctattatagctcatgaggttgtctgggtggcttttctggttatgggaggattagtatcagtgactcagctgatcttagctatgcttattcaaatgtttggggttcagctaaagtgtcattggctgggacaagtgggctgtcttccttgtggactctcatctttcatcagcttagcctgggcttgttca

SEQ ID NO: 166449 - DNA, 601 bp, Human
tggtgagggttggtggtgtgtactaagttgatgtagcttgatctcattacttcttcagcagtgcccagaaactcagcaacaactgtggacaaagtacagcttagggagttgcaagcctgaaattatcacaatttatatggtctgggaccaaaagtttgaagaccattaagttatgacactgtaacagttggctattgatgtgtaacaagcaatcacaaaagtcagtaatttaaataagtaagcatctattatagctcatgaggttgtctgggtggcttttctggttatgggaggattagtrtcagtgactcagctgatcttagctatgcttattcaaatgtttggggttcagctaaagtgtcattggctgggacaagtgggctgtcttccttgtggactctcatctttcatcagcttagcctgggcttgttcacatggtagttgcagtgttctaaaatggaggtgaaagtacagatgctccttgacttatgacagagttacatcctcataagctgaacatatcattaagtcaaaaatgtgtttaatatctaagctaccgaacatcatagcttagcttagtctagcctattttaaatgtgct

SEQ ID NO: 166450 - DNA, 601 bp, Human
aagttattgttaaggaactatgctgatatgaacaaaaactttatgtagtgaaacttcaattagctaaaacccaaaatgtgctgcctaacctactttcataccagggaagcctgtagacctgcacagtcctatatagtagccactaaccacatggggctaccactaaccacatagggctatttgaatttatttaacaattaacttaaaagttaaaccttgagttcctcattcacactagccacatttcaggtgctcaagagccacagatggctagaggccgtcagttggacagacccacgcrtggaacattcccattattgtgcaaagctctatgaggaaggctgttcttggcacgcagatggaactgtcctcttctgtagagtgtggtttttttttttctaactaaatcacttatgggaatcaacatttttacaaattgtgtctttcccccaaaacacaaaaccaggtagttgagggaagtttatgtttttgtaggttccttttaatcaagacttagttgaaccaagacaaaaagaaaataaaaattgagagagagagtgtaagtttcatcagactgggtcaaactcagaatttgctagat

SEQ ID NO: 166451 - DNA, 601 bp, Human
ctgtattcactcatgaatctgctgttactaccagtttggttggcagatgggggactggctgatttaggtcagcctctgttaaaccacttcctctctgctttatgtggtctcctgtcttccagcaggctagtccaggcttgttcacatggctggggtcctgagagaccaagcagatcaagcatagtttcttgtggccccagctcagaactaacacaccatcacttccacctcattttttggccaaagtaggtcctaagtctggccttatgaggtctctaccttttgacaggtgacaaagttrcatcagaagtgggagtggatgcagaaagggaaataactgtggccatttttatagcctaccggctattcaacagattagcttattaatacttaaaaaaacacagcttcattaaatcatctagtttttaagtggtggagtcaggatttgaaccaaattcagcccggcttgagaactcagacttgtaaccactatactcagctgcctctgatgtttctcacactaatttttcttctcttcacacatctttttctttatggtctcactaacaggtttttaagagcaatcatgaacctatcaggg

SEQ ID NO: 166452 - DNA, 601 bp, Human
ctgttactgacattaattatagtcactttaattcaatatgctttcagtttttcaaattatttttgcatatgtttagtaaccttgcatctcataagcaactcatgaattcggttaggcaaaggtacctaactcagttttcttttcttttcttttcttttttttttttttttttttgagatggagtcttgctctgtcatgcagtggcatgatctcgactcactgcaacctatgcctcccgggttcaagcaattctcgtccctcagcctccagagtagctgggattacaggagtgcaccaccaygcccggctaatttttgtatttttagtagagttgggtttttgccatgttagccaggctagtctcgaactcctgacctcaggtgatttatgcgcctcagcctcccaaagtcctgggattacaggcatgggctactgtgcccagccctaactcagttttctaataaagacattgaggcctgggaagatttatatatgttacacaagggcagttgtttaattattggctgagctgggaccagaatctaagtcctcttgctattttcctatgctgactttttattcatgcgataaatacttattg

SEQ ID NO: 166453 - DNA, 601 bp, Human
atttcttcctgagcctctgctgtcaaacgcagcactcctagcaggctcttcacacagagcatttccaagtactctaaagagtagaatcttagcaatacattaaaagttacttcaaaatcagacatcagatactttcttctggaaagccatatctgaggagagtttctcatcattaatattcaccatgatatcaaggttgcctggacttagtcttgctatgttgcccaggctgaagtgcagtagcacaatcttggcccaatgcaacctccgcctcccaggttcaagcaatcgtcctgcctcsgcttcctgagtagctgagactacaggtacatgctgccatgccggctaattttttgtatttttaatagaaatggggtttcaccatgttggccaggctggtctcgaactcctgacctcaagtgatctgcctaccttggcttcccgaagtgctggaattacaagcgtgagccactgcacccagccttcctggacttttaactgcaactgagttgctaaaaagttagtgaaaggggaaactgtgacagtccttggagctttctcatgcaggatctatttttgaaacaaatgaaaggtttcccct

SEQ ID NO: 166454 - DNA, 601 bp, Human
gttgcccaggctgaagtgcagtagcacaatcttggcccaatgcaacctccgcctcccaggttcaagcaatcgtcctgcctccgcttcctgagtagctgagactacaggtacatgctgccatgccggctaattttttgtatttttaatagaaatggggtttcaccatgttggccaggctggtctcgaactcctgacctcaagtgatctgcctaccttggcttcccgaagtgctggaattacaagcgtgagccactgcacccagccttcctggacttttaactgcaactgagttgctaaaaagttagtgaaaggggaaactgtgacagtccttggagctttctcatgcaggatctatttttgaaacaaatgaaaggtttccccttactcttacctactcagctgaaaggaaagattgacctgggaaagggaagctttattcaagtgcttccagctttggctaatgactacctctcatatgctttccactcaaggatctttaaggtgatggtaaaaagatgaatgggggaacaagggaagacaagctaaagttgggaaaattctaaattacagaaattattttgcatagcccgaatataaagaa

SEQ ID NO: 166455 - DNA, 601 bp, Human
taaaccatgctactataaagacacatgcacacatgtgtttattgtggcactattgacaatagcaaagacttggaaccaacccaaatgtccatcagtgatagactggattaaaaaaatgtggcacatatacaacatggaatactatgcagccataaaaaaggatgagttcatgtcctttgcagagacatggatgaagctggaaaccatcattctcagcaaactatcacaaggacagaaaaccaaacaccgtatgttcttactcataggtgggaattgaacagtgagaacacttggacacagkgtagggaacgtcacacaccgggccttttggagggtgggggactgggggagggatagcattaggagaaatgtctaatgtaaatgacgagttgatgggtgcagcaaaccaacatggcacatgtatacctatgtatcaatcctgcacgttgtgcacatgcaccctagaacttaaagtataataaaaaataaataaataaataaaataaatccatggcagaagcacttttcaaagcaacagcagtattttagctttttctcaaacccctggtggttgtgtttcttcctcatgatcacaactatt

SEQ ID NO: 166456 - DNA, 601 bp, Human
gtccatcagtgatagactggattaaaaaaatgtggcacatatacaacatggaatactatgcagccataaaaaaggatgagttcatgtcctttgcagagacatggatgaagctggaaaccatcattctcagcaaactatcacaaggacagaaaaccaaacaccgtatgttcttactcataggtgggaattgaacagtgagaacacttggacacagtgtagggaacgtcacacaccgggccttttggagggtgggggactgggggagggatagcattaggagaaatgtctaatgtaaatgacragttgatgggtgcagcaaaccaacatggcacatgtatacctatgtatcaatcctgcacgttgtgcacatgcaccctagaacttaaagtataataaaaaataaataaataaataaaataaatccatggcagaagcacttttcaaagcaacagcagtattttagctttttctcaaacccctggtggttgtgtttcttcctcatgatcacaactattattcttggttaaaaatctttgctttcttgacatttgtcagcaacgtttggtcattggtgtttgttgaatgaatgaatacagaaagg

SEQ ID NO: 166457 - DNA, 601 bp, Human
ttcactcatgaaaaacactctacctcaccagtagtcagggaaatgcaagttaagacaataagctccattccataggagcatccaactgacagaaagtctgatagtactaagagtgggcaaagatatggggaaagggtaacacccagacactgcagatggaaatgcagttggggacaactggattggagtaaggaagagcctgttcgtaccctgccaagtgacaagtctgagtatacaccctacagcagcctttgcctgtgtgcacaagaagatatgcaccatacttcatccactcatctgyttattcaacagacacttattgtgtcaggtattacagggcccacgcacccgatcgttgtagcgttgtttgaaaataacctaatttttgttaatggcaatgaggaaatagtgtagtctgttcataaattgaaaagtccatacagcaaatgaaaataatgaagtggtctggaacataggtgtatctctaaaacataagactaagtggtaagctatgggaagaaacccagactatgttactctatgggtacatttagaaaacacaggaagcgatgccactgtgcctggccagcaacatcagcat

SEQ ID NO: 166458 - DNA, 601 bp, Human
tctgctccctgaaagctaaaataatgtctcactaaaatctttaaggtaatgatttggcaccattttatacagaaaatgaagccaggtttagtcatgcgtaagtcctctattattttctaagattttagcaggaaagatcttcccagaaataattatgagtttaaactctccaaattttgagatgattttttaaaaaattattatctctttcacttaaattataaagttacaagtcatctctcatccctgttttaagattgtaacccaaagttcaatcagaattttttttttttttttttttgcagcttgccatgaagcagtccaaagaaatggatcagttgaaaaaagtccagcttgaacatctagaattcctagagaaacagaatgagcaggtattttacctaaaatacgtaaaaacatgcaggcagctagccagctttgggatacacatgccatggcccacagtgaccagtggcttgcatattgtaattgaaaggtagatagaagaatttgttgcccattactatattttctccattatatccaaaaagaaaagaaagtaccagtttttggagcaggagcagaatctggctgtgccaaa

SEQ ID NO: 166459 - DNA, 601 bp, Human
ttactctgtatggtacaacactgtcatgggcacagtgcaaaagatacagtgacttcatttctttcctcataaaaaggcaaggtctggaactatatagtataactgccttcataaccaggtaaacatttcatcagcaagaacagttctttgtctccagacaatgcaaacttctacaacaatcttctaaataattgttaaatcccaagacattttttctaagccagagataaatgtaaacattctcccatagtatttccctcaaaggtttctttctgttctcctgtgaccctactcctaatcsgtgtcccaaatctccccttccaaagcaaggcctggaatggattcagtccattagctaaaccagtgttgggggcactggcagaaacaaaccaggcgtcagtatgttttggtcctgattctggatcctcaccttctaggttatttgtaagccactttatgtccttgcctacttggtcagccaactattcacttaacactctgaaggttggggatgtttttcctacttgagttttttcatagacttcccagctacacagtatatctcatctgtcttgacatgtaccatttcaaacattaacga

SEQ ID NO: 166460 - DNA, 601 bp, Human
tgcctacttggtcagccaactattcacttaacactctgaaggttggggatgtttttcctacttgagttttttcatagacttcccagctacacagtatatctcatctgtcttgacatgtaccatttcaaacattaacgactccattactgtcacacactcgagtctcaaaaattgatttttatcatcaatcctatcatttaataaagagaggtaaaaggttttgcttaaaggccaggttctccacttactgccacagaagagaggcacagtctgggaatgacaggcgttggttgtttgtttygtttcttttttttctgttgagatcaactaggggaaagtttgtcactgaggggtgtgtacatgttttatccttagctttttgcttttctgtatatggttttgcattcatttttcaaattcacttcaatattcatttattttcttcgttttgtatgtatgactcaattttgacattactatttttgtacaaacagcttttgaaatcctgtcatgcagtgtcccaaacgcaaggtaggaccgaaactctgataagcaagacgttgctttccttctcgactacgtccgtattctctgtgcagtc

SEQ ID NO: 166461 - DNA, 601 bp, Human
aaaagtaccctagagaagtaagagcccacagggatagagtttgcacaataagattcctgaaagcctgcatgttcctgtaacattccatttacagaagactccagccaatccaatgtaatatgctctcacctgaacttctctatcaattagatttttagggaattacttttaactaaatttcaggctatttaggaaataagttgtacataagcaatacttattctaatgtgataaaattatctacacacagtcaaagcaacgtgtcaatctgtagaaactaaatcaaacagtttgtggtatrgtctaaagataaagcaagtggtctaccctcttctcaagtggttctcctggcactgtgtaaaccagtccccaaaatttaatgtgtataaaaacttcctggagatcttgttaaaatgaagattttaactgattcaatagatctggggtagactccaagattctacgtttctaagaaggtcccaggcaatgctgatgctgcttgtacatggaccatattttgagtagcaaggatgtggtgacaggatcatatttatgggagaagagaggccagggttgttaagtgccttcagataaggatttc

SEQ ID NO: 166462 - DNA, 601 bp, Human
ctcgaccccatgcctagccgaaccgccaaggtcctggtctttcccgcccagaccgagcggcctcggcccaggccttcaccgccctaagtggctccaacccacggcttcctccccgatcagtcgcggttcccactccacaacagactcggaagctcccgcgccgccagcctgtgccctccttaccatggtggcggttctgatggctctgatacccgccggattcgcctcctcagaggcctagcctctctcccacagccgatttcccgccgccgctaccggaaatgcagcaccacgtaaaatkcggtcgggtagaaacctacttccggtccagctcactagccctggagttccggccccggagcggagcttctgccgagcagaggcggggcctggggactgggcgttaacatccggctttgacgtaaggagagccttaagttcctgtttggacaccttcctagcttaaatccgtactgagagctgctctgtgtcacactcatttctcttcaccccgcctttcccattaacctctcggtcctcatttcccatcaccctccccggctctctcctctacagtcactattcttgcttttcactccac

SEQ ID NO: 166463 - DNA, 601 bp, Human
caaacaatatcctaccaggtttccctgcttccagtcccatcgaatatacatgccagagctagagcaatctttctaaacaccactaagcttatgtcattttgctggttaaaatccttcagtgggcagggtgtggtggctcacggctgtaatcccagcactttgggaggccaaggtgggtggattaactgaggtcaggagttcgagaccagcctggccaacatggtgaaaccccgtctctactaaaaatacaaaaaattagccaagtgtggtggcgggtacctacaatcccagctacttgggwggctgaggcaggagaatcgcttgaacccgggaggtggagtttgcagtgaaccctgatcgatccaccgcactccagcctgggcaacaaaagcaaaactccgtctcaaaaaaataaaaataaattaaattaaatccttcaatgacatgcctcaccaccactgaggtaaaattaacatgcaaggcctttagtaactagcctcctgccaattcttcccgtcttcccttctttcttcctttctcctccagcaactttttctcagtcaacaaacgcagaaaaatccagtaactttttaaatcttgt

SEQ ID NO: 166464 - DNA, 601 bp, Human
tgccttctatggacatctgttcatctctgtgagctcagacaacaaagttctgaacctgcaaatatgcagatcaaaaccttgactccatggccgggctcagtggctcactcctgcaatcccggcattttgggaggccgaggtgggcagaacaccttaggtcaggagttcaagaccagcctggctaacatggcgaagccccgtctctactaaaattacaaaaattagccacacgtggtggcaggtgcctgtaatcccagctactcgggagactgagatgggagaatcgcttgaacctgggagrtggaggctgcagtgaactgagatcatgccactgcactccagcctgggtgacagggaaagactccatctcaaaaaaacaaaaacaaaacttgactccacacaaagatactgcgagcctccctcaggttaggtggttcagtttccattcaatgaccattttaaccagcttctaaccacaagggatctgaacctttagggcaacattcactggtccagctcaactcatgtttactgggtgctcactgtgtatctggcactgtgataagcacagtacatctcatttaatccccaaaattgggcc

SEQ ID NO: 166465 - DNA, 601 bp, Human
agcctggggcatgggaaccccagctgggattcctctgccagcagccctgccgatccctgggcccccggcagctccagcaagtggaactcgagcaataccagtctgaaaaataaacaaatatgctctgatgcccagtgatctgaagatcagaagtatactttggaatatcattgccaagagagcccctcgaaatagcttataaatactatcgaaatagcttataaatactacctctccatgtgtgccaacaccattcttcctccatccaagactatgagttatccctgaagcagggtagaayttaagagtaagtctagagaaacatgccacaactcaaccacctatatgcactcctgtgaaagttaaaccaagagcaaagggccagggttccactcagggttcagcaggcaaggcattaaagggacatgagatccattcccagctgattctaatccgctaggtgacaatggacaaataatcccacaatcccgggctgagttgccttatctgcaaatgacatggttatggtacaactggttgtgatcacaaaggtttatgatgggttatgttagaccagccaattctactggaagtaggtact

SEQ ID NO: 166466 - DNA, 601 bp, Human
accagtcacggaccctggacccagcgcacccgcaccatggccggccccagcctcgcttgctgtctgctcggcctcctggcgctgacctccgcctgctacatccagaactgccccctgggaggcaagagggccgcgccggacctcgacgtgcgcaaggtgagtccccagccctggtcccgcggcgctccggggagggagggacccgcagccacaggggcgcgccccgctccggcctcgcctgagaactccaggagctgagcggattttgacgccccgcccttgaccgcggtcgaggcccccrcggcgccccagcgcgtctcagccccgctgtcccgcccgaactccgaaccccggaccccagcatccttgcccggcgcaccccggccggcctcgcagggtcctccgagcgagtccccagcgccgccccggctcccgctcaccccgcccgtccccgcagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggc

SEQ ID NO: 166467 - DNA, 601 bp, Human
actaagatgtcccagattactctccagagtggaaccagggagcagcttcaacaattccaattagtctgttacagagtcatccataagcatgccttgcttttaaacaaaacaaacaaacaaaaaaacacacacaaaaaaattttttttgaaacaacaaaaaaaaaactagtactaatcacttttctgacaatacaattactcaaaattaactagtactgggagggggaagggggggccatacctatgggccttgtctcacacgagtgcatgtgggtaggtgcagggcatttgtcattattgsaaaaacgaattttaatttttaatctttagtttgatttaaacattgcttttagtatgatgccgacaccagctgtgcagaaagggctctggagagatgttcatagcagcacacacctgcggctctttttcggttctggaggctccagggcagccaatattgcttcgtcaaatacattctttaggcctttctttgtaagtgcagaacactccacatacttgacagccttcaggtcacgggccagcttttcagcagtctctggagtgataggcttctgtttgttcttggcaggtttctcaatag

SEQ ID NO: 166468 - DNA, 601 bp, Human
ggaatgtggaatcaatccgtcctcctccccttaagggctaaccactggttaatgaattaaaaaaacaagactaaaaaacaaaccccacacacactcccccccaaaaaaagaggagggaaaaaaaacaaaacaaaacactaagatgtcccagattactctccagagtggaaccagggagcagcttcaacaattccaattagtctgttacagagtcatccataagcatgccttgcttttaaacaaaacaaacaaacaaaaaaacacacacaaaaaaattttttttgaaacaacaaaaaaaaaactagtactaatcacttttctgacaatacaattactcaaaattaactagtactgggagggggaagggggggccatacctatgggccttgtctcacacgagtgcatgtgggtaggtgcagggcatttgtcattattggaaaaacgaattttaatttttaatctttagtttgatttaaacattgcttttagtatgatgccgacaccagctgtgcagaaagggctctggagagatgttcatagcagcacacacctgcggctctttttcggttctggaggctccagggcagccaatattgcttcg

SEQ ID NO: 166469 - DNA, 601 bp, Human
tttatcagtgaaagaagttagaaattaacttcccaaaaaaatcagcaaatggcaaacaaatgtccttgaaagtcacagtcacatatagtgcgtcctagaaaagaggaggggcaagacgggctccacccactttcatgagtttcatcaaatactggatctactcaagggtggagagaaaaggcaactttcaaaaaggagtatgttattaaatgaggcatttactatactccttcctaagagcaccagatggggaacatgttttctaaactagatctaggaaatggaatgtggaatcaatccrtcctcctccccttaagggctaaccactggttaatgaattaaaaaaacaagactaaaaaacaaaccccacacacactcccccccaaaaaaagaggagggaaaaaaaacaaaacaaaacactaagatgtcccagattactctccagagtggaaccagggagcagcttcaacaattccaattagtctgttacagagtcatccataagcatgccttgcttttaaacaaaacaaacaaacaaaaaaacacacacaaaaaaattttttttgaaacaacaaaaaaaaaactagtactaatcactttt

SEQ ID NO: 166470 - DNA, 601 bp, Human
gtaccctctccatttccccttccctttgacccctgtcctctccttctttctcactcccccactttcttccttccttcccctccccttcgggccccaccagactctgcctacctgctaaggggctaacccacatagatgctgataatcaaaaatgaaagcctgaaattttcagccctagaatcacttcaaagacatgaaacacttcagaatattgcttctattttcttttcttttctttttttttttttttgagacaagatgtcactctgtcacccaggctggagtgcagtggcaggatcayggctcactgcagcctcgacctccctgggctcaggtgatcctcccacctcagcctcccgagtagctgggactacaggtgcatgtcaccatacccggttaatttttgtattttttttagagacaaggtctcaccatgttgcccaggctggtctcaaactcctgtgctcaggcaatgcgtcagcctcgacatctcaaagtgctgtgattacaggcgtgagccccgacacctggcctagttctattttctaaatgtgaattctgtaaagatatcttttaaaaataaagttctgtttttggtaga

SEQ ID NO: 166471 - DNA, 601 bp, Human
ctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctcycgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcaaaggtgacgcagatgtgggtgccctgctcctgcccagcagcagtgcttggtggaggctgaggccctgcacaggcaccctcactgctgaccttgagcctctctctcctctagagtggaaaagacaaggatgccgtggataaattgctcaa

SEQ ID NO: 166472 - DNA, 601 bp, Human
ctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctytaaaaacattacaagttagttcatgtcatgccagatagctgaaggcagctcacaagttcttaaggccaggaatgccatgtgtctgctatgcacagctggccctggccctgagcctgaatgacagcaaaggtgacgcagatgtgggtgccctgctcctgcccagcagcagtgcttggtggaggctgaggccctgcacaggcaccctcactgctgaccttgagcctctctctcctctagagtggaaaagacaaggatgccgtggataaattgctcaaggacctggacgccaatggagatgcc

SEQ ID NO: 166473 - DNA, 601 bp, Human; identical to SEQ ID NO: 20386

SEQ ID NO: 166474 - DNA, 601 bp, Human; identical to SEQ ID NO: 20387

SEQ ID NO: 166475 - DNA, 601 bp, Human; identical to SEQ ID NO: 20388

SEQ ID NO: 166476 - DNA, 601 bp, Human; identical to SEQ ID NO: 20389

SEQ ID NO: 166477 - DNA, 601 bp, Human
ttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaagtaagttgtcttcttttcctcctccatttctcccccagctcgcgggttctggagggcargatgacaccctcaggtgtccatcacctgggcagcaggctttcacagggaacctgctagactgggagccaggggggataaggaaaagcttagggcaggtccaagtttaggaaattggagatctccgtggctgcaggctgccctgtgcgttgggagcccagccataaacaccttcacttctggcactagaccagggctacctgggggtgccccagatctcccagcagtggtttgagaggcaacagtggccaggagtgggtggggtgtggaggacatttttcacctggtaggactcttccttc

SEQ ID NO: 166478 - DNA, 601 bp, Human
ttgtcctctggctttaaatccagggtctttccactaacaaaagctaattctgaaagctgctcttgtctttccacatccctgcttttcctcaaagccaggtgtaaattgcatcatctggctgaatgaggcgctcaggcttcctggaatctgaggaacgaacagggcagagcaaatgatgtgggagttagaggcccatggttggactctggcataaagagtttggtcagcttggctggtattttaaactatctatggaccccacctgagatggcaccattctgcctagaggcataaggccttyagtgggaggcctggggcacagcgtatgtgcttcttggaagagcagcagcagggccaccattgaaagacaggaaacaacacatagagaaattgctggctcaggaggctgaggtaaggggattacttgagcccaggagttcaagaccaactggggcaacatagcaagaccccatctcaaaaaaaaaagaaataaaaaagaaaaagaaaggatagaaaatttgcctatacattccacaaagcacaaggattgtccccagaacaacgttctagacctactacctagctctccaacagaaaggga

SEQ ID NO: 166479 - DNA, 601 bp, Human
agcccaggagttcaagaccaactggggcaacatagcaagaccccatctcaaaaaaaaaagaaataaaaaagaaaaagaaaggatagaaaatttgcctatacattccacaaagcacaaggattgtccccagaacaacgttctagacctactacctagctctccaacagaaagggaaccagccactcaggcatggctgttttctggcctctccaaaagctgctataaactgccggcattactcacaggcagcattttttaagtagcctgcctgtgctctatccagtgagcagttcagctaaasgaggagccaagggtgaggggggggtcaaagcgaacctgggccacattcactctgcccagggctgtccccaaagcttagctgtcttctctgggatgaagtcagatcttagtggggttccccaccatggcttccctggagtctgctggcaagtcctgagcagtgcagagctctttgtctgtgggtccagcagagacacgtgtgtggccctgtcacagcagtactcagcctcgctgtccctggtgccaagcaaaatccctttggggctttctgcaagcacctgactgggtttcttgtccagga

SEQ ID NO: 166480 - DNA, 601 bp, Human
caactggggcaacatagcaagaccccatctcaaaaaaaaaagaaataaaaaagaaaaagaaaggatagaaaatttgcctatacattccacaaagcacaaggattgtccccagaacaacgttctagacctactacctagctctccaacagaaagggaaccagccactcaggcatggctgttttctggcctctccaaaagctgctataaactgccggcattactcacaggcagcattttttaagtagcctgcctgtgctctatccagtgagcagttcagctaaaggaggagccaagggtgagsggggggtcaaagcgaacctgggccacattcactctgcccagggctgtccccaaagcttagctgtcttctctgggatgaagtcagatcttagtggggttccccaccatggcttccctggagtctgctggcaagtcctgagcagtgcagagctctttgtctgtgggtccagcagagacacgtgtgtggccctgtcacagcagtactcagcctcgctgtccctggtgccaagcaaaatccctttggggctttctgcaagcacctgactgggtttcttgtccaggaatttgggagactctgaag

SEQ ID NO: 166481 - DNA, 601 bp, Human
aatttgggagactctgaaggctgctctagtcatccgtgatgaagtaaacccccaaggagggaagaaacgactagaatgcccattctctggtttccatttccccttcaaatgacctgattcttcctgcctgcggtgggcgaagccacaaacaggtgtcctgtgctttcatgtacttgaaaactgcatccacttctgcattgtttttttttttttcttgttcaacaaccattcatttggtcacctatcatgtgccagcaatcattaatttttgaaaaccttggaatgtgatcgttggggcagygttatgctttttgtttaggagaatgttagcaaacactcacattttctgagccaatactgattgactatttaggctggaggtggaaggatggtggagagaaggcaggggtcagggaatccataggtagttcaaaggggccatttttggatgaaaatgttcactgtgtatgagctatagacaggtcattgagggctggcagtgtttccaagtgcggatctgtcatcagataactgttaagatagtcgtcagccacgaaggaatctttctgtgttttgtttttattttctaaagaaaaaaaca

SEQ ID NO: 166482 - DNA, 601 bp, Human
tctctcagcggtaatattttgcaaaactgtagtacactatcaaaacgaatacatagccaataagaaaacaacatttccatcaccaggaggacctcttatgtggccctattatagccacacccacttccatcccaccccaccctctccttaacctctggcaaccactggtctgtgtttgtcatctcaagaatgttatgtaagtagaattatacagtatgtaatcttttgggattggcttttttcactcaacaaaattctctggggattcatttaggagtgtgcatgtgtgcttgttgggggtgtgtgtgtgtgtgtgtgtgtgtggtttttttattgctgagtagcgggaatgtaccacagtgggaatcgtccatagtgggaaggtaccattgcttgtttaaccattcacttactgaatgacatctgggatgttttcactttgggactattatgaataaagttgctataagcatttgtgtactggttcttgtgtgaacataggtatacaggttttcatgtctctgggataaatgcccagaagtgtaattgatgggtcatctggtagttgtatgtttagttttttttattttttttcgaagaa

SEQ ID NO: 166483 - DNA, 601 bp, Human
ctgtccagctgttttccattgtgactatgccactttacactcccaccaacactgtatcagtgatccagtttctctgcatctttgccaacatttgttattgtcactatttcttattttagccattctagtgctatcttattgggtttcattttgcatttccctgattactaataccgtttaccactttttttttttttttttttttttgagacagagtcttactctgtcactcaggctggagtgcagtggtgcaatctcggctcactgcaacctccgcctcctgagttcaagtgattctccrgcctcagcctcccaagtaactgggactacaggtgcgtgccaccatgcctggctaatttttgtatttttagtagagacaaggtttcaccatgtttgccaggctggtctcgaactcctgacttcaggtgatctgcccacctcggcctcccaaaatgctgggattacaagcatgagccaccacgcctggcctgttgaccatctttttatatgcttatttgccccccatatatcctccttagcaaaatgtcttctcatgtcttttgcccattttctaatttgattggcttttgttgttgtttct

SEQ ID NO: 166484 - DNA, 601 bp, Human
acactcccaccaacactgtatcagtgatccagtttctctgcatctttgccaacatttgttattgtcactatttcttattttagccattctagtgctatcttattgggtttcattttgcatttccctgattactaataccgtttaccactttttttttttttttttttttttgagacagagtcttactctgtcactcaggctggagtgcagtggtgcaatctcggctcactgcaacctccgcctcctgagttcaagtgattctccggcctcagcctcccaagtaactgggactacaggtgcrtgccaccatgcctggctaatttttgtatttttagtagagacaaggtttcaccatgtttgccaggctggtctcgaactcctgacttcaggtgatctgcccacctcggcctcccaaaatgctgggattacaagcatgagccaccacgcctggcctgttgaccatctttttatatgcttatttgccccccatatatcctccttagcaaaatgtcttctcatgtcttttgcccattttctaatttgattggcttttgttgttgtttctgttgagttttgagaatttttaagtatatattttaga

SEQ ID NO: 166485 - DNA, 601 bp, Human
gcgcaatctcggctcactgccaacctctgctgtctgcgattctcataccttagcctcccgaatagctgggactacaggaactcaccaccacgcccagctcattttttttgtatttttagtagagatggagtttcaccatgttcgctacgctgttctcgaactcctgaccccaggtaatccgcctgccttggcctcccacagttctgggattacaggcgtgagccgccgtgcctggcctttcctatttctttcactttgtttttctcttattctcaatggatttttctgtttcatttcttaycccatgatatttgtctatctcctctttcttgaatcatttaagcattccatttttgtggagttgctcagacactgagtgtgagtcaagggccactcagcctgggttcaactccagatcaaccacttactagatttggggcagttgactcaccctcctgcacctcagttttctcatctataaaatggggagaacagtatctacctggtaccttttctgaaatgattaaatgagtttatacatgtaaagcatttggaataaaattgggtatacggtacagccccagtaggtgacgataattac

SEQ ID NO: 166486 - DNA, 601 bp, Human
aaagatccttacatgaaacaccatttaatccttctctctctgcctttttgtgtttatggtgacctctcagtattttggtttctttaatgacaaagtaaccatggaattagtccacagcatttctagggtacgtgtttctctccagatatcaaaaaataatgcatgaggttttattacttccttaggcttgtggtggggaatcctccaaggatggagttaaaatgaacagccaatactctctcgctcctctgggctacccgaggctctgcaggccccaaactcaccttctgttgccccattyggcaccagccacccccctttgttgtgcagccagaagccagggccgcctggcaggcctattgctaaatctcccagtgtttgtattacataaaacttcacagtcggtgtttctgtgtctacaatgccagaatcctggaaatgagttaacccaaatttgtgtgccttctggcaagcccaactatccaactacaaaaggggactaatgtgataggattctcctgagccaacacaggagttgaaagagcccaacagaggtgcaaactgccattatgattccatgataataattccacatactagg

SEQ ID NO: 166487 - DNA, 601 bp, Human
aagatccttacatgaaacaccatttaatccttctctctctgcctttttgtgtttatggtgacctctcagtattttggtttctttaatgacaaagtaaccatggaattagtccacagcatttctagggtacgtgtttctctccagatatcaaaaaataatgcatgaggttttattacttccttaggcttgtggtggggaatcctccaaggatggagttaaaatgaacagccaatactctctcgctcctctgggctacccgaggctctgcaggccccaaactcaccttctgttgccccattcrgcaccagccacccccctttgttgtgcagccagaagccagggccgcctggcaggcctattgctaaatctcccagtgtttgtattacataaaacttcacagtcggtgtttctgtgtctacaatgccagaatcctggaaatgagttaacccaaatttgtgtgccttctggcaagcccaactatccaactacaaaaggggactaatgtgataggattctcctgagccaacacaggagttgaaagagcccaacagaggtgcaaactgccattatgattccatgataataattccacatactagga

SEQ ID NO: 166488 - DNA, 601 bp, Human
agtaacatgtaatgtggagcataggatgtggccaggagagtcagggttatgattcagaaccaagatggctggactcaaatgggtgtgaagtaggagggtgggaaagcgtgggttctgaagtcaggccgctgtcagttcaaacccaggttctgctgcttgcaagccatgtggtctctggcaagttccctccctgctctgaatctcagtctcctgatctgaataatggacacattacacttattccacagtgttgctgagctgatcaagtgtgttaacacgtgtaaggcacccagtccagagyagtgcacgcaaacacacacacacacacttcacttccagagctgttctgcaaagaaaaaccaaaaggcagtacaagctgctgcaggcaatgaattgatgacgtgtttaaaacaaaagcaaaaagagtgcaaaggccatggagaatgcggcacagacaggaaagatgctccctaaagagcttgcccaggtcaggatgtctccgagcaaaacgagggacactgagtgactctgggagcaacctcagtcctgcatcctcgtcaacaccctgactgttctcaacaataatcccacccatgtgggg

SEQ ID NO: 166489 - DNA, 601 bp, Human
acgtgtttaaaacaaaagcaaaaagagtgcaaaggccatggagaatgcggcacagacaggaaagatgctccctaaagagcttgcccaggtcaggatgtctccgagcaaaacgagggacactgagtgactctgggagcaacctcagtcctgcatcctcgtcaacaccctgactgttctcaacaataatcccacccatgtggggagctcccctttgagggactgaggcagcccagaaaggaggcacaggatgtactgagaaggggaaacctgggcgtcagtgacagctccccagggatggtgkgtctgagcaacgctgatgcagcggagcccctcacccacctgagatgcctcgtccgccttcccagcagctcccttccgcagagtgcttaacagcttggcaatcagagaacgctgtgtgcacggacagctccgcggggatgaagtgtcccatctgacaaagactgttctgagatccgcgctgtccctgcctggctctgcgtttcactgaaagccccttgccctgattctagccctcagcccccacgcacagccaccggcgactctagccaccctggatagtaaaggtgccctttctggggca

SEQ ID NO: 166490 - DNA, 601 bp, Human
cctgggcataaaaatcagcacctggggcctcattccactcatctcgcacacctctgcagtcccttccacgatgccctcaccgctggtaatcagcatccattacatcggcgccaggaaccagctcaggaggccacctgatccgccctcctgtccctccagccctcctctggaaggactcagcgcttgcagtcagacatctctccccattgagaccatttttactgttggtgaactggaggactatcgcactgcccaagacactgttctctgcagcaggtttgcacagggtgccagttagggmggagaaggcagcgaggaaccccgcactttaaggaacagggatgtcatagcagccgtctgcatgggggagggggctggggagcacagggctattggcaaggagacagggctagttaggaccaccggaaccaggctgatgggcactgagggggtagcccaggcggccctctctactatcatgggccttgcagattgagttctcctcttcctgccgggccgcctgcctttgttgtcctgaggactgacaggtaatgtttgtggcagacctgttggtgcaaacagggaggctgtgagaggaatt

SEQ ID NO: 166491 - DNA, 601 bp, Human
gccaggaaccagctcaggaggccacctgatccgccctcctgtccctccagccctcctctggaaggactcagcgcttgcagtcagacatctctccccattgagaccatttttactgttggtgaactggaggactatcgcactgcccaagacactgttctctgcagcaggtttgcacagggtgccagttagggaggagaaggcagcgaggaaccccgcactttaaggaacagggatgtcatagcagccgtctgcatgggggagggggctggggagcacagggctattggcaaggagacagggytagttaggaccaccggaaccaggctgatgggcactgagggggtagcccaggcggccctctctactatcatgggccttgcagattgagttctcctcttcctgccgggccgcctgcctttgttgtcctgaggactgacaggtaatgtttgtggcagacctgttggtgcaaacagggaggctgtgagaggaattcagtggcactaccacaactcttaacagcactctcagcctaactcacaacgcagcccaacatgtccatgggcagaaaaggcctctctccgactccctagcccagaaatac

SEQ ID NO: 166492 - DNA, 601 bp, Human
ccacaactcttaacagcactctcagcctaactcacaacgcagcccaacatgtccatgggcagaaaaggcctctctccgactccctagcccagaaatacgaaccggcagctgacagactgaatctgactcacacatagattctctatggcttgctcactttttcaaaaattgttgaattagtggtcaacatggaaaaaaaatttcatcttcaaaagtttaatttctggcttttctggaaaaagcaaagggaggatcttgcagtactggctccacggcatggcaaggcaataatgaactagasccgagtagcagctgccgctttagaactgcgtgtgtgtacagctcaccacagtccccaccaccccctaccatgtcccccaaacccagggcaagttttggttgcatttatcatgggtttgtatatgtgcttttcctaaaataaagagaatgcaacattttaaatgtttctctacatcaaaatatgaaaatgaagctctaagacatcccatttaaataaaaataggagaaagcctactaattgcacgtgaccaagaaggatgtagagtgtgtctgtgttggaagaacgcgatccggcagctgc

SEQ ID NO: 166493 - DNA, 601 bp, Human
ccaagcagaccttcagagagtgacggggcactcttggtgatgatgccagaatgacaggtgttacctgggatgcatggacatcttatttcctgggagcaatcagggacctctgggggcaagtattgtgcttagaaacaccgaggagcagctgttagatgagtagggagcatgctggaggggagcaggagggagagggagaacacagccctggctggcgggaagtgacccgagctgccgggcagcttgtgcacagcggaccacatggcaggaaatcatgagttccttccctggtgctcccccsggggctcagaacaaccccatcacacccagagggctcaggaggaaccaacctcccaggcagcggtggctgcacttagagcctttggaatcagacaaaacctagcccgctgcttagtaactgtgtggcctgaagcaagctaccacatcactctgcttttgtgacctgtaaaatgaggcgactaaaacggacttaatagatctgtttcaggattaaatgatacaatgcatgaaaaacactcagcacaaagatggcacagaacagggattccatgctggagctattattactgtttgctcccct

SEQ ID NO: 166494 - DNA, 601 bp, Human
gcagaccttcagagagtgacggggcactcttggtgatgatgccagaatgacaggtgttacctgggatgcatggacatcttatttcctgggagcaatcagggacctctgggggcaagtattgtgcttagaaacaccgaggagcagctgttagatgagtagggagcatgctggaggggagcaggagggagagggagaacacagccctggctggcgggaagtgacccgagctgccgggcagcttgtgcacagcggaccacatggcaggaaatcatgagttccttccctggtgctccccccgggrctcagaacaaccccatcacacccagagggctcaggaggaaccaacctcccaggcagcggtggctgcacttagagcctttggaatcagacaaaacctagcccgctgcttagtaactgtgtggcctgaagcaagctaccacatcactctgcttttgtgacctgtaaaatgaggcgactaaaacggacttaatagatctgtttcaggattaaatgatacaatgcatgaaaaacactcagcacaaagatggcacagaacagggattccatgctggagctattattactgtttgctcccctgttc

SEQ ID NO: 166495 - DNA, 601 bp, Human
accacatcactctgcttttgtgacctgtaaaatgaggcgactaaaacggacttaatagatctgtttcaggattaaatgatacaatgcatgaaaaacactcagcacaaagatggcacagaacagggattccatgctggagctattattactgtttgctcccctgttctcaggcccacaaggctctgccacctcaccctgctcactggacgccttcctcaccagggccttcctgactcttcctcgcccaccccagacaagccaaattcaggactgcaccctggcctctctctcactctctackgcactgatttttttgcctgtgtactccccaccagaccaggaactccttgcggacagagaacgcatcaagggtcgtcaatctcattacctgttggagtcacctggggccagattctgggactaggcatcagcacgttgtccagctcccagctgatggcagcgtgcgtccagggcggagaggtcgtgctactcaggtgtgcactgaggaccagccgcgtcaacatcactgcggcttcttagcaaaaccgcggactctggaaaccccagacctacagaatcagaacccgcattttagccagat

SEQ ID NO: 166496 - DNA, 601 bp, Human
actctgcttttgtgacctgtaaaatgaggcgactaaaacggacttaatagatctgtttcaggattaaatgatacaatgcatgaaaaacactcagcacaaagatggcacagaacagggattccatgctggagctattattactgtttgctcccctgttctcaggcccacaaggctctgccacctcaccctgctcactggacgccttcctcaccagggccttcctgactcttcctcgcccaccccagacaagccaaattcaggactgcaccctggcctctctctcactctctacggcactgatttttttgcctgtgtactccccaccagaccaggaactccttgcggacagagaacgcatcaagggtcgtcaatctcattacctgttggagtcacctggggccagattctgggactaggcatcagcacgttgtccagctcccagctgatggcagcgtgcgtccagggcggagaggtcgtgctactcaggtgtgcactgaggaccagccgcgtcaacatcactgcggcttcttagcaaaaccgcggactctggaaaccccagacctacagaatcagaacccgcattttagccagatccccagga

SEQ ID NO: 166497 - DNA, 601 bp, Human
cgatccggccaagagatggcggggtggcgggaggggcgctctggcgaccccggaagcgagaagcaggcctctgcagggccagggatgaaggtgcaagggaaagccctgggacctggaccttaggcgtgggagggacgaaagggaaaggtcttagaaaattcctcaggcgtggcttctgggggggcggggcggggggaggaaaggggcacgggttcccggtctcgtagacgctgcagcggagcagagcctctaggcatgccctcatctagagcagctgctgcggaatccggggagcctgcascactagccgtgcgattccgggcgaggtttttaaactctcacctgttttccccttttgtaaactgaagataatgcctctctcccgggagtgggagcacgatgctgacacaccgtaggaactcgggacttgctgattctccttccttatcctcaaggcgtttgaagcactcctgcccctcacccccacccctccagcccctttcccagccctgccccctggtggaaaatcctaagagctacctctcaggagggctcctgtaaaccaggcactgtacacacacctttcatttcatcttcgcag

SEQ ID NO: 166498 - DNA, 601 bp, Human
atttcatcttcgcagcagctctttttggtgagtactgttatccccattttgcaaataaagcaacggaagcttagagaagtaacttttccaaatgtgcctcagctccaggcaaaataggaacctaggtcatctgatgccagagtcagccttcctaactgtttatgatccgacttccctttctgtactggattttctatttctgccataacagatgaccacagacatagtggctggaaacagcacccacttatcagctcacagttctgtaggtcagaagtccaggcttgatgcgactgtgtcytctgctctgttcccacaaggccaaaaccagggtgtcagcgaggccagcattctcatgtggaactcagggcccccttcaagctcctgtggttctggcagaattcaggtctttgtggttgtaggactgaggtcctcacttttttgctggctatcatctgggggctgctctcagctcccagaggtcacccacattccttgccgtgtggccccctccatctttaaaaccagcaaaggagaagccccctctgtctaattcctctaataatttgaatctcttacttcgggaaaagcccaatccctt

SEQ ID NO: 166499 - DNA, 601 bp, Human
tccatctttaaaaccagcaaaggagaagccccctctgtctaattcctctaataatttgaatctcttacttcgggaaaagcccaatcccttcaaagggcttgtgattgggtcaagctcaccccagatgaactttctttcttcagttcagctctgccatatgacatgccccagtcatgggagtgaggatttcctggggttcctcagggggtgtataccagggggcaggaatcacgagggtgtgttggaattctgcctacttacaagtgccttctctgtccccagcatgtattctggtgttacmttcaagtgtaacacctcgaatgcttcctgctaaccctaaagggccttgaggggactggggcagcctgttcaccaaccagtttggagcattttcctatgagtacagtcatatatattcccacagaagagtatacaaatatctccatatgagacataagcacgccctcctccattcctcttcctccaacttcatcccgtgtttcaaagctcagagagtggtacattttgatccagcatatcttagaaagtaggaaattgataaagatgcttgtgatcacagatagggagactgagtctgtga

SEQ ID NO: 166500 - DNA, 601 bp, Human
tgctaaaagacctcaagataaatagagacagcaaggaatgaaagaaacagcacaggcttgggccagatgagcaggaatccaaaaatcagctctgcctgatatttggtggcctgggtgtcacttaacctctttggaagcctgtttttttatttatccatccaattactcagtaagtactttttgaatacatccatgtgccgggctgtgttctaagtgcttggaataccagagaacaaaatgaacacaaacttatgcccctgtggagcttacattctgatggtgggagagagactgtttgaawtaagcctgattcataagcaaacaatatagtatttatatagtggggattccaatatctaatgccagtgaattgctgtggcgataagaagccacaatccacatgtaatgcgtgggacacagtaggtatttaataaactattgtgattattctttttaaattgctcccaggtttctcaaaccctttcaacacttaatgtgtagtttgcacctagatattgttcatttattcattcaacaaacagctagcaagcatctattttgtgctagactctgtactaggcaccagggatacaaaagaacc

SEQ ID NO: 166501 - DNA, 601 bp, Human; identical to SEQ ID NO: 20390

SEQ ID NO: 166502 - DNA, 601 bp, Human; identical to SEQ ID NO: 20391

SEQ ID NO: 166503 - DNA, 601 bp, Human
gccccacaagatcaaccccctcccaccacagcaggagtggatcaatcagccagtgagggtcaacgtcaagcgggagtatgaccacatgaatggatccaggtaagctcaccaggcctgtgcaggattgggggaaggcacaaagtcgccagatctgcagcaagtggcttctggcacttaaggtttttgcagcagatggggctctagagctgggccaggaagcctgtgtcagtccctagagagctaaggcagagagggccacagactgatgatggggtggagtagggctaggaagcccccctgrctctctggggcccacgaagccctcagaggccaggtaggagtcaggccccaagcgcctatgcagacactcgtggaacacttatttcttgttaatcccaggcccaggtccagtcctgttggggacagcttagcaataagctactcttccctgtcctgttgaagatacttaacccctctgggcaggtctcagcagagcaaaggtgaccaaaccattctttagtaagagtggagaagggatgaggaaggtgtctaccttcctgtgggggctcactgtgtctgggagggggcaggcacctggaag

SEQ ID NO: 166504 - DNA, 601 bp, Human
ttctttagtaagagtggagaagggatgaggaaggtgtctaccttcctgtgggggctcactgtgtctgggagggggcaggcacctggaaggcgtgcatgaagtgggtacaatactgggtcagttcgggctttgcttgtagaaatggagacaggagggtccagggagagaaaatcacagggtcatggaagaggacagtggacaggcggcctcagttttgcgtcctgcctctgccccttgggcaagtcatcgaaacccctcagagcaccagctttctcccttctcaaacaggactgggatattyacttccttatggtccttactctagcgttactctgatgcctcagggaaaggacctgggatggtgcctgagacgcgttaggaaagtgctctatagtgacagtgattgttatgagcaaagacttgaaagacagagaacatcagtcttattcacaaaatatcagataatctactgggccaaaggcacaaagagatgaaaataaaaagcaacagagggccctgaatggcaggctgaaaacatgtgccatttattccacagccagaggctgactttgagcaccgatgtgacatttaacccagaggc

SEQ ID NO: 166505 - DNA, 601 bp, Human
tcacaaaatatcagataatctactgggccaaaggcacaaagagatgaaaataaaaagcaacagagggccctgaatggcaggctgaaaacatgtgccatttattccacagccagaggctgactttgagcaccgatgtgacatttaacccagaggctgactttgagcacagacgtgacatttaacctcatcagagcagtgacttaagactagcgagctgacagtccttgcgcacagacggtaggatgggagagtcagaaagacaagtgaagaagttagtaaaatatcccagataggaaataakgaagttctgaactaagtgatgatagtgattttggaaagtgaaaaggacagatacataagggcgatagcaaagagatgattaacagggcttaggtgagtaaagtgtgaatgaagggggtgcatgacaggaaagaatcaaaggcgactaaagcctgcacattttaaaggctggtgctgtgagcagccgcagaaaggtggcacaggaaatgctttaggatgggatgtcagtgttctctttgagattccttgtgagcaatgggtagaacatccagataaaaatgtctactaggctttgggaact

SEQ ID NO: 166506 - DNA, 601 bp, Human
tatcagataatctactgggccaaaggcacaaagagatgaaaataaaaagcaacagagggccctgaatggcaggctgaaaacatgtgccatttattccacagccagaggctgactttgagcaccgatgtgacatttaacccagaggctgactttgagcacagacgtgacatttaacctcatcagagcagtgacttaagactagcgagctgacagtccttgcgcacagacggtaggatgggagagtcagaaagacaagtgaagaagttagtaaaatatcccagataggaaataatgaagttckgaactaagtgatgatagtgattttggaaagtgaaaaggacagatacataagggcgatagcaaagagatgattaacagggcttaggtgagtaaagtgtgaatgaagggggtgcatgacaggaaagaatcaaaggcgactaaagcctgcacattttaaaggctggtgctgtgagcagccgcagaaaggtggcacaggaaatgctttaggatgggatgtcagtgttctctttgagattccttgtgagcaatgggtagaacatccagataaaaatgtctactaggctttgggaactgaagctca

SEQ ID NO: 166507 - DNA, 601 bp, Human
aatatcccagataggaaataatgaagttctgaactaagtgatgatagtgattttggaaagtgaaaaggacagatacataagggcgatagcaaagagatgattaacagggcttaggtgagtaaagtgtgaatgaagggggtgcatgacaggaaagaatcaaaggcgactaaagcctgcacattttaaaggctggtgctgtgagcagccgcagaaaggtggcacaggaaatgctttaggatgggatgtcagtgttctctttgagattccttgtgagcaatgggtagaacatccagataaaaaygtctactaggctttgggaactgaagctcagataatctttcaggcctggaatttacgtttgggcatcatctctaaggagtctgaactgtgaaagtggatgaggtcaccgaggaaactagtctagattgaagagagagaagggaatgagcatggttgggagggagaactcctccagagcagctcatggcctcagacctgcctgtgggaactcccaggcctaccacatttcaaccctactaaccaaaaccagtgactgggatctcagccacctttccagatcccaggatttcaggaaggctca

SEQ ID NO: 166508 - DNA, 601 bp, Human
cccaggcctaccacatttcaaccctactaaccaaaaccagtgactgggatctcagccacctttccagatcccaggatttcaggaaggctcagaggttctgagcctgcagcccctcagatgaatctctctccagatgtaattctgatggtgccggagctcctaacagtcgaaggacatggtgtgttgaacgttttcccatattatcttaccacttgttcctcaccactatactaagaagtagttactgtaacttcactgttacacaggaaggcaagcagggctttcaggggacagtgctttktctaaggatttaaaggaggcaaagttggagcccgaacccaggcgtttggttccagccccacgtgccatctgttaggcacctttctgctccctctgcttgtgtgtcatgcttttgcaccaccacctcattcctgccaatgcccacctggtgaggaggcctattctacgatgcctcctaaatggggcccttctccaaggagctcccaatgcttgttgaagatccagatcccactggtggagattccttttttttttttttttttttttgagatggagtctcactctgttgcccaggctggag

SEQ ID NO: 166509 - DNA, 601 bp, Human
tcttcaatggcttatgacaaaatgcaaagcccttagtgtggccccaccatccctctgacatcctctctactgccccctccctcccacttcttccctccgcgccagcctcataagactctagctgctgctcctagacccccaggcaccctcgtgcctcagaatctcttcccctgagctccttcattctggaacattcctactccatctagtcatatgactctctccctcacgagttttgggtttctctacctgaacctcaccttttcagaggcctcccctggccacctgatcgaaaccagcrcctcctcactctttaccctgcttagagtgtctgtcctagttcttatcacctccctcactgacacgtgggcagggcctgaaacggtaggtgctcaataaattgtcgtcaaataaataactgagaacacatggctgagcagactcaaaagagaaggtgcttgtttaaagttaggacgcagatccaggtctgctgactcagccccttcaatgctgagcctgagttgatgcatgggcttctgagttccatcttcatgctcaatggagacccatgggtatttgtgtctctggtgggaaggaagta

SEQ ID NO: 166510 - DNA, 601 bp, Human
gtgtgaatattccagtgaacagacaggatatttacctggctttggctacacagagcagcaacctctgcttttgagttgcttgtcttgacccataccatcagcgggtaacaaagtaggttcagaaagactgatatcttctcacccaccctgggcaagcagagacaatcctgtggactctcagagccaagcagcttaggcacagctatcgccagcaccccacaaatattccctaagggctcacatgtaagctggactagtggctagcaggaagcaaggagttttagaaaaatgtcattgcttrcagtggaaccatgtcagaccctatcatttaattatgccaaaagcaatgacagaatgaaataaatgccaggctctttaaatctctcatcctgaacactgtgcttctcctatcctctgagtattattgataatgacagttcgttacttgcacatgatttgattgtttgcagtggtctaattcgccataacacaaaaagataggagaggatgttataatgattctgaacttcagatgagaaaaccaaggcagggtataaaatttgagactgcttggctcatgggctagacctgtgctgttcaa

SEQ ID NO: 166511 - DNA, 601 bp, Human
ggaagcaaggagttttagaaaaatgtcattgcttacagtggaaccatgtcagaccctatcatttaattatgccaaaagcaatgacagaatgaaataaatgccaggctctttaaatctctcatcctgaacactgtgcttctcctatcctctgagtattattgataatgacagttcgttacttgcacatgatttgattgtttgcagtggtctaattcgccataacacaaaaagataggagaggatgttataatgattctgaacttcagatgagaaaaccaaggcagggtataaaatttgagaytgcttggctcatgggctagacctgtgctgttcaatgcagcagccactagccacaggttgctactgagcacttgaaatacggttagttgaaaattgaaatgtgctctaaatataaaccacatactggatttagaagacttactatggaaaaagtgtaaaatatctcattgattatttattatgctgaaatgatcttcttttggctatattgagttaacatattaatatactttaatatattattaaaattcatttcatcgttttgttttcttttaaaaatctggctactagtaaatttaaa

SEQ ID NO: 166512 - DNA, 601 bp, Human
agactgcttggctcatgggctagacctgtgctgttcaatgcagcagccactagccacaggttgctactgagcacttgaaatacggttagttgaaaattgaaatgtgctctaaatataaaccacatactggatttagaagacttactatggaaaaagtgtaaaatatctcattgattatttattatgctgaaatgatcttcttttggctatattgagttaacatattaatatactttaatatattattaaaattcatttcatcgttttgttttcttttaaaaatctggctactagtaaattyaaaattatgtagctcggccaggtgtggtggctcatgcctgtaatcccagcactttgggaggccaaggcggcggatcacctgaggtcgggagttcgagaccagcctggccaacatggtgaaaccctgtctctgctgaaaatacaaaattagcctggcatggtggcgcatgcctgtaatcccacctactcaggaggctgaggcaggagaattgcttgaatctgggagacggaggttgctgtgagccgagatcatgccactggactccggtctgggcaacaaaagtgaaacaccatctcaaaa

SEQ ID NO: 166513 - DNA, 601 bp, Human
ttagaagacttactatggaaaaagtgtaaaatatctcattgattatttattatgctgaaatgatcttcttttggctatattgagttaacatattaatatactttaatatattattaaaattcatttcatcgttttgttttcttttaaaaatctggctactagtaaatttaaaattatgtagctcggccaggtgtggtggctcatgcctgtaatcccagcactttgggaggccaaggcggcggatcacctgaggtcgggagttcgagaccagcctggccaacatggtgaaaccctgtctctrctgaaaatacaaaattagcctggcatggtggcgcatgcctgtaatcccacctactcaggaggctgaggcaggagaattgcttgaatctgggagacggaggttgctgtgagccgagatcatgccactggactccggtctgggcaacaaaagtgaaacaccatctcaaaaaaaaaaaaaattatgtagttcgcacatgtggttcccattctacttctattggacagtgctgggccatggtggtctggactgttctgtgattcacagtgcattttttctgcattccttgacagcatgggcttc

SEQ ID NO: 166514 - DNA, 601 bp, Human
tagctcggccaggtgtggtggctcatgcctgtaatcccagcactttgggaggccaaggcggcggatcacctgaggtcgggagttcgagaccagcctggccaacatggtgaaaccctgtctctgctgaaaatacaaaattagcctggcatggtggcgcatgcctgtaatcccacctactcaggaggctgaggcaggagaattgcttgaatctgggagacggaggttgctgtgagccgagatcatgccactggactccggtctgggcaacaaaagtgaaacaccatctcaaaaaaaaaaaaaattatgtagttcgcacatgtggttcccattctacttctattggacagtgctgggccatggtggtctggactgttctgtgattcacagtgcattttttctgcattccttgacagcatgggcttctgagttatgtcttcatgctcactggagacccattggcatttgtgtctctggtgggaaggaggtgtgcggtgcacctgaagctaccatgcccacttgcttttcaccccagtagcaaaccctctggcccaggggcaaagggtcaagtgcagagactgaggtctgaggatctcagagacag

SEQ ID NO: 166515 - DNA, 601 bp, Human
cctgaggtcgggagttcgagaccagcctggccaacatggtgaaaccctgtctctgctgaaaatacaaaattagcctggcatggtggcgcatgcctgtaatcccacctactcaggaggctgaggcaggagaattgcttgaatctgggagacggaggttgctgtgagccgagatcatgccactggactccggtctgggcaacaaaagtgaaacaccatctcaaaaaaaaaaaaaattatgtagttcgcacatgtggttcccattctacttctattggacagtgctgggccatggtggtctggrctgttctgtgattcacagtgcattttttctgcattccttgacagcatgggcttctgagttatgtcttcatgctcactggagacccattggcatttgtgtctctggtgggaaggaggtgtgcggtgcacctgaagctaccatgcccacttgcttttcaccccagtagcaaaccctctggcccaggggcaaagggtcaagtgcagagactgaggtctgaggatctcagagacagagtggcttgcccatgttgagggagttttgtgctctctttcttcatatcttcctgttgtggttgactct

SEQ ID NO: 166516 - DNA, 601 bp, Human
gttcgagaccagcctggccaacatggtgaaaccctgtctctgctgaaaatacaaaattagcctggcatggtggcgcatgcctgtaatcccacctactcaggaggctgaggcaggagaattgcttgaatctgggagacggaggttgctgtgagccgagatcatgccactggactccggtctgggcaacaaaagtgaaacaccatctcaaaaaaaaaaaaaattatgtagttcgcacatgtggttcccattctacttctattggacagtgctgggccatggtggtctggactgttctgtgatycacagtgcattttttctgcattccttgacagcatgggcttctgagttatgtcttcatgctcactggagacccattggcatttgtgtctctggtgggaaggaggtgtgcggtgcacctgaagctaccatgcccacttgcttttcaccccagtagcaaaccctctggcccaggggcaaagggtcaagtgcagagactgaggtctgaggatctcagagacagagtggcttgcccatgttgagggagttttgtgctctctttcttcatatcttcctgttgtggttgactctgttaggctgggtt

SEQ ID NO: 166517 - DNA, 601 bp, Human
ctggagacccattggcatttgtgtctctggtgggaaggaggtgtgcggtgcacctgaagctaccatgcccacttgcttttcaccccagtagcaaaccctctggcccaggggcaaagggtcaagtgcagagactgaggtctgaggatctcagagacagagtggcttgcccatgttgagggagttttgtgctctctttcttcatatcttcctgttgtggttgactctgttaggctgggttgccttgaaacagcatggcccataggttctgtgtcgcatgtagacttcagcaacttgatccaarctgtggtctgcaaataactctcagctgcatcctgtctcaaccacagggataggggaaaacatcccatgaagaaaagaatatcaggttatagagggaaatgcaagacttgccttgtgagcctggtattcaggaccagagttcagagctaaccttccttgaaattccctggcctggcccccagggtctggatgccctggacacctagggactcacattccacacagagaaggatcagctcctgttccctggaacttgtgcctctctggctgcgaggcccctttctaaactcttgtgttctca

SEQ ID NO: 166518 - DNA, 601 bp, Human
aacgggaggagcccggggagtgtgccctcctgtcccaccatcctgccccctgctgtagttctcctttccgagagacccctgcccataccctatgccctcttgctctgggggtcctccaagggaagagcgtgcagtgtggagcccacctctcccacagaggccgcctgccaatgaaaaccttgctcacttggttgcaggccaacttaatccttcaaacttctgcagcacttggactgtttcacaactgacaaggatgcagggaaaggctgccagaccatgtgcgtgagtgtgtgtgtatgcrcgcgtgtgtgtaatgtgtatgcgtgtgtgtgcactgtgtttgcatgtgtgtgcatgtgttgaatgtgtgtgcagatgaagtgtacgtgcatgtgtgtgcatgttctctgtgttgaaatgtgtgcttccatgtgggtgaagtatgtgtgttccatgttggaatgtgtacagtgcgtgtctgtgcatgtgtgttgaagtgtgtccatgcatgggagtaagcatatgtgtgcacgtgttctctgttgaagtatgtgcatgcatgtgggtaaagtattgtgcacatgtgttctgtgttggagtg

SEQ ID NO: 166519 - DNA, 601 bp, Human
atgatctgctttctctcttgtgaatgtccatactgcttccacagtgagcttggggccagggatgcaaaatgccacagggccaccacctctccatcaggtggaagttcctggactccattccttctccaagtagcaaccagctcttttgcatgtgtgcttgatagtgaagcttaacacagaagacctgagtcctgtttccaccttgactagctgtgtgactgagccaggcagcccctgtctcgatttcattaaccatgaaaaggagatagtaacccttgctgtgcctatcctgggggcttaytgggaaattcaaatacaacagtgcataagaaatgcattaaacttatatatgtgcaatagaaataactcactgagaaagcatttgctgctcacctcctgtaagaatactagggttaaacaaagaaagtgatgactatcctctcaagaactcagcagtcagggggcgcaggccaagctgagaatcagacagtgtgacaagtccttataaccaaggcgggcaccaagtgctgggggactgtggggaaggcgtgtctgggagcatggactaggttgcctggcagtgaggctaaaaatgtaagct

SEQ ID NO: 166520 - DNA, 601 bp, Human
tctctcttgtgaatgtccatactgcttccacagtgagcttggggccagggatgcaaaatgccacagggccaccacctctccatcaggtggaagttcctggactccattccttctccaagtagcaaccagctcttttgcatgtgtgcttgatagtgaagcttaacacagaagacctgagtcctgtttccaccttgactagctgtgtgactgagccaggcagcccctgtctcgatttcattaaccatgaaaaggagatagtaacccttgctgtgcctatcctgggggcttattgggaaattcraatacaacagtgcataagaaatgcattaaacttatatatgtgcaatagaaataactcactgagaaagcatttgctgctcacctcctgtaagaatactagggttaaacaaagaaagtgatgactatcctctcaagaactcagcagtcagggggcgcaggccaagctgagaatcagacagtgtgacaagtccttataaccaaggcgggcaccaagtgctgggggactgtggggaaggcgtgtctgggagcatggactaggttgcctggcagtgaggctaaaaatgtaagctgcagtcagaca

SEQ ID NO: 166521 - DNA, 601 bp, Human
gcataagaaatgcattaaacttatatatgtgcaatagaaataactcactgagaaagcatttgctgctcacctcctgtaagaatactagggttaaacaaagaaagtgatgactatcctctcaagaactcagcagtcagggggcgcaggccaagctgagaatcagacagtgtgacaagtccttataaccaaggcgggcaccaagtgctgggggactgtggggaaggcgtgtctgggagcatggactaggttgcctggcagtgaggctaaaaatgtaagctgcagtcagacagggagggctgcratgccacacaaagaagctcagaccttggtctgagggcactgaggcgctgccagcagtttttacgtactgtaattataggattgggctgggatttgaagaaaactctggtggcagcatggaggatagaaagagggcatcatcatcatcatgacaccaagtgtggccgggcaatggctccatgctcatcatcggagccctgggctcatgattcagaggctgaggcaagctgccctgtcagtgctgaccgcctctgggctttgtctcttctcactttagggagtctccggtggactgcagcgt

SEQ ID NO: 166522 - DNA, 601 bp, Human
ccaacatgaccaccaacgagaggagagtcatcgtccccgcaggtaattcgagaaccaggctgcctgggcgccattcacttccccactctctggggggcagggagcatctaaacctttatctgatactctattccctgtggaattgcaaaatggagaaagctgcacgccagccgggagtggtggctcgcgcctgtaatcccagcactttgagaggccaagacgggtgaatcacttgtcaggagttcaagaccagcctagccaacgtggtgaaacctcatctctactaaaaaaaaaaaaaatwcaaaaattagccaggtgtggtagtggacgcttatattcccagctactcagggggctgaagcaggagactcgctttaaccgggaaggcggaggttgcagggagccaagatcacaccactgcactccagcctgggtgatggaatgagactctgtctcaaaaaaaaaaaaaaaaaaaaagctgcacattttacctgacttcctagctgccctttaaggcagtatcccagatgtcacctgatgtgtgggtgctagaagccccacccttaaacagaccacatcacagactctacatcaatggcct

SEQ ID NO: 166523 - DNA, 601 bp, Human
ttggtcccagaaaataaaatcatcgttcagtccttcagtccattggctggacactccaccccagctagcaccagcaagctcagctgcctgcacaagaagggtgtttacaaactgccacgtgtagaactggtgccaggtagaaggggcaaggatgtccaaatcttaagcaaagtgattacagggcagggattaaacctgatcttaccaaaataactttaccagagaggcaaaactccttccatttgtaaaagcataaatgtagttgcctctgaagtcaaaaggttagacatctctttgaggyagtccgaaggcatctgcttgtaggtctaaaggcagaaatgttaagggctgcctcctgccttggcccgtggtgtttgttttccctgggaagctgcatctcaccatatccctggattacagctgcctccctgtgctctgggccaaattcaagaaggtgtgagcaagagtgaggcagcagacgggtggggcttgtagaaatttctctgtaccctttaggacttagaaatgactcctaaagcaattctaagtttgctcttccacaagcatctgacctaacaaaggaagaggaagaatcacttcc

SEQ ID NO: 166524 - DNA, 601 bp, Human
attggctggacactccaccccagctagcaccagcaagctcagctgcctgcacaagaagggtgtttacaaactgccacgtgtagaactggtgccaggtagaaggggcaaggatgtccaaatcttaagcaaagtgattacagggcagggattaaacctgatcttaccaaaataactttaccagagaggcaaaactccttccatttgtaaaagcataaatgtagttgcctctgaagtcaaaaggttagacatctctttgaggcagtccgaaggcatctgcttgtaggtctaaaggcagaaatgktaagggctgcctcctgccttggcccgtggtgtttgttttccctgggaagctgcatctcaccatatccctggattacagctgcctccctgtgctctgggccaaattcaagaaggtgtgagcaagagtgaggcagcagacgggtggggcttgtagaaatttctctgtaccctttaggacttagaaatgactcctaaagcaattctaagtttgctcttccacaagcatctgacctaacaaaggaagaggaagaatcacttccatttattgagtgctttctaggtgccaggcaccacgtaaatt

SEQ ID NO: 166525 - DNA, 601 bp, Human
atttctctgtaccctttaggacttagaaatgactcctaaagcaattctaagtttgctcttccacaagcatctgacctaacaaaggaagaggaagaatcacttccatttattgagtgctttctaggtgccaggcaccacgtaaattgctttatctccatggcattacttaaaacacctgtcacaggagaccagctagtaatgtttagcccaggtgtatcgtctccctcctcactgaaagcagacaatgaaactgtattagaactgacaggtgggaatctctttgtacagcccaaagcaaagytgagcctcactgggtcttcactcaaatggtttcaaactcccctgcttcagtcaaacagctcccagcctgggagggaaagcttgcgggactgaagggtttggggatctgagattgtctttgaaccaacctttggcaccatctcattttggtcgtcattttggggaaggaatcttggaaatgggcagaagtggccagactgctatgtcgaccctccaaactttctttgatcagtgttgaaatgctttcaaaaggaatagcaaaacatcaggcttggctgagccaagttacctatagcgctgg

SEQ ID NO: 166526 - DNA, 601 bp, Human
aagaggaagaatcacttccatttattgagtgctttctaggtgccaggcaccacgtaaattgctttatctccatggcattacttaaaacacctgtcacaggagaccagctagtaatgtttagcccaggtgtatcgtctccctcctcactgaaagcagacaatgaaactgtattagaactgacaggtgggaatctctttgtacagcccaaagcaaagctgagcctcactgggtcttcactcaaatggtttcaaactcccctgcttcagtcaaacagctcccagcctgggagggaaagcttgckggactgaagggtttggggatctgagattgtctttgaaccaacctttggcaccatctcattttggtcgtcattttggggaaggaatcttggaaatgggcagaagtggccagactgctatgtcgaccctccaaactttctttgatcagtgttgaaatgctttcaaaaggaatagcaaaacatcaggcttggctgagccaagttacctatagcgctggtggtgaaaataaaacaaattcatgtcaaatgattttcaaagcactttcaggctatggatttacttcattattttagctccggcta

SEQ ID NO: 166527 - DNA, 601 bp, Human
cattttggtcgtcattttggggaaggaatcttggaaatgggcagaagtggccagactgctatgtcgaccctccaaactttctttgatcagtgttgaaatgctttcaaaaggaatagcaaaacatcaggcttggctgagccaagttacctatagcgctggtggtgaaaataaaacaaattcatgtcaaatgattttcaaagcactttcaggctatggatttacttcattattttagctccggctagatcttttaggtcctcacacattttggcttcctccaggccaggctgtggatatgagrggaagtctcatttgggcaagtccacaaatcaaggcaataaaatattagtggaataaccgattgaatttatgatgggatttaaagacaagtataaatgtgggccctagttaatcactagctccatgttcagatgggaagaaactaggactaaatcatccaggaaatgcatttggaagagtttagcatgatccagagttgaagatttataattcattgtgctgtagagggagagtaataatattgttgcagagcccaaagcaagggaggaaataataaaataaataaaatatatggtgtaaa

SEQ ID NO: 166528 - DNA, 601 bp, Human
aaataaataaaatatatggtgtaaaattgaatttgaggccttggatactaaaagtgaggaactgggagaagtgaagaatgaaataatatgctacataatccaactctcccgaggatatgtttctctagaattctgaaaaggtgcaaaattatttccatttgccaatgatccatgcctaattgcttctggagagtaaaagagcaagaaatgtatctgagagagagagaggaagacatacttgtacaatgacactttagaggagctccgctttctggcttcagagcagtgtaactcacaggtraggtaaagcaggatggtgagaagaggaaaggggctttgggggaacccacctcttcagcttagtgaagtcctataatggtttctattggaaccccagcccagatacttaccagcgatggggctttgggcaaaggacttaaccttttaagactccattttgcatctgtaaaatggggatattaaaagatttccttggtaagtaaaaatagggctcgcggagcaggtggcacatagcacccaccatctgagccgtcactgctcacagggcattaggttgttggaatgacattcagcagcaggc

SEQ ID NO: 166529 - DNA, 601 bp, Human
gcaggatggtgagaagaggaaaggggctttgggggaacccacctcttcagcttagtgaagtcctataatggtttctattggaaccccagcccagatacttaccagcgatggggctttgggcaaaggacttaaccttttaagactccattttgcatctgtaaaatggggatattaaaagatttccttggtaagtaaaaatagggctcgcggagcaggtggcacatagcacccaccatctgagccgtcactgctcacagggcattaggttgttggaatgacattcagcagcaggctgtgaccygtgaacccaaactctcctaactcctcccctttgccagctcctccaccttcagcacaacacagcagccactctcgtgcatgggcagggcctgggcactttacaaagcagactactcgggccctgccacccagattctcacacataaaaaccaaggtggaatggagagtccaaggacagttggtggatgcttgtgtaaaagtgctgggaaacttgcctctggctgcccagctgtgaagcgtgagccttgcttcttgccccacatccactcctagtcattcaatcctggttccctgctttgcc

SEQ ID NO: 166530 - DNA, 601 bp, Human
ctctcctaactcctcccctttgccagctcctccaccttcagcacaacacagcagccactctcgtgcatgggcagggcctgggcactttacaaagcagactactcgggccctgccacccagattctcacacataaaaaccaaggtggaatggagagtccaaggacagttggtggatgcttgtgtaaaagtgctgggaaacttgcctctggctgcccagctgtgaagcgtgagccttgcttcttgccccacatccactcctagtcattcaatcctggttccctgctttgccaggagccttcayagacgctgtagaatgagagggtgagttgcttgaggggtagcacagatattcctgcctaataaatatgttaaatcaaacaggctcattagaagccggaggctaatggccgacttacaataaaatgccgagtctctcctcccccaggaagtcttccttgactctccaaattttcactattcccttccacttatgagtcctcgaaccaccgccacacagtccattgcttagtagtggtgtgcttgcctacctgtttcatgggaatgagtatttcttgaaggcaagcgtcatgtaattttcttc

SEQ ID NO: 166531 - DNA, 601 bp, Human
ttgcttagtagtggtgtgcttgcctacctgtttcatgggaatgagtatttcttgaaggcaagcgtcatgtaattttcttctatgataaggatatttaaggtgtttattggacccactaaccattggttgccaagtgaagagatgggcttcagactgtgatgagtgataaaagagttctgcctactgtggaacctgctggaactcatcacttgtgctgaaagtgcaacatccccaccacacacacacacacacacacacacacacacacacacacacacatacacacactgagaaggaggargaggtatgagtgtcctaccatagagatggcctcagtggttaccttacctgtgttcactcaagagctaaaatgttctccccaacgtcatctctcatctttgggtatttaaatatctaaaatatgttttggggatgccctggtagaaatttctacacagctgtgcttaaaaggagaaaaatctagtttgggtttctgttcaagactaacaccgctgggtttttcaactgcacagatggaattgcagtaaaagtctctctgtttcttttctacagccatctgagggatccgtgttctttcatg

SEQ ID NO: 166532 - DNA, 601 bp, Human
catctttgggtatttaaatatctaaaatatgttttggggatgccctggtagaaatttctacacagctgtgcttaaaaggagaaaaatctagtttgggtttctgttcaagactaacaccgctgggtttttcaactgcacagatggaattgcagtaaaagtctctctgtttcttttctacagccatctgagggatccgtgttctttcatgaaatcattaatattcttaaaatacagatggttcccgtttccagagacattggtcccggggtctgtgaaattgtgtttattttcattttgatgycaccatttctcaggcaaaggttccaactgctctccaaaactttaaagagtgctctgtcaggatacgtagtgaggcagctaagcacctccctggagtgctaagtggttcaggcagcgccagatgccatggagcctgatgagtgttctaggggaaccatgtggaagggagctctcccagagagaaagagaagggaaagaaagagggacaaggggtgagggaggctgcctaggctctcagggagcctctaccttcctgcagtccttgctaacaacgtcttctcctctgcagaccccacactgt

SEQ ID NO: 166533 - DNA, 601 bp, Human
cccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagtaagtgccgcccaagtacccagggctgggaggaagcttggcatggagccaacccagggagaggaagtcagtgctgcccgttcgtgttgggcagatgcygccggagcagcatcgtggggcctgtagtgttgccaaggtcacgtgggctcctacagaccctgtgaggggcagacccaatcctgaagtgtcaaaggaagtaagacgagaaatggagaaaagtagagagctgtgacctggaggggtctggcagaggctggttacactcttcccatgagaccgcctttccagaaactattccaatttgaaaatagatagagatgggtggtgccctggctggtgttttcctaagtgattatttaaaattcctccaggaaactctagattcaaggcttttggatt

SEQ ID NO: 166534 - DNA, 601 bp, Human
gacagggcagccttgagatgctatttgttgtgaatggccaaggcagctgcgagtcttgcaggagtttagctttgggcaggggcttgatgattttaagcccccttcgcaagttcagatccttagacagcaactctgggacctgcttttcctggactggctggctctgggttggtgagctctgtttgctcgccatcgttctgtggacctttaactccccatctttggaatccactgtcccttcagcgacagtgttcctcatggggcaggggcaacacgtgctggctggagaaatgaaaaatcmaaaaactggctttggcagtttccactggtgcctctgtgctctctggtcacctttccgaggcgtctggtaactagtgcgagaaagtagatgatgcagtatttgttagctccggagcaattacctcatgtctgagtcttgctgcaacatgaggtcagcccaagaaacaatttcaaaaaaggggacaattttccacccagtttttcagagctttggataattagcactttctaattcatattttcagcttttaactgtttgtggaattttaaaaaataaggatctttgaacagagtcctgcag

SEQ ID NO: 166535 - DNA, 601 bp, Human
ctttggcagtttccactggtgcctctgtgctctctggtcacctttccgaggcgtctggtaactagtgcgagaaagtagatgatgcagtatttgttagctccggagcaattacctcatgtctgagtcttgctgcaacatgaggtcagcccaagaaacaatttcaaaaaaggggacaattttccacccagtttttcagagctttggataattagcactttctaattcatattttcagcttttaactgtttgtggaattttaaaaaataaggatctttgaacagagtcctgcagtgatctaggyaggccagggtgggtgtgtggaggttagcatgagaaggagagaccagcaaagcaacctgattccagcaggagtttgcaggaaccctaagccctttccttcatttgccaggagtagagaggacaacagtagcatagacagcatgctctgaactgttagttaaagggcccagtgcttcgagactcttcggcggatgcccttgttgggagaatgttcaaggcattctctccatgtggggaaagcccattcatgccatatgaccccggggccctaaccagtccataaacagcccaaggtccccta

SEQ ID NO: 166536 - DNA, 601 bp, Human
ggaggttagcatgagaaggagagaccagcaaagcaacctgattccagcaggagtttgcaggaaccctaagccctttccttcatttgccaggagtagagaggacaacagtagcatagacagcatgctctgaactgttagttaaagggcccagtgcttcgagactcttcggcggatgcccttgttgggagaatgttcaaggcattctctccatgtggggaaagcccattcatgccatatgaccccggggccctaaccagtccataaacagcccaaggtcccctagtacttcctgccaccgaacaatgggaacacagatgctgaagtgagacaaatgcctgagaaggtggtcactggtcgccagtagagagaccttctattggagaagagcagataacaaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagac

SEQ ID NO: 166537 - DNA, 601 bp, Human
aaggagagaccagcaaagcaacctgattccagcaggagtttgcaggaaccctaagccctttccttcatttgccaggagtagagaggacaacagtagcatagacagcatgctctgaactgttagttaaagggcccagtgcttcgagactcttcggcggatgcccttgttgggagaatgttcaaggcattctctccatgtggggaaagcccattcatgccatatgaccccggggccctaaccagtccataaacagcccaaggtcccctagtacttcctgccaccgaacaatgggaacacagawgctgaagtgagacaaatgcctgagaaggtggtcactggtcgccagtagagagaccttctattggagaagagcagataacaaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagacatttgaaaatgcagg

SEQ ID NO: 166538 - DNA, 601 bp, Human
gcaggaaccctaagccctttccttcatttgccaggagtagagaggacaacagtagcatagacagcatgctctgaactgttagttaaagggcccagtgcttcgagactcttcggcggatgcccttgttgggagaatgttcaaggcattctctccatgtggggaaagcccattcatgccatatgaccccggggccctaaccagtccataaacagcccaaggtcccctagtacttcctgccaccgaacaatgggaacacagatgctgaagtgagacaaatgcctgagaaggtggtcactggtcrccagtagagagaccttctattggagaagagcagataacaaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagacatttgaaaatgcagggcagatatccagagttgaggatggtggcgaacagtagtaca

SEQ ID NO: 166539 - DNA, 601 bp, Human
agagaggacaacagtagcatagacagcatgctctgaactgttagttaaagggcccagtgcttcgagactcttcggcggatgcccttgttgggagaatgttcaaggcattctctccatgtggggaaagcccattcatgccatatgaccccggggccctaaccagtccataaacagcccaaggtcccctagtacttcctgccaccgaacaatgggaacacagatgctgaagtgagacaaatgcctgagaaggtggtcactggtcgccagtagagagaccttctattggagaagagcagataamaaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagacatttgaaaatgcagggcagatatccagagttgaggatggtggcgaacagtagtacatccacaagatgggaagtagttgttctgccattgaaatg

SEQ ID NO: 166540 - DNA, 601 bp, Human
agaggacaacagtagcatagacagcatgctctgaactgttagttaaagggcccagtgcttcgagactcttcggcggatgcccttgttgggagaatgttcaaggcattctctccatgtggggaaagcccattcatgccatatgaccccggggccctaaccagtccataaacagcccaaggtcccctagtacttcctgccaccgaacaatgggaacacagatgctgaagtgagacaaatgcctgagaaggtggtcactggtcgccagtagagagaccttctattggagaagagcagataacaaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagacatttgaaaatgcagggcagatatccagagttgaggatggtggcgaacagtagtacatccacaagatgggaagtagttgttctgccattgaaatgat

SEQ ID NO: 166541 - DNA, 601 bp, Human
tggtcactggtcgccagtagagagaccttctattggagaagagcagataacaaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagacatttgaaaatgcagggcagatatccagagttgaggatggtggckaacagtagtacatccacaagatgggaagtagttgttctgccattgaaatgattattgggaaacaccatgagaagtgcttaggatacaatgttgggtggaaaagctcattataaagtggtctgtgcactgatagaaaaaccatgtctgcctgcgaaagcaaaaaattaaaataatcgtgttaaattaaaaaaaaaaaaaccttgccccaacatggtattgaaatatccttttgaggaacctagacttaaaatgatccactgtcagggaaaaggcttttagattcatgctgctttttaattg

SEQ ID NO: 166542 - DNA, 601 bp, Human
ggtattgaaatatccttttgaggaacctagacttaaaatgatccactgtcagggaaaaggcttttagattcatgctgctttttaattggtgtctaccttggggttccagccttggggaccctctagtgtgaggtggtggctggctgctaagcgcctgcaggaggccatgggctggcgatcgtgtctgctctgtttctgctctggattgctgggaactcccccgtgacaaccagcactttaaacgcttttaaagccttcaaacactttattgtttttccagactgacttccagtggatgttytgtgcttaggtggaaggccagtgcttgcggagagtttgaggcgatgagtcaaggcaaggggagagggtgctgattctttgtgctttatcatcttgtcctttcattggagaggaaggtggggctcagatatttccactttagcaagagatggatggaaaatagctgagatccttcactccggtggaggaagtactgcagggtgaaggaaagttgatagagcagaatcggggacctgagactgtggctggttggaagtcagtagagtccaagttggtggcacttctctgatctaatctttct

SEQ ID NO: 166543 - DNA, 601 bp, Human
atccttttgaggaacctagacttaaaatgatccactgtcagggaaaaggcttttagattcatgctgctttttaattggtgtctaccttggggttccagccttggggaccctctagtgtgaggtggtggctggctgctaagcgcctgcaggaggccatgggctggcgatcgtgtctgctctgtttctgctctggattgctgggaactcccccgtgacaaccagcactttaaacgcttttaaagccttcaaacactttattgtttttccagactgacttccagtggatgttttgtgcttaggwggaaggccagtgcttgcggagagtttgaggcgatgagtcaaggcaaggggagagggtgctgattctttgtgctttatcatcttgtcctttcattggagaggaaggtggggctcagatatttccactttagcaagagatggatggaaaatagctgagatccttcactccggtggaggaagtactgcagggtgaaggaaagttgatagagcagaatcggggacctgagactgtggctggttggaagtcagtagagtccaagttggtggcacttctctgatctaatctttctgggctttatag

SEQ ID NO: 166544 - DNA, 601 bp, Human
gctttatagaaagtctagaaaaaggaaaacttcataggataagaagctttggcatcaaatttacatttcacaaaaggtgcttgactatttattctggtggtttgggaggggagctagacttttacattttaaatgcaaatgtattttccagggtagagaagaaatagcagttccctgtgcccctacagaccctgtctgatggccaggcatgctagggaggtgcttgttcttcacacctgggcgtgtcagctgtgccagaggagctgtgtcacacgccacacaggcgcccacccctcccccmcaccaccacaggaaatgcaaggaggactgtgatggctggggtggccacggttcttgggggtaattcccatgagtcctgggaaactccagggtttacacctgtcaatcccagcactttgggaggccaaggcgggtggatcacctgaggccagaagttggagaccagcctggccaacgtggtgaaaccccgtctctactaaacatacaaaaatgagccaggtgtggtggtgggcgcctgtaatcctagctacttgggaggctgaggcaggagagtcgcttgaatgcgggagggggaggctgc

SEQ ID NO: 166545 - DNA, 601 bp, Human
ggccaggcatgctagggaggtgcttgttcttcacacctgggcgtgtcagctgtgccagaggagctgtgtcacacgccacacaggcgcccacccctcccccccaccaccacaggaaatgcaaggaggactgtgatggctggggtggccacggttcttgggggtaattcccatgagtcctgggaaactccagggtttacacctgtcaatcccagcactttgggaggccaaggcgggtggatcacctgaggccagaagttggagaccagcctggccaacgtggtgaaaccccgtctctactaawcatacaaaaatgagccaggtgtggtggtgggcgcctgtaatcctagctacttgggaggctgaggcaggagagtcgcttgaatgcgggagggggaggctgcagtgagctgagatcgcaccaccgcactctggcctgggcgatagaccgaggctctgtcttcagaggaaaaaaggttgcccccttgtggacaactatctacagtacccattttgaagctgaacccactgaggcccagacagcttcagaaattggttcaaaggcatccagccgattgagagcacctggcatctcagactaggg

SEQ ID NO: 166546 - DNA, 601 bp, Human
gtgagctgagatcgcaccaccgcactctggcctgggcgatagaccgaggctctgtcttcagaggaaaaaaggttgcccccttgtggacaactatctacagtacccattttgaagctgaacccactgaggcccagacagcttcagaaattggttcaaaggcatccagccgattgagagcacctggcatctcagactagggcctctggagtcccagtccctggcctcgcgttgccgacgttcccccggccctggagacagcaagccagcctgcgccacacaggcaaggcagcctcactcccgkccttccacgtgggcagcccggccacttcccccacagcattttctgttgtcatttgtaccaagagataaatgctttccaaaaactttcctgtggcctcctggaaggaggccgattaagccaaacctatcaccacgctaactttgtccttctctgggcctgactgtcggccccaccagtatctctcccggacacaccccgtgtggcagaggagccttcgcagcagctgctgcgggaacgagatttgtcccttctcaggccaaggcggggaaggacctcgaagaaacggagggcgccgggctg

SEQ ID NO: 166547 - DNA, 601 bp, Human
aaggaggccgattaagccaaacctatcaccacgctaactttgtccttctctgggcctgactgtcggccccaccagtatctctcccggacacaccccgtgtggcagaggagccttcgcagcagctgctgcgggaacgagatttgtcccttctcaggccaaggcggggaaggacctcgaagaaacggagggcgccgggctggcagttcaggctcagggccgctggggggagtttgcgcaaggctgggagccccgaggccccgggggaggtggggaggcagaaagaaaaagagccttttttaarttttacaaacaagttcgttttgtatgtcaatctgggtctgacctggaaaaaaaaacactaagaaactgcgtcttcaaacagtggctgctcaaaagaatgaaactgcgcgaccgggagaccacggaaagggtgtctatcttcattcccatttttaatttaaactttaatggaaaacacattttgcattttctggtctttccacctgcagcctcagatggtcgggcagaggttttgggtctgggcaattaagctggtgcaatcttatcacttccaggcctgggtttgactggtgaaggagaa

SEQ ID NO: 166548 - DNA, 601 bp, Human
ctgactgtcggccccaccagtatctctcccggacacaccccgtgtggcagaggagccttcgcagcagctgctgcgggaacgagatttgtcccttctcaggccaaggcggggaaggacctcgaagaaacggagggcgccgggctggcagttcaggctcagggccgctggggggagtttgcgcaaggctgggagccccgaggccccgggggaggtggggaggcagaaagaaaaagagccttttttaagttttacaaacaagttcgttttgtatgtcaatctgggtctgacctggaaaaaaaaacactaagaaactgcgtcttcaaacagtggctgctcaaaagaatgaaactgcgcgaccgggagaccacggaaagggtgtctatcttcattcccatttttaatttaaactttaatggaaaacacattttgcattttctggtctttccacctgcagcctcagatggtcgggcagaggttttgggtctgggcaattaagctggtgcaatcttatcacttccaggcctgggtttgactggtgaaggagaacagaatgccagctgaacaaaaggccaggtttccctggacccagtagtcagccagg

SEQ ID NO: 166549 - DNA, 601 bp, Human
aatgaaactgcgcgaccgggagaccacggaaagggtgtctatcttcattcccatttttaatttaaactttaatggaaaacacattttgcattttctggtctttccacctgcagcctcagatggtcgggcagaggttttgggtctgggcaattaagctggtgcaatcttatcacttccaggcctgggtttgactggtgaaggagaacagaatgccagctgaacaaaaggccaggtttccctggacccagtagtcagccaggattgttgtttaaagatcccagagccttgcaccctcccgctyctgcacactcagccagagctgttgatatagcagtgcagcccagagaaaagagagacctggattcaataggctggctgtgagggggcactggtgaattctatggtcacagcgaggcaggagacaaaggctttggcactgggacgcttgcgccccctggcccaggtgtccccgatgaaaagcaggttaggttgagggaatgtgaagcagcagaaaccgtgattgttggggttctaccccacacctgcaaagcctcacactgctcactcccctctcctttcagatccaggtactgtctctagc

SEQ ID NO: 166550 - DNA, 601 bp, Human
gctggtgcaatcttatcacttccaggcctgggtttgactggtgaaggagaacagaatgccagctgaacaaaaggccaggtttccctggacccagtagtcagccaggattgttgtttaaagatcccagagccttgcaccctcccgctcctgcacactcagccagagctgttgatatagcagtgcagcccagagaaaagagagacctggattcaataggctggctgtgagggggcactggtgaattctatggtcacagcgaggcaggagacaaaggctttggcactgggacgcttgcgccccctggcccaggtgtccccgatgaaaagcaggttaggttgagggaatgtgaagcagcagaaaccgtgattgttggggttctaccccacacctgcaaagcctcacactgctcactcccctctcctttcagatccaggtactgtctctagcagcacatggattcaaacatggaatggaaaatgatcttttccccatgcttgcactttgggaaggccattctattctcagcaggagctactttatgctttttagagcaaaaatgccctcaataaatagatatatgtatatgcatacacacccatat

SEQ ID NO: 166551 - DNA, 601 bp, Human
aggagacaaaggctttggcactgggacgcttgcgccccctggcccaggtgtccccgatgaaaagcaggttaggttgagggaatgtgaagcagcagaaaccgtgattgttggggttctaccccacacctgcaaagcctcacactgctcactcccctctcctttcagatccaggtactgtctctagcagcacatggattcaaacatggaatggaaaatgatcttttccccatgcttgcactttgggaaggccattctattctcagcaggagctactttatgctttttagagcaaaaatgcccycaataaatagatatatgtatatgcatacacacccatatacaaatatatacatacaaacacatatacagaaacttacaaataaccaagtaggcaaatcttatacttcagtttgaactgaagtacaacacagagagaagtgcaaaaatcatgaagtgcgctacgtgagacattatcgtgacgtgaatccacccactcccataagcacctcccgggccaaggagtagaatttcagccccctgtaccctctctccaccccacaaccgcttcctccacaaaactaaccaccaccctgcttcccag

SEQ ID NO: 166552 - DNA, 601 bp, Human
tggcagggtcaggccagaaagagcctcaaggcaggagaaagcagtccaaagccacagagagggaggccagactccaggaggacctgcctgcatcagaacaagttccttaagaaaacagagcctggggaactaatgaagtagaaatcggagaagaggagggaatctaggtcccttgggagagaggccagatgcccccaaccagcccctccttggggaaggcagcctctccttctaggagtgaaacttgaaccaagaacagtctttagggcaaaatccttttcctaggttgccatgaaatatrcatttcatgcaagctttggagaggtcaaatgaccctttctctcagctttctgggagtttcctgtggaattcatgtgtgcccaaagaagaactttcaccaatggggaaatttaataaatgtggtttatctaaggttcgtgctttcggctacatctgcactaatgactcaggcagtttgctcctcggagaccatcatttttctttatttgctccagcagtgaggtttcagcctgagggagagaacgtcagggacggagaggcaagcattcttggtcctacttctgggatttttttgtattcc

SEQ ID NO: 166553 - DNA, 601 bp, Human
aacgatcatagctagcatttatggaacacttatgagccaaggtccattctgagcacattgcatgcattatttgatttaatcttcataatgccattgagtggtgttagcccattttacagatgagaaactgctggctcaaagagatgagggaaatcagtggagggcacaaagctagtcagtgataagaggcaggtctaattttaaagtctcctttgcttaataaacatacagtcgtgctttgcttcatgatggggatagttcatcttcatgtgaataccacaaaatgtacttacacaaaccsacatggcatagcctactacacactgaggctgtatgctacagcctgtggctcctagcttactaagctgtatagcatgttattgtactgaatatagtagacaaccgtagcacaatggcaagtatttgtgcatctaacttttaaaagatacagtaaaaatacactattaccgttgtcgtatatgtggtccatctttgcccaaaacatcattttttggtgtgtgactattaacaggaacttgtcccagccttactttgtcattggtattcttgaacatggaataaccaaatgtagctggctctt

SEQ ID NO: 166554 - DNA, 601 bp, Human
tcatagctagcatttatggaacacttatgagccaaggtccattctgagcacattgcatgcattatttgatttaatcttcataatgccattgagtggtgttagcccattttacagatgagaaactgctggctcaaagagatgagggaaatcagtggagggcacaaagctagtcagtgataagaggcaggtctaattttaaagtctcctttgcttaataaacatacagtcgtgctttgcttcatgatggggatagttcatcttcatgtgaataccacaaaatgtacttacacaaacccacatrgcatagcctactacacactgaggctgtatgctacagcctgtggctcctagcttactaagctgtatagcatgttattgtactgaatatagtagacaaccgtagcacaatggcaagtatttgtgcatctaacttttaaaagatacagtaaaaatacactattaccgttgtcgtatatgtggtccatctttgcccaaaacatcattttttggtgtgtgactattaacaggaacttgtcccagccttactttgtcattggtattcttgaacatggaataaccaaatgtagctggctcttggatg

SEQ ID NO: 166555 - DNA, 601 bp, Human
tagcccattttacagatgagaaactgctggctcaaagagatgagggaaatcagtggagggcacaaagctagtcagtgataagaggcaggtctaattttaaagtctcctttgcttaataaacatacagtcgtgctttgcttcatgatggggatagttcatcttcatgtgaataccacaaaatgtacttacacaaacccacatggcatagcctactacacactgaggctgtatgctacagcctgtggctcctagcttactaagctgtatagcatgttattgtactgaatatagtagacaaccrtagcacaatggcaagtatttgtgcatctaacttttaaaagatacagtaaaaatacactattaccgttgtcgtatatgtggtccatctttgcccaaaacatcattttttggtgtgtgactattaacaggaacttgtcccagccttactttgtcattggtattcttgaacatggaataaccaaatgtagctggctcttggatgttatattcatgtgactgtctcatttctaaaatggcatccacatagccacactttggcatacagcgggctcaataccacccccgtcatccccctccttgt

SEQ ID NO: 166556 - DNA, 601 bp, Human
caaagagatgagggaaatcagtggagggcacaaagctagtcagtgataagaggcaggtctaattttaaagtctcctttgcttaataaacatacagtcgtgctttgcttcatgatggggatagttcatcttcatgtgaataccacaaaatgtacttacacaaacccacatggcatagcctactacacactgaggctgtatgctacagcctgtggctcctagcttactaagctgtatagcatgttattgtactgaatatagtagacaaccgtagcacaatggcaagtatttgtgcatctaacwtttaaaagatacagtaaaaatacactattaccgttgtcgtatatgtggtccatctttgcccaaaacatcattttttggtgtgtgactattaacaggaacttgtcccagccttactttgtcattggtattcttgaacatggaataaccaaatgtagctggctcttggatgttatattcatgtgactgtctcatttctaaaatggcatccacatagccacactttggcatacagcgggctcaataccacccccgtcatccccctccttgttttcatctggagctgctgcagagctagaacta

SEQ ID NO: 166557 - DNA, 601 bp, Human
aatgtacttacacaaacccacatggcatagcctactacacactgaggctgtatgctacagcctgtggctcctagcttactaagctgtatagcatgttattgtactgaatatagtagacaaccgtagcacaatggcaagtatttgtgcatctaacttttaaaagatacagtaaaaatacactattaccgttgtcgtatatgtggtccatctttgcccaaaacatcattttttggtgtgtgactattaacaggaacttgtcccagccttactttgtcattggtattcttgaacatggaataascaaatgtagctggctcttggatgttatattcatgtgactgtctcatttctaaaatggcatccacatagccacactttggcatacagcgggctcaataccacccccgtcatccccctccttgttttcatctggagctgctgcagagctagaactaacagtcatattctaggcaattggacaattcttataaaattctcttcctctgccgggtgcggtggtaatcccagcactttgggaggccgaggcaggcagatcacctgagaccagcctgaccaacatggagaaaccccgtctctacta

SEQ ID NO: 166558 - DNA, 601 bp, Human
cacactgaggctgtatgctacagcctgtggctcctagcttactaagctgtatagcatgttattgtactgaatatagtagacaaccgtagcacaatggcaagtatttgtgcatctaacttttaaaagatacagtaaaaatacactattaccgttgtcgtatatgtggtccatctttgcccaaaacatcattttttggtgtgtgactattaacaggaacttgtcccagccttactttgtcattggtattcttgaacatggaataaccaaatgtagctggctcttggatgttatattcatgtgwctgtctcatttctaaaatggcatccacatagccacactttggcatacagcgggctcaataccacccccgtcatccccctccttgttttcatctggagctgctgcagagctagaactaacagtcatattctaggcaattggacaattcttataaaattctcttcctctgccgggtgcggtggtaatcccagcactttgggaggccgaggcaggcagatcacctgagaccagcctgaccaacatggagaaaccccgtctctactaaaaatacaaaattagccgagcatggtggcgcatgcct

SEQ ID NO: 166559 - DNA, 601 bp, Human
gtatttgtgcatctaacttttaaaagatacagtaaaaatacactattaccgttgtcgtatatgtggtccatctttgcccaaaacatcattttttggtgtgtgactattaacaggaacttgtcccagccttactttgtcattggtattcttgaacatggaataaccaaatgtagctggctcttggatgttatattcatgtgactgtctcatttctaaaatggcatccacatagccacactttggcatacagcgggctcaataccacccccgtcatccccctccttgttttcatctggagctkctgcagagctagaactaacagtcatattctaggcaattggacaattcttataaaattctcttcctctgccgggtgcggtggtaatcccagcactttgggaggccgaggcaggcagatcacctgagaccagcctgaccaacatggagaaaccccgtctctactaaaaatacaaaattagccgagcatggtggcgcatgcctgtaatcccagctactggggaagctgaggcaggagaatcacttgaatctgcgaggcggaggttgcagtgaactgagatcgcgccattgcactccagcctgg

SEQ ID NO: 166560 - DNA, 601 bp, Human
attaacaggaacttgtcccagccttactttgtcattggtattcttgaacatggaataaccaaatgtagctggctcttggatgttatattcatgtgactgtctcatttctaaaatggcatccacatagccacactttggcatacagcgggctcaataccacccccgtcatccccctccttgttttcatctggagctgctgcagagctagaactaacagtcatattctaggcaattggacaattcttataaaattctcttcctctgccgggtgcggtggtaatcccagcactttgggaggccraggcaggcagatcacctgagaccagcctgaccaacatggagaaaccccgtctctactaaaaatacaaaattagccgagcatggtggcgcatgcctgtaatcccagctactggggaagctgaggcaggagaatcacttgaatctgcgaggcggaggttgcagtgaactgagatcgcgccattgcactccagcctgggcaacaagagcgaaactccgtttcaaaaaaaataaataaataaattctcttcctcatcgtctggcttggatagtgcacacattttctctgaggcacacaaccaaa

SEQ ID NO: 166561 - DNA, 601 bp, Human
tcatgtgactgtctcatttctaaaatggcatccacatagccacactttggcatacagcgggctcaataccacccccgtcatccccctccttgttttcatctggagctgctgcagagctagaactaacagtcatattctaggcaattggacaattcttataaaattctcttcctctgccgggtgcggtggtaatcccagcactttgggaggccgaggcaggcagatcacctgagaccagcctgaccaacatggagaaaccccgtctctactaaaaatacaaaattagccgagcatggtggcrcatgcctgtaatcccagctactggggaagctgaggcaggagaatcacttgaatctgcgaggcggaggttgcagtgaactgagatcgcgccattgcactccagcctgggcaacaagagcgaaactccgtttcaaaaaaaataaataaataaattctcttcctcatcgtctggcttggatagtgcacacattttctctgaggcacacaaccaaacgcccacagctgggtgaggcggcaactccatttcggcatcccttccatgactggagactaaaaataggggtgtgtctgacagcccatt

SEQ ID NO: 166562 - DNA, 601 bp, Human
caataccacccccgtcatccccctccttgttttcatctggagctgctgcagagctagaactaacagtcatattctaggcaattggacaattcttataaaattctcttcctctgccgggtgcggtggtaatcccagcactttgggaggccgaggcaggcagatcacctgagaccagcctgaccaacatggagaaaccccgtctctactaaaaatacaaaattagccgagcatggtggcgcatgcctgtaatcccagctactggggaagctgaggcaggagaatcacttgaatctgcgaggcrgaggttgcagtgaactgagatcgcgccattgcactccagcctgggcaacaagagcgaaactccgtttcaaaaaaaataaataaataaattctcttcctcatcgtctggcttggatagtgcacacattttctctgaggcacacaaccaaacgcccacagctgggtgaggcggcaactccatttcggcatcccttccatgactggagactaaaaataggggtgtgtctgacagcccattcccacccctggcacccaagccagtccactcggccacagggagcggggaaaagggttgtttaga

SEQ ID NO: 166563 - DNA, 601 bp, Human
ggcaattggacaattcttataaaattctcttcctctgccgggtgcggtggtaatcccagcactttgggaggccgaggcaggcagatcacctgagaccagcctgaccaacatggagaaaccccgtctctactaaaaatacaaaattagccgagcatggtggcgcatgcctgtaatcccagctactggggaagctgaggcaggagaatcacttgaatctgcgaggcggaggttgcagtgaactgagatcgcgccattgcactccagcctgggcaacaagagcgaaactccgtttcaaaaaaaataaataaataaattctcttcctcatcgtctggcttggatagtgcacacattttctctgaggcacacaaccaaacgcccacagctgggtgaggcggcaactccatttcggcatcccttccatgactggagactaaaaataggggtgtgtctgacagcccattcccacccctggcacccaagccagtccactcggccacagggagcggggaaaagggttgtttagaagaattttcttagcctcgaatacatgtgttgagcttatggtatgttttataaaagcagatcccagccctcgtttca

SEQ ID NO: 166564 - DNA, 601 bp, Human
caagagcgaaactccgtttcaaaaaaaataaataaataaattctcttcctcatcgtctggcttggatagtgcacacattttctctgaggcacacaaccaaacgcccacagctgggtgaggcggcaactccatttcggcatcccttccatgactggagactaaaaataggggtgtgtctgacagcccattcccacccctggcacccaagccagtccactcggccacagggagcggggaaaagggttgtttagaagaattttcttagcctcgaatacatgtgttgagcttatggtatgttttrtaaaagcagatcccagccctcgtttcaagggctctttaagatttccttaggagaatctcaaagagaatggcaaaaatgcctaagtttcacaaaatacaaccttgaattcactttaaacaaaggaaaaagtctagttttaggaaagaagggagaatgtgttttacatgtaacaacaaattgctttttcaaagtgctgggtacagaagaggtatgaattgaagtttaatttgaaaagattggatatcagcattctgagattacagaaaattcaacgcgtgactcctcaggttcagtgcgtgc

SEQ ID NO: 166565 - DNA, 601 bp, Human
agcccattcccacccctggcacccaagccagtccactcggccacagggagcggggaaaagggttgtttagaagaattttcttagcctcgaatacatgtgttgagcttatggtatgttttataaaagcagatcccagccctcgtttcaagggctctttaagatttccttaggagaatctcaaagagaatggcaaaaatgcctaagtttcacaaaatacaaccttgaattcactttaaacaaaggaaaaagtctagttttaggaaagaagggagaatgtgttttacatgtaacaacaaattgytttttcaaagtgctgggtacagaagaggtatgaattgaagtttaatttgaaaagattggatatcagcattctgagattacagaaaattcaacgcgtgactcctcaggttcagtgcgtgctcttagacataggtgaagggaagcaaaagttcctattggaatactaccactcacctccttcccaactcccattgccccctccaccagtaacatacctgtgtaccttaccctcacctgtgaaaggacccatatgtacataaacccagaagataccacagcaggaaggagtgatactggcttc

SEQ ID NO: 166566 - DNA, 601 bp, Human
tttttaaagtggtggcttaagggtttggtctggtttggtttggttttgctgagaaagaaaacttcctcggcaaatgatttttgccagtgaagattttagtacacgtcacaatagaattcctcagcgtctttatgaaacatcgtgaggagtggttcagatactgttagatttcaggcattgaaacaagtgaataattcatagtacctggtttaaaggaggaaaagatgtgaacaaataattattaggaaccagagagagactggaaaaaatatttgcgcggcatagcaaaaattccacagargaggggacttttgaataggagcttgaagaataataagagtgtggcaggcactctgtcctccttggctcgctgtctgtccccagtttttctttaactcaccctccccaaaatatataagaaaggcagaagttctcaggatcagttacatatagcacagcactgcaaaacctttcagagaaacaaaggctcttctaagggaaggaccatttggcttaaaatccgcatggggtgtgaaggaaacagagagccaaaggcactagctggctgtcttgcccaaggttacaactttgatcacacagc

SEQ ID NO: 166567 - DNA, 601 bp, Human
ttgagctgtcttgctcctctatgccttccccttgtgaggtggtctgaatctgtctgaacgacccatcaagccacaaaacaaagtacattagcaagacaaagctaagcaagccctccctctatcctccctgcctcctccccacctctcactggctctcctgctctgctctaatcactatctattagctattagaagacatcaggcaaccttggctccatcttctttgaataagacacacacagccccaaacaaacccagagttcatcaagagcaccagagctgtgtgtgtgtgtgtgtgtggctgtgtgtgagtgcacactggtgcagtccacaaagggcaggtgctggcatcaagcacaaagcaaggaagttgaggagatgctgtctattaatgtcttcaaagcacttatcaaattagaatggctttttgctttaaaattgtataatcacccttccagcttgtctcttgaaaatggctgcaatctctaggggttatttgtgcccaggaagtaagagtagattttaaaaattaatttagaacaatctttaagcccctttaaattaaatattctatggacatggattggatccagctagagca

SEQ ID NO: 166568 - DNA, 601 bp, Human
acttatcaaattagaatggctttttgctttaaaattgtataatcacccttccagcttgtctcttgaaaatggctgcaatctctaggggttatttgtgcccaggaagtaagagtagattttaaaaattaatttagaacaatctttaagcccctttaaattaaatattctatggacatggattggatccagctagagcagttatgctctacctttagtttatcaaggctaaggcacttaaaaaaataaactaggataaaagctattgttatccatttacaatagcagccacaactgtcatctrtaaagggttttggaatatatcagacacctccacatgctttgctttggagcctagcactgggtctttgaagtagatattattatctctattttgcagacaaagaaagtggggttcagcactattaagtgactcactgaagggtacacagctactagatggcagagcaaggactcaaaccaggttagaggattagactagaaccccctcactttctgacaaatacagcctttctcttccagctgccattctgcaaaagcaatacctagcctaaatgtaacttgggcaaagatgtgaatgttt

SEQ ID NO: 166569 - DNA, 601 bp, Human
ttgcattacttgatttctgtccatgcagttttcccactgtcagctccatctccatccctaaacttttctctctttccaaagatgaaccaataaacaacttatgcttggcaccagcccttagttctgacagcacagagaatcaccaggagatctttcaaaatactgactctaggacaaacattgcatgattgcactcataggaggtaactgtcaactttgtagagccagaaggtacatggtggttaccaggagcggcaaggagtggaaatagggtgttagtgtttaatgggtaagagtttcmatttgggaagatgaaaaggttctggagctggatggtggtaatcgttgcatagcattgtgaatgtacttaatgccactaaattgtacacttaaaatggttaaaatggtaagttttatgttacatattttactaaaattttgtaaatgcaaaaattaaaataaaaaaatactgatgcccaagtgccaaaaaatgatgcattaattcagaacctccaagggtgactcctgggcattggaaatgttttagagctctccgggttattcatataagccaagctgcagccaagctagagaagcctgc

SEQ ID NO: 166570 - DNA, 601 bp, Human
agctaatttttttttgtattttttagtagagacggggtttcaccatgttagccaggatggtctcgacctcctgacctcatgatctgcccgccttggcctcctaattacagtatcccgctaattacagtatttttgagggtttaccagatgttaacaccgtaccaagggtcgtgaaggatactatacatagatagccaagctgctttaaaacttattcgggggccgggcatggtggttcatgcctgtaatccctgcactttgggaggccaaggtgggcagaccacctgaggtcagaagttcragaccagcttggccaacatggtgaaaccccgtctctactaaaaataaaaaattagtcaggtgtggtggcatgtgcctgtagtcccagctacccgggaggctgaagcaggagaattgcttgaacccgggaggcggaggttgcagtgagcgaagatcacaccactgcactccagcctgggtgacagagtgagactctgtctcaaaaaacaaagcaaaaaaacaactatttagggagacacacctaggaaatatgaaggaaatataaaactgcatgtaatcgaaaaacaacaatgcatgctac

SEQ ID NO: 166571 - DNA, 601 bp, Human
ttggccaacatggtgaaaccccgtctctactaaaaataaaaaattagtcaggtgtggtggcatgtgcctgtagtcccagctacccgggaggctgaagcaggagaattgcttgaacccgggaggcggaggttgcagtgagcgaagatcacaccactgcactccagcctgggtgacagagtgagactctgtctcaaaaaacaaagcaaaaaaacaactatttagggagacacacctaggaaatatgaaggaaatataaaactgcatgtaatcgaaaaacaacaatgcatgctacacacaagawattttctgagtgtaatgaagagatggaaaatcattaatgctcaagctgaacatctcctccaaatcccttatagaacaggagagatctgaggccagagaaggtgtggacccagccatggtcacacagggagtgaagacaaatatatacaattattcctatgtaggcagatgttatagatacatgataccttagtcaggaattgacctaaattctgtgattcatgctctcctccattcattcatttctttcttatggagaatcttctctgcatagaataccaggctgagccctaaaaccatg

SEQ ID NO: 166572 - DNA, 601 bp, Human
tgacagagtgagactctgtctcaaaaaacaaagcaaaaaaacaactatttagggagacacacctaggaaatatgaaggaaatataaaactgcatgtaatcgaaaaacaacaatgcatgctacacacaagaaattttctgagtgtaatgaagagatggaaaatcattaatgctcaagctgaacatctcctccaaatcccttatagaacaggagagatctgaggccagagaaggtgtggacccagccatggtcacacagggagtgaagacaaatatatacaattattcctatgtaggcagatrttatagatacatgataccttagtcaggaattgacctaaattctgtgattcatgctctcctccattcattcatttctttcttatggagaatcttctctgcatagaataccaggctgagccctaaaaccatggtgaacacagcacactacctaccctcaagcaggttctagtcaaacagagagacagacagctaagtaagtaaggaactactgtgctttagagtgagggcaatgcacgtatattaccacgtctttcaattttcccctgcatttagctcctgtgtggatgtcctttatgattt

SEQ ID NO: 166573 - DNA, 601 bp, Human
gtgaacacagcacactacctaccctcaagcaggttctagtcaaacagagagacagacagctaagtaagtaaggaactactgtgctttagagtgagggcaatgcacgtatattaccacgtctttcaattttcccctgcatttagctcctgtgtggatgtcctttatgattttagaggtcatagtaaaagatggaggcctctagcaagctgcagcatggcagggctggaaatagatgttgaagcaaagggaaggaggaaggcaccaaggaaaccagcgtgtttgttggggtgggtgtgtgagytttcaagttgggttttggagacaggagcccaggtgagcccttgcaggaataactgaggcctgggtgtttgatgtgggtttcaggaagacaccctggggtagaacctgtgcaccatggcttcctggtacctggaaaaccgggtgcagttggatgtttcattgtgagacaggaagctcagcgaaggagcggagagccagggacttgtgtcaaaatcatttggccggggagggcggagtaggtgggcatggagctgaaataagactgaccatgaattcatgattgttaaagcagggtgatggg

SEQ ID NO: 166574 - DNA, 601 bp, Human
atggcttcctggtacctggaaaaccgggtgcagttggatgtttcattgtgagacaggaagctcagcgaaggagcggagagccagggacttgtgtcaaaatcatttggccggggagggcggagtaggtgggcatggagctgaaataagactgaccatgaattcatgattgttaaagcagggtgatggggcctcagggttcattagactttcctctctacttgtatatatcttagaaattctccgtaactcaaaaaatgcctcaagatatctttgccttatttctccgggcgaagagtttccygaggagggcatctttgtccctcgcgatatgcactgcctgtgtcaggctgatgcgctcccgggtgcagtacttgggaaggcgggcatttggcagccttgtgtgtgtgtctgtgcaggagggcgtgagctggtgctcagtgtggaggtgggctgtgtgtgttgccttgtagagtgcagcgtatgggggctaggtctggaacatgtgtacccaaaggaaaaggcctgtaatactgtgaggtaatctcctgttatttttagggagtaaataacatctctcatgcagcaggttgtgtgaccccac

SEQ ID NO: 166575 - DNA, 601 bp, Human
gtttcctgaggagggcatctttgtccctcgcgatatgcactgcctgtgtcaggctgatgcgctcccgggtgcagtacttgggaaggcgggcatttggcagccttgtgtgtgtgtctgtgcaggagggcgtgagctggtgctcagtgtggaggtgggctgtgtgtgttgccttgtagagtgcagcgtatgggggctaggtctggaacatgtgtacccaaaggaaaaggcctgtaatactgtgaggtaatctcctgttatttttagggagtaaataacatctctcatgcagcaggttgtgtgrccccacaggccccatctacgtcagctcacacacacttcaaattggagggtatcgcggcctcacaggagagcctgtgaagaacattgtcattatatgttcttcctttatgatgaaatgtgcctaagccattcttagcaaaagcagggatgattgctggatgtgtgtgtgtgtgcatgcattcgtgtgtgtgtgtgtgtgtgtgtgtgtgtgtgtgcacgcgcgctgtttctgtggtccaaaggcaagatttatgattatgggatagacagtagcttgctctctctattttattttttaaaa

SEQ ID NO: 166576 - DNA, 601 bp, Human
cagcgtatgggggctaggtctggaacatgtgtacccaaaggaaaaggcctgtaatactgtgaggtaatctcctgttatttttagggagtaaataacatctctcatgcagcaggttgtgtgaccccacaggccccatctacgtcagctcacacacacttcaaattggagggtatcgcggcctcacaggagagcctgtgaagaacattgtcattatatgttcttcctttatgatgaaatgtgcctaagccattcttagcaaaagcagggatgattgctggatgtgtgtgtgtgtgcatgcatkcgtgtgtgtgtgtgtgtgtgtgtgtgtgtgtgtgcacgcgcgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttttttcacgagagagagattaagagagagagagacagagagagagagagagagaacgagggtgacagagagaaacagagatcgggggaggagggagag

SEQ ID NO: 166577 - DNA, 601 bp, Human
gcgtatgggggctaggtctggaacatgtgtacccaaaggaaaaggcctgtaatactgtgaggtaatctcctgttatttttagggagtaaataacatctctcatgcagcaggttgtgtgaccccacaggccccatctacgtcagctcacacacacttcaaattggagggtatcgcggcctcacaggagagcctgtgaagaacattgtcattatatgttcttcctttatgatgaaatgtgcctaagccattcttagcaaaagcagggatgattgctggatgtgtgtgtgtgtgcatgcattcrtgtgtgtgtgtgtgtgtgtgtgtgtgtgtgtgcacgcgcgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttttttcacgagagagagattaagagagagagagacagagagagagagagagagaacgagggtgacagagagaaacagagatcgggggaggagggagagcg

SEQ ID NO: 166578 - DNA, 601 bp, Human
tatgggggctaggtctggaacatgtgtacccaaaggaaaaggcctgtaatactgtgaggtaatctcctgttatttttagggagtaaataacatctctcatgcagcaggttgtgtgaccccacaggccccatctacgtcagctcacacacacttcaaattggagggtatcgcggcctcacaggagagcctgtgaagaacattgtcattatatgttcttcctttatgatgaaatgtgcctaagccattcttagcaaaagcagggatgattgctggatgtgtgtgtgtgtgcatgcattcgtgygtgtgtgtgtgtgtgtgtgtgtgtgtgtgcacgcgcgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttttttcacgagagagagattaagagagagagagacagagagagagagagagagaacgagggtgacagagagaaacagagatcgggggaggagggagagcgaga

SEQ ID NO: 166579 - DNA, 601 bp, Human
aaaaggcctgtaatactgtgaggtaatctcctgttatttttagggagtaaataacatctctcatgcagcaggttgtgtgaccccacaggccccatctacgtcagctcacacacacttcaaattggagggtatcgcggcctcacaggagagcctgtgaagaacattgtcattatatgttcttcctttatgatgaaatgtgcctaagccattcttagcaaaagcagggatgattgctggatgtgtgtgtgtgtgcatgcattcgtgtgtgtgtgtgtgtgtgtgtgtgtgtgtgtgcacgcgygctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttttttcacgagagagagattaagagagagagagacagagagagagagagagagaacgagggtgacagagagaaacagagatcgggggaggagggagagcgagagaactggaaacaaagactcgttgtctctaagctgga

SEQ ID NO: 166580 - DNA, 601 bp, Human
tcattatatgttcttcctttatgatgaaatgtgcctaagccattcttagcaaaagcagggatgattgctggatgtgtgtgtgtgtgcatgcattcgtgtgtgtgtgtgtgtgtgtgtgtgtgtgtgtgcacgcgcgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcatttttttttttttttycacgagagagagattaagagagagagagacagagagagagagagagagaacgagggtgacagagagaaacagagatcgggggaggagggagagcgagagaactggaaacaaagactcgttgtctctaagctggagcaggcaggaaaccccaatccctcgggaacttagccagcccgccctgtcctggagtcagactccagctctctgaattcaatttgacagcttgtctgggacactttctaagtaaccattatccttcctttctctaagtaaaaggactgttatttcttttcgtgggtg

SEQ ID NO: 166581 - DNA, 601 bp, Human
tatatgttcttcctttatgatgaaatgtgcctaagccattcttagcaaaagcagggatgattgctggatgtgtgtgtgtgtgcatgcattcgtgtgtgtgtgtgtgtgtgtgtgtgtgtgtgtgcacgcgcgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttttttcacragagagagattaagagagagagagacagagagagagagagagagaacgagggtgacagagagaaacagagatcgggggaggagggagagcgagagaactggaaacaaagactcgttgtctctaagctggagcaggcaggaaaccccaatccctcgggaacttagccagcccgccctgtcctggagtcagactccagctctctgaattcaatttgacagcttgtctgggacactttctaagtaaccattatccttcctttctctaagtaaaaggactgttatttcttttcgtgggtgtgct

SEQ ID NO: 166582 - DNA, 601 bp, Human
tagcaaaagcagggatgattgctggatgtgtgtgtgtgtgcatgcattcgtgtgtgtgtgtgtgtgtgtgtgtgtgtgtgtgcacgcgcgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttttttcacgagagagagattaagagagagagagacagagagagagagagaragaacgagggtgacagagagaaacagagatcgggggaggagggagagcgagagaactggaaacaaagactcgttgtctctaagctggagcaggcaggaaaccccaatccctcgggaacttagccagcccgccctgtcctggagtcagactccagctctctgaattcaatttgacagcttgtctgggacactttctaagtaaccattatccttcctttctctaagtaaaaggactgttatttcttttcgtgggtgtgctgtgcgaactgctattgcacacgtgtggctcacacagtgacta

SEQ ID NO: 166583 - DNA, 601 bp, Human
atttcttttcgtgggtgtgctgtgcgaactgctattgcacacgtgtggctcacacagtgactaggacacactttcctcaaattattggaaacagcccgtttcctaagacaagtgtaaatttgttccaggataataaggcaaaagactgagtatcagtccactgccttattagaggtgggcctattccattagaggaggaattttgtgtatgtaggttttacttctttgaggattcttttgaaatagacacaaacaacaatatctcccaatgatcattctccccagtttctgtgttaattgrtggattaatttaatgaaacgcatcaccatacatcccactgtggagggaactcagatgtcctcaaagctaccagaggttgtgcaggccacgggcacaactaggggtgaccacctagagttcaaaggaggctgtcttctgcctgggaacagggccatcctggggtttcttttaattactcagacccagttgagtcaccaccataacctgagggactgtgaggtgatcacctgcccttcaatgtgttcctattggaagaccatcccgattcagctctgtgggaccgctagagacaagttccag

SEQ ID NO: 166584 - DNA, 601 bp, Human
gataataaggcaaaagactgagtatcagtccactgccttattagaggtgggcctattccattagaggaggaattttgtgtatgtaggttttacttctttgaggattcttttgaaatagacacaaacaacaatatctcccaatgatcattctccccagtttctgtgttaattggtggattaatttaatgaaacgcatcaccatacatcccactgtggagggaactcagatgtcctcaaagctaccagaggttgtgcaggccacgggcacaactaggggtgaccacctagagttcaaaggagsctgtcttctgcctgggaacagggccatcctggggtttcttttaattactcagacccagttgagtcaccaccataacctgagggactgtgaggtgatcacctgcccttcaatgtgttcctattggaagaccatcccgattcagctctgtgggaccgctagagacaagttccagaactgtctggatccccctggagcgtagaggtgtgatagttttgctcagtaatacagctttgcccatttaggttctgacccaaagacctgtccttcaaacatgacttggttcctgtctactctatcttc

SEQ ID NO: 166585 - DNA, 601 bp, Human
ccaatacagcattcaatagattctagcccagcagtcttctgtcttgtgagacgggaagcgtcttgaaggtagggactattggatggatggatgaaaataataggcaaagtaccttaaactgttccccagcagtctggtgtagaactaaccctttgagatgtttctacaaggtggatgttttggctctatccactgcagctgctggtgtggcattgcctttcctccctaccctgccctaaatttccattgcatgggaccccagggtggttccttggaagctgtgatcagtcccatccctgarcagggaagcaaaactgataaagagcagatttcaatcacaagatgatggcaccagagccccttcttggcccaaccaccgcaggatcctgctgccaactggactccacaggcccttcaggtctctgcccatcaggaggaggctgaggacacgccaagccgaggaaaggtgacgctgcagggagaatgtaccttctgctcaattccaccttcctttcttcacttatgccccagacagccacaataagagctaacatttgttaagcacctactatgtgccaagaaatttcctattcatttcaca

SEQ ID NO: 166586 - DNA, 601 bp, Human
atacagcattcaatagattctagcccagcagtcttctgtcttgtgagacgggaagcgtcttgaaggtagggactattggatggatggatgaaaataataggcaaagtaccttaaactgttccccagcagtctggtgtagaactaaccctttgagatgtttctacaaggtggatgttttggctctatccactgcagctgctggtgtggcattgcctttcctccctaccctgccctaaatttccattgcatgggaccccagggtggttccttggaagctgtgatcagtcccatccctgagcarggaagcaaaactgataaagagcagatttcaatcacaagatgatggcaccagagccccttcttggcccaaccaccgcaggatcctgctgccaactggactccacaggcccttcaggtctctgcccatcaggaggaggctgaggacacgccaagccgaggaaaggtgacgctgcagggagaatgtaccttctgctcaattccaccttcctttcttcacttatgccccagacagccacaataagagctaacatttgttaagcacctactatgtgccaagaaatttcctattcatttcacattt

SEQ ID NO: 166587 - DNA, 601 bp, Human
ctctatccactgcagctgctggtgtggcattgcctttcctccctaccctgccctaaatttccattgcatgggaccccagggtggttccttggaagctgtgatcagtcccatccctgagcagggaagcaaaactgataaagagcagatttcaatcacaagatgatggcaccagagccccttcttggcccaaccaccgcaggatcctgctgccaactggactccacaggcccttcaggtctctgcccatcaggaggaggctgaggacacgccaagccgaggaaaggtgacgctgcagggagartgtaccttctgctcaattccaccttcctttcttcacttatgccccagacagccacaataagagctaacatttgttaagcacctactatgtgccaagaaatttcctattcatttcacatttatccttcataaaaccttgttaagttggcactatgattattcccattttacctgaatcacaggtatgatgttaagcctgaatcacaaagctagtatgaaacagaaacagaagagagcctgttcctgtagtcccctccccacctaggcaatggcaagggctccaaaatgaccctttcctact

SEQ ID NO: 166588 - DNA, 601 bp, Human
tgaatcacaaagctagtatgaaacagaaacagaagagagcctgttcctgtagtcccctccccacctaggcaatggcaagggctccaaaatgaccctttcctacttcatctaccacccccatcatgcatttcccccaagtagctgatgttgtctagttgctaagatatattcatctattgactcctgctaccatctaaaaaatcaggagcctgacccagtgcaatcaatcttatttgcatttcaagaagcaatctagcaatttagaattttagaaattccactataaagaggttgtttgccrggtgggatggggcggtggtaatggagctgcaaagtatataaaagaaacatgctttgtccacgcttatcagtcaaattctttctttctatccatccctggagagagagagggagaggaagcttcttccatgccacatggagacaaacgggcttcagacatcttctagtgaaagaccaacgtataggaagcatcatttgtggtggtttcacagattttttttattgttacgctttataatttatataattatacacatatccttttgtgtttaatactacatttaagaggataaaggaaaac

SEQ ID NO: 166589 - DNA, 601 bp, Human
gctggaaggtatttaaaagaaacttgtttcaccaaattctcatcaaccaaattctttctttcatctatctggagagagagagagacggagaagcttcttttgtgccagacagagatctatgagcttagggcatcttctagtgaaaggccaatgtataggaaacatcatttgttattttaatataaaaacctttctaatccctttttatagattgaataactctctctcttcagaagcccttatctaagataataaagagcatatttctcatgaaatatccttgttggagaaaagaaagtcyttgaggaggaaatatggaggctagaaacactacccaggttgtgagtgggctttttctttcttgtctcagggatctgtaagatcgagaagtttaacatgggtcaggtgtggtggctcacgcctgtaatctcaacattttgggaggtcgaggtggaaagatcacttaaactcaggagttcaagatcagcctaggcaacatggggagagtcaatctctacatcaaataaaaaaattagccaggcatggtggcacgggcctgtggtcccaactatttgggaggcttaggcacaagaattgcttg

SEQ ID NO: 166590 - DNA, 601 bp, Human
aatttcaatttctattaaaattcttacatggccacatatgctacctctcaggctttgggcctctgggcctgtgctaatttgcatgtctggtttagataatgtctgaggtccttccagtctaaaaaggagcctctgatgctgtgatataataagtgagatcacattccacctaccaagacttgatggttctttttcttttaactactgtgctctgtctgatgtgtggatgcacagctcagggacggaagtgtttcctgctcacctgccaggccacaaaagaaggagtgctcttggccgggcrtggtggctcacgcctgtaatcccagcactttgggaggctgaggtgagtggatcacctgaggtcaggagttcaagacaagcctggccaacatggtgaaaccccgtctctactaaaaatataaaaatcagccaggcatggtggcaggcgcctataataccagctactcaggaggctgaggcagaagaattgcttgaatccgggagacggaagttgcagtgagccgagattgcgccattgcactccagcctgggggacaagagcaagacttcgtctcaaaacaaaacaaacaaacaaacaaaa

SEQ ID NO: 166591 - DNA, 601 bp, Human
agtgagatcacattccacctaccaagacttgatggttctttttcttttaactactgtgctctgtctgatgtgtggatgcacagctcagggacggaagtgtttcctgctcacctgccaggccacaaaagaaggagtgctcttggccgggcgtggtggctcacgcctgtaatcccagcactttgggaggctgaggtgagtggatcacctgaggtcaggagttcaagacaagcctggccaacatggtgaaaccccgtctctactaaaaatataaaaatcagccaggcatggtggcaggcgcctrtaataccagctactcaggaggctgaggcagaagaattgcttgaatccgggagacggaagttgcagtgagccgagattgcgccattgcactccagcctgggggacaagagcaagacttcgtctcaaaacaaaacaaacaaacaaacaaaaagaagtagtgctccttcagcatgaactcacctgtccacttctgctacactgaacccagagacttgtcctttcctgcaaagcatttcagacataggtcaaaaggcaaatcatgggaattgttgggattttacgtttcttgatttgaatggcc

SEQ ID NO: 166592 - DNA, 601 bp, Human
ggcatggtggcaggcgcctataataccagctactcaggaggctgaggcagaagaattgcttgaatccgggagacggaagttgcagtgagccgagattgcgccattgcactccagcctgggggacaagagcaagacttcgtctcaaaacaaaacaaacaaacaaacaaaaagaagtagtgctccttcagcatgaactcacctgtccacttctgctacactgaacccagagacttgtcctttcctgcaaagcatttcagacataggtcaaaaggcaaatcatgggaattgttgggattttacrtttcttgatttgaatggccgttctaattcaacgtgaatccaagaccacagacttgacaatcacctgattcaaaatatgtgaaaagtacttgagtctttaaaatatggggttcatctcaccttttactattcctctcccaaacatcaaagagatgctgtcaagtttcttagctaactttgctatcctacaacataaagcaactctcatgcataaaaaactaattaaaaggaattggctttccagagggactttgagaccaatgtcagccaatctgtcacttttcaaaataaaattatggaa

SEQ ID NO: 166593 - DNA, 601 bp, Human
ttcaaaatatgtgaaaagtacttgagtctttaaaatatggggttcatctcaccttttactattcctctcccaaacatcaaagagatgctgtcaagtttcttagctaactttgctatcctacaacataaagcaactctcatgcataaaaaactaattaaaaggaattggctttccagagggactttgagaccaatgtcagccaatctgtcacttttcaaaataaaattatggaactatgtagagctctattttcataatgttagatcaagtctttgctcaaattctatattttcagagaagmcctcccatccctgcactgcctacttccctcctctggttttctcttcttcatagcattcatcgccttctaatatacaatgtaatttactacttgtcttgaatgtcagctccacagaggaaggacgtttgtctagcgattgttgtgttctcagcatgtaaagtgtctggcaaggtagtagacattcagtaaaacattgttgaatgaataaatgtgtggtgggacataaggcatcaattaaatccaataagttggtgatggcgaggggcaagaatgaatttttgagagaaacaaaggtgctta

SEQ ID NO: 166594 - DNA, 601 bp, Human
aaatatggggttcatctcaccttttactattcctctcccaaacatcaaagagatgctgtcaagtttcttagctaactttgctatcctacaacataaagcaactctcatgcataaaaaactaattaaaaggaattggctttccagagggactttgagaccaatgtcagccaatctgtcacttttcaaaataaaattatggaactatgtagagctctattttcataatgttagatcaagtctttgctcaaattctatattttcagagaagacctcccatccctgcactgcctacttccctccyctggttttctcttcttcatagcattcatcgccttctaatatacaatgtaatttactacttgtcttgaatgtcagctccacagaggaaggacgtttgtctagcgattgttgtgttctcagcatgtaaagtgtctggcaaggtagtagacattcagtaaaacattgttgaatgaataaatgtgtggtgggacataaggcatcaattaaatccaataagttggtgatggcgaggggcaagaatgaatttttgagagaaacaaaggtgcttaagatacaacccctcttcctaaagatgatcacc

SEQ ID NO: 166595 - DNA, 601 bp, Human
tcataatgttagatcaagtctttgctcaaattctatattttcagagaagacctcccatccctgcactgcctacttccctcctctggttttctcttcttcatagcattcatcgccttctaatatacaatgtaatttactacttgtcttgaatgtcagctccacagaggaaggacgtttgtctagcgattgttgtgttctcagcatgtaaagtgtctggcaaggtagtagacattcagtaaaacattgttgaatgaataaatgtgtggtgggacataaggcatcaattaaatccaataagttsgtgatggcgaggggcaagaatgaatttttgagagaaacaaaggtgcttaagatacaacccctcttcctaaagatgatcacctagcgagggacacaagcgtacaaagaattacactcaaaggctaagcaggacacgggcagtagacacaagacaattcaccagtgagccttgacctgcagaactttgaaagcaaaggacacagaagctgaatgttacgcagacccaagagtgtatcccctatggccaaggagaagaagggcaacctcgctgtgaacattgcaacctatgagggtcggagca

SEQ ID NO: 166596 - DNA, 601 bp, Human
gctccacagaggaaggacgtttgtctagcgattgttgtgttctcagcatgtaaagtgtctggcaaggtagtagacattcagtaaaacattgttgaatgaataaatgtgtggtgggacataaggcatcaattaaatccaataagttggtgatggcgaggggcaagaatgaatttttgagagaaacaaaggtgcttaagatacaacccctcttcctaaagatgatcacctagcgagggacacaagcgtacaaagaattacactcaaaggctaagcaggacacgggcagtagacacaagacaaytcaccagtgagccttgacctgcagaactttgaaagcaaaggacacagaagctgaatgttacgcagacccaagagtgtatcccctatggccaaggagaagaagggcaacctcgctgtgaacattgcaacctatgagggtcggagcagggcagagggcgttgcgtataaactgcctctcatttatcctcaagcctgattacctaagtgaactgttatgttttcttctttctacctggaatcctcttaaaccagaggcagatttgacctaagaagtatgcaatttagttgcgtctacatgacc

SEQ ID NO: 166597 - DNA, 601 bp, Human
gtgatggcgaggggcaagaatgaatttttgagagaaacaaaggtgcttaagatacaacccctcttcctaaagatgatcacctagcgagggacacaagcgtacaaagaattacactcaaaggctaagcaggacacgggcagtagacacaagacaattcaccagtgagccttgacctgcagaactttgaaagcaaaggacacagaagctgaatgttacgcagacccaagagtgtatcccctatggccaaggagaagaagggcaacctcgctgtgaacattgcaacctatgagggtcggagcasggcagagggcgttgcgtataaactgcctctcatttatcctcaagcctgattacctaagtgaactgttatgttttcttctttctacctggaatcctcttaaaccagaggcagatttgacctaagaagtatgcaatttagttgcgtctacatgacccaatatggaaggaagttttggcaaacacccagttaatctagtcagtatgaattgctattccacatgaggctggctcaaaaatcccactttgaggccttatcaaaataaataggtcatttagacatctgtgtcacttagacacagag

SEQ ID NO: 166598 - DNA, 601 bp, Human
tacaacccctcttcctaaagatgatcacctagcgagggacacaagcgtacaaagaattacactcaaaggctaagcaggacacgggcagtagacacaagacaattcaccagtgagccttgacctgcagaactttgaaagcaaaggacacagaagctgaatgttacgcagacccaagagtgtatcccctatggccaaggagaagaagggcaacctcgctgtgaacattgcaacctatgagggtcggagcagggcagagggcgttgcgtataaactgcctctcatttatcctcaagcctgattrcctaagtgaactgttatgttttcttctttctacctggaatcctcttaaaccagaggcagatttgacctaagaagtatgcaatttagttgcgtctacatgacccaatatggaaggaagttttggcaaacacccagttaatctagtcagtatgaattgctattccacatgaggctggctcaaaaatcccactttgaggccttatcaaaataaataggtcatttagacatctgtgtcacttagacacagagcctgtgggagaaatgaaatagaagaaggtcccaggttcagcagggagcctca

SEQ ID NO: 166599 - DNA, 601 bp, Human
cacaagacaattcaccagtgagccttgacctgcagaactttgaaagcaaaggacacagaagctgaatgttacgcagacccaagagtgtatcccctatggccaaggagaagaagggcaacctcgctgtgaacattgcaacctatgagggtcggagcagggcagagggcgttgcgtataaactgcctctcatttatcctcaagcctgattacctaagtgaactgttatgttttcttctttctacctggaatcctcttaaaccagaggcagatttgacctaagaagtatgcaatttagttgcgyctacatgacccaatatggaaggaagttttggcaaacacccagttaatctagtcagtatgaattgctattccacatgaggctggctcaaaaatcccactttgaggccttatcaaaataaataggtcatttagacatctgtgtcacttagacacagagcctgtgggagaaatgaaatagaagaaggtcccaggttcagcagggagcctcacgtggccatggcaaggctgtgcccagagaatgtgccacttcactctccacgcttttcatatttaaaagtcagctatttcttccaagcctttt

SEQ ID NO: 166600 - DNA, 601 bp, Human
ctgattacctaagtgaactgttatgttttcttctttctacctggaatcctcttaaaccagaggcagatttgacctaagaagtatgcaatttagttgcgtctacatgacccaatatggaaggaagttttggcaaacacccagttaatctagtcagtatgaattgctattccacatgaggctggctcaaaaatcccactttgaggccttatcaaaataaataggtcatttagacatctgtgtcacttagacacagagcctgtgggagaaatgaaatagaagaaggtcccaggttcagcagggagcctcacgtggccatggcaaggctgtgcccagagaatgtgccacttcactctccacgcttttcatatttaaaagtcagctatttcttccaagccttttcctcgtaggtctttttttccctttgcccatctaatatcttcaacagtacctccattatgctccacacagcagggtcagctccgaggcagaggggctgttggattccaggacaagatccttgagcaaaggaaacctgatccaggatgttttttccctgtgagttccaagtttggggaaagcgttccctggatattttcctcct

SEQ ID NO: 166601 - DNA, 601 bp, Human
tttttccctgtgagttccaagtttggggaaagcgttccctggatattttcctccttccaaggtctcagtggatgccaagctcctctgttgctctttgggatgtaagacgccgctgaagtgaaggtttaatagcccctctagaatggtgggatgtagtgaggacttggtcctgagcttcaaggccaggtggccagtgactctggcacctgacagtgggggaggaaggaggatgctgggtaatgcctgggcctaacagccaggcagaccacctgtagccatcagccctctctgtcttctgggrtggggtttctcaaaccagggtccaggataataatccacctcttcttttaaaagaaagccacgatttattttattatattattattattattattattttttttttttttttgctttggagacaggatctcactttgtcacccaggctggagtacaatagtgtaatcatagctcactgcagccttaaactcctggcctcaagtgttcctcccaccttggcctcccaaagtgctgggattacagccctgagccaccacacccagcctgagagccaagctttatttaaatttgggaatcactg

SEQ ID NO: 166602 - DNA, 601 bp, Human
tgggatgtaagacgccgctgaagtgaaggtttaatagcccctctagaatggtgggatgtagtgaggacttggtcctgagcttcaaggccaggtggccagtgactctggcacctgacagtgggggaggaaggaggatgctgggtaatgcctgggcctaacagccaggcagaccacctgtagccatcagccctctctgtcttctgggatggggtttctcaaaccagggtccaggataataatccacctcttcttttaaaagaaagccacgatttattttattatattattattattattattwttttttttttttttttgctttggagacaggatctcactttgtcacccaggctggagtacaatagtgtaatcatagctcactgcagccttaaactcctggcctcaagtgttcctcccaccttggcctcccaaagtgctgggattacagccctgagccaccacacccagcctgagagccaagctttatttaaatttgggaatcactgttccaggagcacaggaataaaactgtccttcatcctttatagccctcaggcttctcttccttttcaaggccttcctcaatgggcttggtaatctc

SEQ ID NO: 166603 - DNA, 601 bp, Human
gatgtaagacgccgctgaagtgaaggtttaatagcccctctagaatggtgggatgtagtgaggacttggtcctgagcttcaaggccaggtggccagtgactctggcacctgacagtgggggaggaaggaggatgctgggtaatgcctgggcctaacagccaggcagaccacctgtagccatcagccctctctgtcttctgggatggggtttctcaaaccagggtccaggataataatccacctcttcttttaaaagaaagccacgatttattttattatattattattattattattattwtttttttttttttgctttggagacaggatctcactttgtcacccaggctggagtacaatagtgtaatcatagctcactgcagccttaaactcctggcctcaagtgttcctcccaccttggcctcccaaagtgctgggattacagccctgagccaccacacccagcctgagagccaagctttatttaaatttgggaatcactgttccaggagcacaggaataaaactgtccttcatcctttatagccctcaggcttctcttccttttcaaggccttcctcaatgggcttggtaatctcatc

SEQ ID NO: 166604 - DNA, 601 bp, Human
gcccaccagagagaaaggataccttcgtgatgacatcctaagccctgcatctactttgcctcagggtggggctgagagcgcggactcgagcaaagactgcagcagatgagaagctggtcctgagctgtgggttgggaaggttcgggcagtgcagcagttctcacaggtggagagcaggatgaaggaacgcttagaggagagcagcttctgcaggttggtggctgggagaggctgctcctccccaaagactggacctattagaagcacaggacctctgatggagatggggttttagaggatytcctagtccagccctctaccagtacacgtcataacctgtcggacagcccaacaacaaagaccgccgctcacctgcagtttcttccctgtcggagtctgggagtgaatcttcctcctcgtgggcttggctctcttgggaagttgagggctttgggtctcaggtctgccattgatttgagcatttctcctgtgcatcctcactctttcaagaaaggaggtctggatctggctaccaaatccccctgctctgctgggagcatgagcagccttgcccattgctcggctgaaaggtctgcattca

SEQ ID NO: 166605 - DNA, 601 bp, Human
acctgcagtttcttccctgtcggagtctgggagtgaatcttcctcctcgtgggcttggctctcttgggaagttgagggctttgggtctcaggtctgccattgatttgagcatttctcctgtgcatcctcactctttcaagaaaggaggtctggatctggctaccaaatccccctgctctgctgggagcatgagcagccttgcccattgctcggctgaaaggtctgcattcagaagccaggctttccaaggataaacagggttaggtgctgccagccttcttagcagcaaccagaaattcawtgagaagtttcagggaaaattcatctttttccacccagtcattgagagcaaggttttatgacacagaggatgaagagagaggcttttgtgggctgatgtcgctgtgttgctggcctccggtcaggtcacaaggtggagcgctgcatgccggcagggacgtttgggctttcagacagcagaggcatcagagcagaagcaaatatcttcccaaagatgtttggccatatttctaggaccaggttaaaagcttcacacagaagctaagttaacattggtatgtctatgagagggtcatgtcca

SEQ ID NO: 166606 - DNA, 601 bp, Human
tgtgcatcctcactctttcaagaaaggaggtctggatctggctaccaaatccccctgctctgctgggagcatgagcagccttgcccattgctcggctgaaaggtctgcattcagaagccaggctttccaaggataaacagggttaggtgctgccagccttcttagcagcaaccagaaattcaatgagaagtttcagggaaaattcatctttttccacccagtcattgagagcaaggttttatgacacagaggatgaagagagaggcttttgtgggctgatgtcgctgtgttgctggcctcyggtcaggtcacaaggtggagcgctgcatgccggcagggacgtttgggctttcagacagcagaggcatcagagcagaagcaaatatcttcccaaagatgtttggccatatttctaggaccaggttaaaagcttcacacagaagctaagttaacattggtatgtctatgagagggtcatgtccagaaacagctttcgccttccaacagagactttgcggaaaaaaatctccatgctcatatttctctacctcaggaggctctcctggaatctaagaggccatttagtgtcaaattcagcccc

SEQ ID NO: 166607 - DNA, 601 bp, Human
aagtttattcattcaacaaatacttagagtctactaactctgtgtggggccctgttctaagtgcttggatgtatcagagaacacaacagagatccctactcttatggacctgatgttcaggagggagggggatatgaaccataaacgacaaatacaaattaattactgattaaattatgtgataagtgaaaatggaagagcagaggaaggaggatgagggagttgcggggaggagggaattaatgtggatttggaaggctgcccaacatgtttctgggtctgaatatttttggtctgtgamacaaatcgtattcttgattgctaacatccactgaggccacctctgtgctgggcactatgctgggtgtttacttgggtatctcatttactctgcaaggctggcctggttcttcatacccctagggcagaatgcaagactttagttcttggccttctgcatcttcatgctttttctttggagcagaaattgctctgaaaatgctgggtttaacttaaatcttacattgaccagacgtctcctcgagccccagagcctacggagtgcttttgttaaaccccagagccaatgtgctcaggctgt

SEQ ID NO: 166608 - DNA, 601 bp, Human
gggaattaatgtggatttggaaggctgcccaacatgtttctgggtctgaatatttttggtctgtgacacaaatcgtattcttgattgctaacatccactgaggccacctctgtgctgggcactatgctgggtgtttacttgggtatctcatttactctgcaaggctggcctggttcttcatacccctagggcagaatgcaagactttagttcttggccttctgcatcttcatgctttttctttggagcagaaattgctctgaaaatgctgggtttaacttaaatcttacattgaccagacrtctcctcgagccccagagcctacggagtgcttttgttaaaccccagagccaatgtgctcaggctgtcctttgtgcagccaggtaccagtgggaagattttccatgcaaatacttgggaataaaaaagaaatgagagggaggcctgtggtctttgctactctgactccacaggctgctgggatggacgttggatgaagacaccagcttagggcatggcctgttgctatttatgactctattacttcacagtgagagcacagttcaggctgactgctgggtggcctctgtgtttctgtcact

SEQ ID NO: 166609 - DNA, 601 bp, Human
ttttccatgcaaatacttgggaataaaaaagaaatgagagggaggcctgtggtctttgctactctgactccacaggctgctgggatggacgttggatgaagacaccagcttagggcatggcctgttgctatttatgactctattacttcacagtgagagcacagttcaggctgactgctgggtggcctctgtgtttctgtcacttcctttttcacctatgtgaggactgtagcattgattgggacttccaaagtcctgttagccaagcttctgccatcagatgggcctgtgggcacattgmcccataaaactctgcctccttcctaaggccctggggcaccacagaaagatgggcctgccaagccactgctctgataaggcatgcctttaaccaggctccatcactcagagctacaggaaaatcccatggtcatccgccctctgttggtgacagggaattccatcatgcattcagatttttgcatgcctgctctgtccctggaactagaataagagaatagggagaaaagccgataagaagtcaacgataactatagccatggccataatttgggctccaaaagaaataattctgagtggt

SEQ ID NO: 166610 - DNA, 601 bp, Human
tggttaccagatagctttcagagagggttgaagccttcagtagactaatgattgagcagaaaaaaatgtttagaaaacttgagacagattttatccatgcagtaagtcagaagtcaagtcagaagttcagatgacatgtacgattcctggaatttagtgattttttgtttgaatgtgttacttctcttctactttctgttctgctcccactagaattatctccttcccccaggccctcagatccaccccacataccacaagctcattcttcaccacaccctgttttctagcatggctgcamgcgcaaaacctcccttagttcccacctgcaacgccaaggtcccagagtttgctgagctaccatcagcaagaccttgaacatgcctcggccctctctcctctccctccacattgctctacttcagtggtacagctcctcccatggctgtctctagacctcaccttgacatctcaccacccacctctgccttgttcctacctgatgcactctcccctctccaaagagtcacctggccctagttccactcacctctctgtcaacctccaggaaccctttatgtgtcctccatgccttaggcac

SEQ ID NO: 166611 - DNA, 601 bp, Human
cagaaaaaaatgtttagaaaacttgagacagattttatccatgcagtaagtcagaagtcaagtcagaagttcagatgacatgtacgattcctggaatttagtgattttttgtttgaatgtgttacttctcttctactttctgttctgctcccactagaattatctccttcccccaggccctcagatccaccccacataccacaagctcattcttcaccacaccctgttttctagcatggctgcaagcgcaaaacctcccttagttcccacctgcaacgccaaggtcccagagtttgctgarctaccatcagcaagaccttgaacatgcctcggccctctctcctctccctccacattgctctacttcagtggtacagctcctcccatggctgtctctagacctcaccttgacatctcaccacccacctctgccttgttcctacctgatgcactctcccctctccaaagagtcacctggccctagttccactcacctctctgtcaacctccaggaaccctttatgtgtcctccatgccttaggcacatgacccgtgtttcctcacaatcacagttaccctctcatactcacatgcaaggacg

SEQ ID NO: 166612 - DNA, 601 bp, Human
tgtcaggaagagaacttgaaccaatcctctgacttcacattcagggttcttcccattactttggctcccagataagactacaatcttctgaaagtcagagtgttaatattccaaccccagggggtgagtacacttccagaatttagggatgctttaaaagccattgctgaattgaattttatttctcctgatcactacagataatgctcatgcaacttttctgagaagcaggcgatgctaatgtacccctatttgttattgttcattagacccttcttatgactcagtcagaagaggagcwtggggcaataacatgaattctggcctcaacaaaagtaagtaaatgttttatagttctttggaggaaagcatgtttctgaggacaggattggagaacaggatcatgagacacaggagagcagcaagcatttgtttccctgctttttgagtagacatcaaaattatttgccaatttagggcctttccatgataccagtccttgaaagatgatatgggattttcgtttagatttttgagttttgttttattgcgctcggttttagaacatgggaaatttgaaggttttcttgagacaaggttc

SEQ ID NO: 166613 - DNA, 601 bp, Human
tccaaccccagggggtgagtacacttccagaatttagggatgctttaaaagccattgctgaattgaattttatttctcctgatcactacagataatgctcatgcaacttttctgagaagcaggcgatgctaatgtacccctatttgttattgttcattagacccttcttatgactcagtcagaagaggagcttggggcaataacatgaattctggcctcaacaaaagtaagtaaatgttttatagttctttggaggaaagcatgtttctgaggacaggattggagaacaggatcatgagayacaggagagcagcaagcatttgtttccctgctttttgagtagacatcaaaattatttgccaatttagggcctttccatgataccagtccttgaaagatgatatgggattttcgtttagatttttgagttttgttttattgcgctcggttttagaacatgggaaatttgaaggttttcttgagacaaggttctgtaccaatgaatggtcactgtcactgggttttgcttttgttatttaaatcaagataatgactcgctataattttgctcccgtaactgttgaggctaagtcgtaccaat

SEQ ID NO: 166614 - DNA, 601 bp, Human
aaagcatgtttctgaggacaggattggagaacaggatcatgagacacaggagagcagcaagcatttgtttccctgctttttgagtagacatcaaaattatttgccaatttagggcctttccatgataccagtccttgaaagatgatatgggattttcgtttagatttttgagttttgttttattgcgctcggttttagaacatgggaaatttgaaggttttcttgagacaaggttctgtaccaatgaatggtcactgtcactgggttttgcttttgttatttaaatcaagataatgactckctataattttgctcccgtaactgttgaggctaagtcgtaccaatttccccattccccttgatactgggtagatttcctcatatcatcatctcaccacttggtggagaaattgatgtctcagaaccctgccatctcctcaacaggttatcttctgtccctgatgaggagatgccggggggtctgggacatcaggttctccaccaagtggtgagatgatgacatgtcgaagtctacccaatatcccccagtaagagaataaggggcaagaatgactcatgaactcctgtaccagaaatcaaa

SEQ ID NO: 166615 - DNA, 601 bp, Human
aagtggtgagatgatgacatgtcgaagtctacccaatatcccccagtaagagaataaggggcaagaatgactcatgaactcctgtaccagaaatcaaacttgccatgcctaggaagcaaaatatgaagcacatgaacaggtggtaaagggaattctttcaagaaagaggttggggttacaaattaatgcccaaacaataaccaagaccccttccaattatgtgtattaattatttacttactctgcacatgacatttggcaatataagattcacaaagatgaatcagacatgcactggtcycataagcgggagagagaaatcaagcacacacagaactcctttcttctggttggtatcaaggaaggctttgtggacctggtagcacttgagttagctctggaaggagaggcaggatttggacctgtggcgatatgggctggggaagacatgagcttggcatgtctgacagtcagtgaggacctcaggttcctggagcttaggatgtgtgatgcagaagaagtctggaaaggtaagaaacagaattgtaaatgatgctatgaagatatgccttagttctttaggcaatgaagagtcactaag

SEQ ID NO: 166616 - DNA, 601 bp, Human
aaggacttctctaactttccgatttgaaaatgaaatccacagcctcagtaccatcagtgatgctatactgttagtttactttttaaaaatttgaaaatgaaaaggtgacatttaagcaaagacaaaattttaagaatttaaaaatgtgtttattattgtctctcccattggaatgcgagttctaccaggaactgcttgttcattcctgaatctccagcctggagaacagggccagcacatagtagattctaggtaaatgtttctaaaataagatgaataaatgagtcagtggagagtgggygaaggaatgagtgagaaagcacatctgtcaagacgtcttgctcccctcggggagctgggtcctactcactgcatttctttccctcttgccacaggtcctccccttggaggggcacaaacgatcagtaagaatacagagcaacggccccagccaggtacctgcccaggatatgtaatctctcctttgcttcctgcacagttgttgatttcacatggtcaactgatggagggtttaaacaatataccacatatgttttctcttatttctctcaaagagggtctatctttgaccctaatagtc

SEQ ID NO: 166617 - DNA, 601 bp, Human
ctcctttgcttcctgcacagttgttgatttcacatggtcaactgatggagggtttaaacaatataccacatatgttttctcttatttctctcaaagagggtctatctttgaccctaatagtcctgtgaatgaagtaacaggtactgacatcaagtagagacttgttaaatatcaaaggtgaaagaacttgaagatgaactattccaatgctttattttgttcaataaagaaactgaggcccggggaggtgaagtgacttgctaaaaaccatacagctggttaatgaaagaaatagggctayaatcccagatcccccaaattcctgtccaagccttttatgcttcaccaaaccttactttcagaaatatccccatcctgtgatgagttggcttaacaattaaggcagaggaactttgaaagccatggacctggagactccgtattggagaggaacttggagatttctgggtctatcctaccctcacctctaccttacttgtgcttgtagtaaaacagggcgttgactttctagctgggctcagttccactatctgacccaaagtctgcctcctggaatttccactcaagcttttccttctgg

SEQ ID NO: 166618 - DNA, 601 bp, Human
aagactttttcatggctaaataaacacatacgttttgaggaaagtgagattttaagaatagtcattttatagctaaaatgtacactctggtttgtgctgacatttctggcttgtgtgacatttcaaatcacagagtgttatactagaagaaaactgaggaatccagtagcccaacccactcatttgtcagatgagaaaactgattcccagaaattgtccaacaagttatttgtttatcacatagctgctgctaaaacccaggctgcttggtttctaggcatgtgtttttcatgctacattyaaaaaaaaaacagattaataatgttgttagtattaggtagagttattaaagaccagtaaccatgagacctgctttaagcccatggagtcagctgtccgttgtatcattgaatattatccagttcctttccaaatgttttctttgttttgctttgggtaatgacaacataatctgcacattttagatgccaaaataagaaaaagtaatcctgttcctattctttgttctttctgtaattattgagatgaagaccacaaatgtcatcaagatctttgagatctgcaaataaaagcagtaaag

SEQ ID NO: 166619 - DNA, 601 bp, Human
taaaagcagtaaagttttctgaaatcagtctttcctgtgatcttgaaataaaagtataaacccttatggttttcttatggttggtacggttgtcatattttttaaaaacactgaagcaaatttccttttttatttccttagatccgtatcagatcctgggcccgaccagcagtcgcctagccaaccctggtgagtttaccttggcctgcaagccttttttgccagaatgtttcgtagctttgtgaaatcacagagacttctgtcctaagtccagacacctgagtggggagtaacatgcacstctttccttgaaatgttcaatgtctgtttctggagcatgtgaacaacaggtcagggcttgttatgaggtgtcaaggttggttagctgaggatacttctaggaataaacacatcagcactgcacatgtgcacttaggtgtagatgagtaataagtggcacaggtaggtaggcgtttcaatcagagaaaatgggcaagaaagagaagaagacaactccactcagctctcagttgtctcccacatgccaggcacaagttcataaatattccaaagggttttatttgtgattttagaaagtgtt

SEQ ID NO: 166620 - DNA, 601 bp, Human
ggcctgcaagccttttttgccagaatgtttcgtagctttgtgaaatcacagagacttctgtcctaagtccagacacctgagtggggagtaacatgcacctctttccttgaaatgttcaatgtctgtttctggagcatgtgaacaacaggtcagggcttgttatgaggtgtcaaggttggttagctgaggatacttctaggaataaacacatcagcactgcacatgtgcacttaggtgtagatgagtaataagtggcacaggtaggtaggcgtttcaatcagagaaaatgggcaagaaagaraagaagacaactccactcagctctcagttgtctcccacatgccaggcacaagttcataaatattccaaagggttttatttgtgattttagaaagtgttgccaagttatctggccttataaaagagatgtgtcctggaaaagttgcagatatagtcaatttgaccttgtactttaaagatttagtatcaaaaataactctcaagagggtccttctaaaccaagtccatcgagattgggagctagcaggcccttgtcgcagtgtggcccactcaccttcccatcccagggactctgcctacc

SEQ ID NO: 166621 - DNA, 601 bp, Human
ttgtgaaatcacagagacttctgtcctaagtccagacacctgagtggggagtaacatgcacctctttccttgaaatgttcaatgtctgtttctggagcatgtgaacaacaggtcagggcttgttatgaggtgtcaaggttggttagctgaggatacttctaggaataaacacatcagcactgcacatgtgcacttaggtgtagatgagtaataagtggcacaggtaggtaggcgtttcaatcagagaaaatgggcaagaaagagaagaagacaactccactcagctctcagttgtctcccrcatgccaggcacaagttcataaatattccaaagggttttatttgtgattttagaaagtgttgccaagttatctggccttataaaagagatgtgtcctggaaaagttgcagatatagtcaatttgaccttgtactttaaagatttagtatcaaaaataactctcaagagggtccttctaaaccaagtccatcgagattgggagctagcaggcccttgtcgcagtgtggcccactcaccttcccatcccagggactctgcctacccattccttagtgcctggtcattactgccagaggagaa

SEQ ID NO: 166622 - DNA, 601 bp, Human
acttaggtgtagatgagtaataagtggcacaggtaggtaggcgtttcaatcagagaaaatgggcaagaaagagaagaagacaactccactcagctctcagttgtctcccacatgccaggcacaagttcataaatattccaaagggttttatttgtgattttagaaagtgttgccaagttatctggccttataaaagagatgtgtcctggaaaagttgcagatatagtcaatttgaccttgtactttaaagatttagtatcaaaaataactctcaagagggtccttctaaaccaagtccatygagattgggagctagcaggcccttgtcgcagtgtggcccactcaccttcccatcccagggactctgcctacccattccttagtgcctggtcattactgccagaggagaaagcagccacccagcatattctgggtatttttctctctgcacaagttctctgtagaacttagagctgcaagccaagctctgggcctgccaagggccaatccaggtcctgtccatccaaaagctaaagctcatggcgcagcttctcccaatgactcccacagtcatgccttgcccctgactttttattgctga

SEQ ID NO: 166623 - DNA, 601 bp, Human
caaaccttgcagaccatgagagcaattagaggtcacataatctgagtgttaactaattcttcattgaatgactagtaatggatacccctcttggccttccactgaaaaatgaatccagacttgtttgtggatgtttttattcacttcaattaaatatttcaaacccagaatttataaaggaacctaaatttgaggcttactgtgattctaccttaacaatgctggatattatttcttcttcctgaaaccattcttacctgtgaaatacccagaacataaatatgtaaattttcacttttcyctccatagacagattggaggtattagatttgagacactgatcatgtaaggcccagttttattctttggagaaataatcttttttatttaaatgaaaaataaaactcagctgtctatgaagacaacatctacttgtcataactaagtcctagttagaacaatctatggcttttcttcctaagttaacattcccaattattttgagacttgaagatttaactactaactgatctcattcaacattcagtttcattttgctcttgtaaatacaaccatcatcttgtctgtttcatgctgtttg

SEQ ID NO: 166624 - DNA, 601 bp, Human
agatatataacctactacagatataggctatatggaacagcccatgtctcctaggctagaaacctgtccagcatattactgttctgagtactgcaggcacatgtaacacaatggtgagtattaagtgtatctaaatataagaaaggtacattaaaaatactgtattacagtattatgaaacctttgtcatgcatgcgcttcactgtaccaaaacattattatgcagcatgactgcaatttagaaaataaatgcatgggtttcttctgcttttataactgatcatattctatttctataacygagttaccatagagagactggatcccttgtacatcgtcatcaggaagcataaagtggcttttgccggtgtaggtgtagataggaaacatgagtgctccagggtccttggagtggtcaagacctaaggagtggccgaactcatgcgcagcaacaagaaacaagttgtagcctgtaagaaaacaaagaaacaatgagaaaaaaaggaattccagtgaccaggtaatgaaaggaatatcattttatctatctggtatgtttctttcttggctatatactttcttttctctttcttcagtctcc

SEQ ID NO: 166625 - DNA, 601 bp, Human
aacaacagggatacattctgaaaaatgtgttgttaggagattttgtcattgggtgaatattgtagcgtgtacttacacaaacctagatatataacctactacagatataggctatatggaacagcccatgtctcctaggctagaaacctgtccagcatattactgttctgagtactgcaggcacatgtaacacaatggtgagtattaagtgtatctaaatataagaaaggtacattaaaaatactgtattacagtattatgaaacctttgtcatgcatgcgcttcactgtaccaaaacatyattatgcagcatgactgcaatttagaaaataaatgcatgggtttcttctgcttttataactgatcatattctatttctataaccgagttaccatagagagactggatcccttgtacatcgtcatcaggaagcataaagtggcttttgccggtgtaggtgtagataggaaacatgagtgctccagggtccttggagtggtcaagacctaaggagtggccgaactcatgcgcagcaacaagaaacaagttgtagcctgtaagaaaacaaagaaacaatgagaaaaaaaggaattccagtgac

SEQ ID NO: 166626 - DNA, 601 bp, Human
caagtaccgtgtaatcttacttccttcctcccctccacttccatccttcaagacctctcgagattctttagaagtataaacttaggtttcttgaggttgatgataaaaaggagggaaaaaagcaacagaatttgagaaattttccctacaccttgcacaatctattgacagattgctcttgaaaactagattccccttaaagccatttttgatggcgtatttttcctgcaaaagccctcatcttgcctcctcctcttgactattttaccagctgtcaacatcagctaatgttgcttcaccrgtttgccatggtgcagctgtatctcagctgtgacaaaccaggccttcagcacttatgtgacttgcgacatgttggtaaatttccaaccgtctcccatgagtgcagacaggatgggggtgcagtatataataataataatcctacactgtttttctttctgtctagtttttattagttctttcatcagtccctgagtcataacaatgtagaaataataattgcaaaataaatttgcaaattccctttgccatcttcaagttcatgcccatggctatgctagctactgtgatagattgaaat

SEQ ID NO: 166627 - DNA, 601 bp, Human
atcaatgaatgaatgaataaacaagcatactggaacagtgtagaaattaaaattttatattgcatttctgggttcatttcatttcatccctcaaattccaacatgtatctagaatcaaagtctttccataccaaaacgaatccgtgtgggcctaacgagtaaccatttattaatacagcagttactttcaatgcttgtctgtttttaaaacaaatgggatttctagattttcttggttatatttataagaaagactgtaactagagatgtaaaaggaagctacacaatgtcaaggttataygttgaaaagtaaaacatttatccatcagtcatttatttgatctgaaatatgtaaataaactgcctgcccatttttactgctaacttcgcctttggaagtctgacaggatgttttggcaatatgcagaagcagcttcacagatgtttgtcgcatacagactttatgaaagaatctcaagagtacctgtctttaaagatcattgtttctcctcggagactggtaatggcatcaagggataaggaagggtcacatttgtctggcgtttttggatgtttagggttggggtcttcatctcctgga

SEQ ID NO: 166628 - DNA, 601 bp, Human
tgatcattttactgaatctctagtggcatcaaattcagcactgcctcccctggtcttgtgtgaggactcctctgtggaaagcttacctctgaagatgaagatgaggtcatgagaagggtgctcatatgcagcatcaatacggttgggaagttctggccaaaatgatttcgttaaaaacagctccgcatcaacctgctgaggatgcaggcgccagaagaatctaacacaaaagtaaaatggagttttctgtcacatttttaaatgcaatatttctatcctgctagtcacctctctccacatsaacacagacaagttagatacaaccaatacctcccacctgtgaagggaaaaaaaattccattaccctttaagcgccagtgacaagttgtgctatcctaactagcgtaaggtattcaactttgaaatctcacagagcctgtgtgaggtctctgagttctttgcaggttgaaacagtcttgctcaattttgggtatcttgccaggggcaagcaaatgtgccaggcattgtgttggcctccagagagaagatatgagttatatgaactatgtcttccatggtctcatggcctgggaaaacatac

SEQ ID NO: 166629 - DNA, 601 bp, Human
gcaatttggaaattggtcataattttatgtcaaggaaagcagtagaatataaaaatgtatctatactatgaaaataaatatgtaaaaatttgtattacataatgaaaatgagcaaatgaaataaactgagttttcagaaggaagaatgattcataatattttttccactttttcagaatatattggtataatgttttctcaataaacaatttttaagcagaactaagagaaaaaactgacatgattcatatgaaagaaagagtggatatgacaagactaataatgtagaccttttatatgytcaatttggagattcatggtagaatggtttcaggtactttctggcttccatttttttaatacttggtctttaatttaggtatattttcagtagtgatcattttactgaatctctagtggcatcaaattcagcactgcctcccctggtcttgtgtgaggactcctctgtggaaagcttacctctgaagatgaagatgaggtcatgagaagggtgctcatatgcagcatcaatacggttgggaagttctggccaaaatgatttcgttaaaaacagctccgcatcaacctgctgaggatgcag

SEQ ID NO: 166630 - DNA, 601 bp, Human
ttttattctctaaaaagtagctttattataacattaatattataaatagttgaacaatacaaacagtgtcagcaggaagttatgtaatcattttaaattatggtcataaagataaagtagcaatttggaaattggtcataattttatgtcaaggaaagcagtagaatataaaaatgtatctatactatgaaaataaatatgtaaaaatttgtattacataatgaaaatgagcaaatgaaataaactgagttttcagaaggaagaatgattcataatattttttccactttttcagaatatrttggtataatgttttctcaataaacaatttttaagcagaactaagagaaaaaactgacatgattcatatgaaagaaagagtggatatgacaagactaataatgtagaccttttatatgttcaatttggagattcatggtagaatggtttcaggtactttctggcttccatttttttaatacttggtctttaatttaggtatattttcagtagtgatcattttactgaatctctagtggcatcaaattcagcactgcctcccctggtcttgtgtgaggactcctctgtggaaagcttacct

SEQ ID NO: 166631 - DNA, 601 bp, Human
aaagagaaggtgccaattgggtgtggtggctcacgactgtaattccaccattttgggaggctgaggcaggtggattgctggaagccaggagcctgaccagtgtggcaaaaccccgtctctactaaaaatacaaaaattagttgggtgtagtggcacatgcctgtaatcccagcttcttgggagactgagacacaagacatgagaattgcttcaatacaggaggcagaggttacagtgagccaagatcatgccactacactcaagcctggataacagagcaagactcagtctcaaaaaaaaagaaagaaagagggggtgccaaagatggttgagaggcacaacaaatggctaagaaaagaatgtttgagaagaggaatgtttgagtattgtgtgtgtgtgtgtgtgtgtgtgtgtgtgtgtgtgtgtgtgttcaagagagcttgagacttttaaatacatgtctgagggtctgcctgaaagagctgacatggaatgaaaatgaatgactagtatgacatttacaatagtgtgtaggaataatgtatagtagtgacagatgtttgaggcactttgcggctatgacacagatgggtcagtacct

SEQ ID NO: 166632 - DNA, 601 bp, Human
aaactatgggcctgtcagcttcctggtcaacctctccagtggatcagctaactctgcagataggagggccttctctaaaccaatcttttcctgtactcatgctggtatcctctttggccacggaagatggagctacatgtaaattaggagaaagtgacaagaaagagaatacaggagaaagattagaaagagaaggtgccaattgggtgtggtggctcacgactgtaattccaccattttgggaggctgaggcaggtggattgctggaagccaggagcctgaccagtgtggcaaaaccccrtctctactaaaaatacaaaaattagttgggtgtagtggcacatgcctgtaatcccagcttcttgggagactgagacacaagacatgagaattgcttcaatacaggaggcagaggttacagtgagccaagatcatgccactacactcaagcctggataacagagcaagactcagtctcaaaaaaaaagaaagaaagagggggtgccaaagatggttgagaggcacaacaaatggctaagaaaagaatgtttgagaagaggaatgtttgagtattgtgtgtgtgtgtgtgtgtgtgtgtgtg

SEQ ID NO: 166633 - DNA, 601 bp, Human
gctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggmtccagctgtggctacaacatagggtttttatacaagaaaaataaagtgaattaagcgtgaaaaaaaaattataaaagaatttataccagaatatatatcagtgataatccctggagcagtgctatctgatagaactttctttgatgatgggacagttctatttctagattgtccaaaagagtaacatgtgaaatgtggctagtgtgactgagaaaataaattttaaattttaatagttaacgtgcctacttgctattgtattgaacagtacagcagaaagtaagattaatcctaaggggg

SEQ ID NO: 166634 - DNA, 601 bp, Human
ttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgcwggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgc

SEQ ID NO: 166635 - DNA, 601 bp, Human
tttgcacaaagaaacactcactgaagtgctctgcttaaagaagataaaccattgtggtctccactgttaattacaaaaaagttgccacaaactttgaaattacaataatttttaagatttaatatttttagtctaatacttagtcaggattcagactttctccttccataccccgcatttaaacaccagggttagatcttcctgtcctatacttccacaattctcagctcacacctctcatagatattaccagactgcatttctgcaacgtgtttatgtgcctttctcctaagttatgaayttggctcatccatttttgagtctcaatatttaacacaaatccaggcacaaaacggcattatttttggtataaattaataaataagcagacgactaaatgaagtgacaaaccagaacatctcaattctcataagttattttgtgcacaaaaattatattatttcaatatcctgctgaggacattatgtagaatataatacaaacaatttgaaattaaactacttctcagaatctgtgttaccagtttcctagctgttctctctgacttcaagctatctaatctctgtacaaatatattctg

SEQ ID NO: 166636 - DNA, 601 bp, Human
gaatcatccccaaagacttgttttcaaaatgctatctacaaaacaacagtgtctttcaaacagaagttacctccttttttctatcatgaacattatctttaacttgaaggggcagattaactgtaccttctgctaaatatcttctttttttttttcccagagtcttgctctgtcacccaggctggagtgcagtggtgtgatctccactcactgtaagctccacctcctaggttcatgccattctcctgcctcagcctcctgagtagctgggactacaggcacccaccaccatgcctggcttttttttttttttgtatttttagtagagacggggtttctttcaccgtgttagccaggatggtcacgatctcctgacctcgtgatctgcccacctcggccttccagagtgctgggattacaggcgtgagccattgcacccggcctatatatcttctaagtatcatactactgagacacttgtcatcataggaaaggtcagcaatctgaaatgcatatccttttataaaggaaaatgtaaacagcaaaaatttacttaagggttgggaggtagctggaggtaattaaaacatgagatagtaaa

SEQ ID NO: 166637 - DNA, 601 bp, Human
tttcaattccacataccagttatgaaaagcttcttttaccccagaaattcagctagcaagtatctactctccctgatgtcaatcaattttcattacaaatacttaggacaaagagacactagataatgaataagaggtaatattaacaaataagagagaaggttctgtgggttccaatctcagctctaccattttatttactatttatctgtgcaagtgatttaaaatctttgtgtttaatataacacatttagccaagttcctgacatatgtgttcaataaatgccactattatgaaatstgttcagaacctaactgaatttttttggaagattttttagcaagttagaaaatcttatttcaaaatgtttatgtatgaaactataaaattttgatctcttataataccttcacaacaaaatcaaataacagtggaatcatccccaaagacttgttttcaaaatgctatctacaaaacaacagtgtctttcaaacagaagttacctccttttttctatcatgaacattatctttaacttgaaggggcagattaactgtaccttctgctaaatatcttctttttttttttcccagagtcttg

SEQ ID NO: 166638 - DNA, 601 bp, Human
caggctgagaagagaaggtggaagacagccatcccagaagccatggagaatgaggggactgtctgcagggcagattatctagtcataatattcactttcaattccacataccagttatgaaaagcttcttttaccccagaaattcagctagcaagtatctactctccctgatgtcaatcaattttcattacaaatacttaggacaaagagacactagataatgaataagaggtaatattaacaaataagagagaaggttctgtgggttccaatctcagctctaccattttatttactattyatctgtgcaagtgatttaaaatctttgtgtttaatataacacatttagccaagttcctgacatatgtgttcaataaatgccactattatgaaatgtgttcagaacctaactgaatttttttggaagattttttagcaagttagaaaatcttatttcaaaatgtttatgtatgaaactataaaattttgatctcttataataccttcacaacaaaatcaaataacagtggaatcatccccaaagacttgttttcaaaatgctatctacaaaacaacagtgtctttcaaacagaagttacct

SEQ ID NO: 166639 - DNA, 601 bp, Human
tgttgtaggctgacaggaattatccagtagagaaggggaaaaatgatttaaatgttgcgggaggattggtagagcctgtccttgagtcagcaggagtaatctggatctagtggtcaaggagagagggctggacttgagaactgcagagctctggtaaccccagaaaaatgggattatagttcagaggccacttctgtccatacagatggtggtagcaatttcagaaagtttttttccgaaaattaggaagcaaggctgttagctgaaagtgaggacaggggagtgctggcaggctgagaaragaaggtggaagacagccatcccagaagccatggagaatgaggggactgtctgcagggcagattatctagtcataatattcactttcaattccacataccagttatgaaaagcttcttttaccccagaaattcagctagcaagtatctactctccctgatgtcaatcaattttcattacaaatacttaggacaaagagacactagataatgaataagaggtaatattaacaaataagagagaaggttctgtgggttccaatctcagctctaccattttatttactatttatctgtgcaag

SEQ ID NO: 166640 - DNA, 601 bp, Human
ttaagaaacaaccaaacagctagctgaaatgccatttctgggtccctttcttagatattttgacttggcttacctggggcgaggtgcagaaatcatctcaaaccagtacccaggtgattctgaggcagatagcttgaggaccaaaagaacactggcttaccagagaaaaccctaagtagatcaggagccaactttgggatgtgttggtttgagatattcagtctggagttcaggggaaaggtctgggctggagatagaaatttggaagtgattggattttgggtggtttatccacagtttkgagactggattagataaccaaggaagtaagtatataaacagaagggaagaggaccaaatactcagaatactcagcactggaccctctcatattaaaagctaaaggagaagaacagtttgaaggggagctagtgaggaaaatcaagagagggtcgtgtcttgaaaaccaagcgaataaagtatttgcaggaaggtggagtgatcaattgtcaaatgctaccaatgagtcaagtaacatgggactgacaattgcccataagatttagtaacatggtaaccttgacaagagaagttttggtgg

SEQ ID NO: 166641 - DNA, 601 bp, Human
catctctgctatggtgatctatgatcagagatctttgatgttattactgtaattgtttttgggtgccacaaaccttgcccatgtaagacaataaacttaactgataaatgtgtgtgttcagactgctccaccaattggcattctgtccttgtctctttcttcatgatttcctattccctgtgtcacaacaatattgaaatcaggccaattaacaaccctacaatggcctctaaatgttcaagtgaaaggaagggttgcatatgtgtcaccttaaattaaaagctagaaagattaagcttcrtgagggaggaatgtcaaaagccaagacaggccaaaagctaggcctcttgcaccagttagccaagttgtaaatgcaaaggaaatgttcttgaaggaagttaaaaagtgctactccagtgaacacatgaatgataagaaagcaaaaaaacaaaacaaaaaaagccttatagctgatatggagaaacgcttaatggtctggatagaggatcacgccagccacaacattcccttcagccaaacctaatccagagcaaggccataattctcttcaattctatcaagggtgagagagggatgaaag

SEQ ID NO: 166642 - DNA, 601 bp, Human
aagttaacttccttccttgttttaattcttatatctgaaaaaaggagatggcagtaacttctcaaacagctcttagctgaaaattaagggagatacaagcatatcgtatcttattgcgctttgcttaattgtacttcacaaatattgtatgttttacaaattcagggtttgtggcagccctgcatccagcaagactatgggcatcatttttccaacagcacatgttcacctcctgtctctgtcacgttttagtaattctcaaaatatttcaaactttttcattatcatctctgctatggtratctatgatcagagatctttgatgttattactgtaattgtttttgggtgccacaaaccttgcccatgtaagacaataaacttaactgataaatgtgtgtgttcagactgctccaccaattggcattctgtccttgtctctttcttcatgatttcctattccctgtgtcacaacaatattgaaatcaggccaattaacaaccctacaatggcctctaaatgttcaagtgaaaggaagggttgcatatgtgtcaccttaaattaaaagctagaaagattaagcttcgtgagggaggaatgtc

SEQ ID NO: 166643 - DNA, 601 bp, Human
cttggtggtgggcacctgtaatcccagctactctggaggctgaggcaggagagtcacttgaacctgggaggcagaggttgcagtgagcagagattgtgccattacactcctgggagacagaatgagactccgtctaaaaaaaaaaaaaaaaaaatgagcctaggcaaggtggtttatgcctgaaactccagcactttgggaggattgcttgaggccaggagttccagaccagcctgcaacaaagcaaagccttgtctattaaaaaaatatctggaggttgaggtgggagtatcacttcagyccaggagttcaaggctgcagtgagctatgatcatgccactgcactccagcctgtctctaaataataataaattttaaaagtaaaaaatatttttaaacgacttgactacaataagagttttaagtcttttcaataaatcttcaatcagttgctaatatcatctcgtgcttcaaacacagtgcccagtggtgtgctttagtgaaagcggtttaatttttggagtctgccagaactgggtttggttaccagctccattactaactggctaggtatctttaggaaagttaacttccttccttg

SEQ ID NO: 166644 - DNA, 601 bp, Human
gctacataaaaaacattaaaaaattacaaaactatttgtcaacaaagttgttcatgtccttgtgctactctgatgtaggattataacagttacatacatgcaaatggttaattccttccctcatatctatgaagtttagttttttcttcctgattacagaaatcctaaatttatcaatgtgttcaacttcattatttcttcaaattctgtttaggcatatcaagtgacttaagattctgttataactttctagaatctccccagtcttacttgaaactggctttgtaaaaaaaaaaaaaaagaaagaaaaaggtagaactatatggataattaattaacattttcctaaatgttatttaagtctaggcaccaaaatatataagatttgaactggccaggtgcagtggctcacgcctgtaatcccagcactttgggaggctgaggcaggcagatcacttaaggtcaggagtttgagaccagcctagccaacacagtgaaaccctgtctctactaaaaataaaaaaattaggtgggcttggtggtgggcacctgtaatcccagctactctggaggctgaggcaggagagtcacttgaacctgg

SEQ ID NO: 166645 - DNA, 601 bp, Human
tgttttctgaaggaggagacaattgatttaaagaatcctatttggtagcatattccttttttttttttttttttagaaatgaagttttagggaccttttcaaggagaactacaaaccactgctcaagaaaatcagagaggacacaaacaaatggaaaaacattccatgctcatgggtaggaagaatcaatgtcgtgaaaatggccatactgcccaaagtaatttatacattcaatgttatccccatcaagctaccactgactttcttcacagaattggaaaaagctactttaaacttcatrtggaaccaaaaaagagcccacatagccaagacaatcctaagcaaaaagaacaaagctggaggcatcacactacctgacttcaaactatactacaaggctgcagtaaccaaaacagcatggcactggtaccaaaacggatatatagaccaatggacagaaaagagacctcagaaataacaccacacatatacaaccatctgatctttgacaaacttgactcaaacaagcaatggggaaaggattccctgtttaataaatggtgttgggaaaactggctagccataagcagaaaactgaaac

SEQ ID NO: 166646 - DNA, 601 bp, Human
acactggagcagacggctaacatgatctgacttatattttaacagtatcacaatggcttctaagtcgagggcagactctcaacctctggaatctaggaaggtaaggatagaaatgagactgtcaggagaccactgcaatacatccgaaggggaataagagtggcttaaaccaaagtggtcagtggaggtggtgataagaggtcaggttctggatgttttctgaaggaggagacaattgatttaaagaatcctatttggtagcatattccttttttttttttttttttagaaatgaagtttyagggaccttttcaaggagaactacaaaccactgctcaagaaaatcagagaggacacaaacaaatggaaaaacattccatgctcatgggtaggaagaatcaatgtcgtgaaaatggccatactgcccaaagtaatttatacattcaatgttatccccatcaagctaccactgactttcttcacagaattggaaaaagctactttaaacttcatatggaaccaaaaaagagcccacatagccaagacaatcctaagcaaaaagaacaaagctggaggcatcacactacctgacttcaaacta

SEQ ID NO: 166647 - DNA, 601 bp, Human
tttttctctaaaagatatggtaccactggagacactggagcagacggctaacatgatctgacttatattttaacagtatcacaatggcttctaagtcgagggcagactctcaacctctggaatctaggaaggtaaggatagaaatgagactgtcaggagaccactgcaatacatccgaaggggaataagagtggcttaaaccaaagtggtcagtggaggtggtgataagaggtcaggttctggatgttttctgaaggaggagacaattgatttaaagaatcctatttggtagcatattccttttttttttttttttttagaaatgaagttttagggaccttttcaaggagaactacaaaccactgctcaagaaaatcagagaggacacaaacaaatggaaaaacattccatgctcatgggtaggaagaatcaatgtcgtgaaaatggccatactgcccaaagtaatttatacattcaatgttatccccatcaagctaccactgactttcttcacagaattggaaaaagctactttaaacttcatatggaaccaaaaaagagcccacatagccaagacaatcctaagcaaaaagaacaaagc

SEQ ID NO: 166648 - DNA, 601 bp, Human
ataaatgtctagctccatgcaaaatgtggatgaactacataagtataatgttgtgtaaaataagcagacatagaaaaatactatctgattccattaatataaagttctaaaatagttcaaaccaatctatcatgttagaaattgggatggcggttacttttggggaatgattggaaggggcaaaatggagcttctgggaacctaatgatctttaaattttttggtctgggtgataataacatcgtttcatttacctactgataagctctacatctttgagtgcttttctgaaaatatttaycaataaaagtttctttcttttaaaaactggctccagctaagaggacaacctagagagtattgtgatccaacagaatctgtgtagggtcagtcagcggaagtccagaagcagagggtcacggtcatgtccagagagaagagaggtgtctactgcattacagcattacaggattacagttagaggctctcagtaaagtatctccatgaatctcaccaaagtatcccactagaggaagagcagcctgtaatcacccaccaaacacagataaccccagtgacactaaaattcctacttgttgtg

SEQ ID NO: 166649 - DNA, 601 bp, Human
gaaagctggaggaacaaacttaactggactctgcagtgatccaaaaaagtttcagatacagatataagaaatgcctaaaagataagaaatggggtttaaagcccatgagaggatgggatatattacttcagtcccaatggaagagagtggcagggctgaactatatgcataaaaatgtagaaccttaaaagactgccttagcaatgaaaacagggctagaaaacactacacagaaaatgccaggcagccaggaatctgtccaaaattcagggtgaggacaaaaatcatttatgccaaaaayaacataaacaaaataaaatattggcctttaatgggaggtgaattttcactatcacatggtataggaacctgggccaaggaacaaagactggtacaggaccagtgaaattgccagggtccttggagaggcaaatgaaaagcttatctgtagggacaggtgtgtccacatgcaaaaaataaaagatttgtacaagaatatttatagcagcagtgttcataatagcctcaatctgaaaacaacccaaatgatcacctacagcataatgtgtaaacaaatggttttatttattcaatgcattat

SEQ ID NO: 166650 - DNA, 601 bp, Human
accacaaacacagaaatactggataaaatataatagaagcatgttgcttaatttcagtctggaaaaaaaggtaggtaaatctctataagccagaaaagaaaaaagaaatgaaagctggaggaacaaacttaactggactctgcagtgatccaaaaaagtttcagatacagatataagaaatgcctaaaagataagaaatggggtttaaagcccatgagaggatgggatatattacttcagtcccaatggaagagagtggcagggctgaactatatgcataaaaatgtagaaccttaaaagrctgccttagcaatgaaaacagggctagaaaacactacacagaaaatgccaggcagccaggaatctgtccaaaattcagggtgaggacaaaaatcatttatgccaaaaacaacataaacaaaataaaatattggcctttaatgggaggtgaattttcactatcacatggtataggaacctgggccaaggaacaaagactggtacaggaccagtgaaattgccagggtccttggagaggcaaatgaaaagcttatctgtagggacaggtgtgtccacatgcaaaaaataaaagatttgtaca

SEQ ID NO: 166651 - DNA, 601 bp, Human
aagcactatcaaaatgtgattagatcattttatttgcctagtgacttacaaaaattttagatgacaaaattccactttaaaggaaataaaatatctttattaggaaataaaatatctttattagaaacaagaaagggacttacctgtaaaataagagacctatattgtttgtgttgcttctcaatatgagcacaagtgaacatagttcacttaggtctgagagagttcacaatttttcatggcatttttgaaaagaaggggaaaatacatagtcaaatggcaggaaataatatatgttcartagtttaaggaatgaaatagtgaaagtcagtatggtatgacccacaagtcacgggcttgaagcaacatgagctggtccatatgagggcaatctttctaccacaaacacagaaatactggataaaatataatagaagcatgttgcttaatttcagtctggaaaaaaaggtaggtaaatctctataagccagaaaagaaaaaagaaatgaaagctggaggaacaaacttaactggactctgcagtgatccaaaaaagtttcagatacagatataagaaatgcctaaaagataagaaatgggg

SEQ ID NO: 166652 - DNA, 601 bp, Human
ttaactcttgtgtaaaatacagcttgataaatattttttagataggtgtatatacaattatacctattgtttcgcttatatttgtaaatatagttatactcaacagtataagacatatgtcacttattgtcatatatagtaaatagtcacttgcttctgattttttaccaccttttaactttttttcttacagaatgctttttattcagtaatttctcacctttttatagtaatagaccataattaaatgtgaagtctaacaagattatttccaagtgttactctttttttttttttttttgagcggagtctcgctccgtcgctcaggctggagtgcggtggagccatctcagctcactgcaagctctgcctcttggattcatgccattcccctgcctcagcctcccgagtagctggaactacaggcgcccaccaccacgtctggctaattttttgtatttttagtagagatggggtttcaccgtgttagccaggatggtctcgatctcctgaccttgtgatcctcctgcctcggcctcctgaagtgctgagattacaggcgtgagccaccgtgcccagccccaagtgttactcttaataa

SEQ ID NO: 166653 - DNA, 601 bp, Human
ttggattacccccaaactctctcatgcctctatgactttcctcccttccttccaatttatcaacttaacaaaatctcactcgtctttcaagccttggcttaactgctcccctcatctggtcttacctgactgctctcataaaggctttagacatttcttctgtgtaccaactgcacattcaatgtattcctattgtatactttgtgtctatagctactaggttctataagagtaggaactactcagtttgatacttttaactcttgtgtaaaatacagcttgataaatattttttagatargtgtatatacaattatacctattgtttcgcttatatttgtaaatatagttatactcaacagtataagacatatgtcacttattgtcatatatagtaaatagtcacttgcttctgattttttaccaccttttaactttttttcttacagaatgctttttattcagtaatttctcacctttttatagtaatagaccataattaaatgtgaagtctaacaagattatttccaagtgttactctttttttttttttttttgagcggagtctcgctccgtcgctcaggctggagtgcggtggagc

SEQ ID NO: 166654 - DNA, 601 bp, Human
gatgataagtaccaaataaatttaaacataagtataaatttaaacatgagtataaataaggaaattatagttaccaaacagaatgcaattcttataagtttggaagaaaaaatgacttagatgtccaatatttaaagtttgagttggaaggataatttttaataattaagggcactggcatgaagtcacgaccttgaggggttggcacgactcatatcattgtagactgcctgtgacaggctggaatggcttaaagaaatctggaagctcaattcactctaacttttcatcatctttaacrttaagtgatgagccatcaaaactgcaaagtagatgcattatcatgcaaacaaaatatggggagtacagttaaaggtttatcttctcaagcaatgttttggcttaaagaaatgttgtagccagccagttccaactagagccgactaagggaatttggcatggggcccaggcattgcctctgaaccataatgcatggccaggactcagagccaccaagaatgcaatgaatgcagtgggagccactcgctacttcaggtacctggctgtatatgcaggtgaagaaaggtcaggcacaagtgca

SEQ ID NO: 166655 - DNA, 601 bp, Human
gtatagaaagttactgtttaagtgtgaatgtcaatctcatcacttagtagctagatgacatttggcaattaaaatgaagataacattagtaccttggattggatctaaggaatacacaagctcatgtaagagcttagaatagtctggcacatagcaagtacttaacaaatgtctattataattatgattatcacacatctaaatctcaaatatagttagattttttctagatgtggtccaagaagtctatatctagtcaagttattcagttttaaaggcaacttaaagatattctcaaacwtgcatgaaattgggaaataagaccccagtatgctcttccaaaagatgtaatccagtcaacaacagatacgttatagcagacaatgtatgaggtaggaagtctggtatgaagagactgatgataagtaccaaataaatttaaacataagtataaatttaaacatgagtataaataaggaaattatagttaccaaacagaatgcaattcttataagtttggaagaaaaaatgacttagatgtccaatatttaaagtttgagttggaaggataatttttaataattaagggcactggcatgaa

SEQ ID NO: 166656 - DNA, 601 bp, Human
gtcgaaaacatcatctacatttgctgtttctacctaacttcctttattcctatgtggtaatttgacttgtatattcactattcttataaaatggcttaacatcatcaaatattttttcattcctaaatgctgtgaatgctttcctgacctgaatcatttgcttcaggtaatttctttccccacctgtcccattgattcatattttggggcctctcttttctgactcttgacctgtctttccagcacttccttttaaattccctttgtcaactcctcttactttgcttattccttatatgtkgtgtgccactgcacacactttgtgggtagtctgtctcattatcttctgatggtcccaaaatctcaatatgagctctgaccttccagtcatatttctaggtacctcaaactcaatatatacaaaatacaactaagtggttatctgtacaaattatatcatgaattgtattattagagaaattatataagaacgtaaggaaattcaaaacagaaaataacctacaatttgataatcatgcatctattctcatttttgcttccttcttgctatggtttgaatgtttgtgtccccttcaaaatt

SEQ ID NO: 166657 - DNA, 601 bp, Human
caaaaataaaaaaattcagcttaaacatgtaaacgttaatttactatttttgacactctctttttttcccaataaatttctttaaaacagactgtgagtcttttaatatcatcagcctacttcagcctacttatacttctgaagcatgacacataattttaaaagatcatgggattttcctgtagtattttacattagttaagattaaaatcagagtcttctggccaaagttggtagtaaaggaactcagaggtacctaaaacatgtacttaatcaagcaggggaaaggattagcctaaayggcaaagggcaaaaatgccaaaaggcctatatatgtgacagctgatatcaagaaggttcctgacctcatgcatttctggaaaagcacaaatattttcttaaagatgcatgcctctataaacttatgttcatgtacactcacatagtgttcatctcttgtttagagtcccaggaattaagccttcacctaataaagggtaactgtgaagcctcatatctttgctgacttttgtgcacatagtgccagtcctacaggaggttagcagagtgtactgcatactactttctgatttgactctaa

SEQ ID NO: 166658 - DNA, 601 bp, Human
acagaaataatgataaaggaagaacttaaaacagatagaagtactcaataaagaggagaaactttatagaagtatagacaatacacatcgcacatcaccctggggtcactttgtgtagaggaaactatggatgcctttaaaaaggtctggcacatgaatttaatattcaataatgatttttaaaccacaaatatgttaataaggcacggaacaatctaatttatttagatttaacaaaaataaaaaaattcagcttaaacatgtaaacgttaatttactatttttgacactctcttttttycccaataaatttctttaaaacagactgtgagtcttttaatatcatcagcctacttcagcctacttatacttctgaagcatgacacataattttaaaagatcatgggattttcctgtagtattttacattagttaagattaaaatcagagtcttctggccaaagttggtagtaaaggaactcagaggtacctaaaacatgtacttaatcaagcaggggaaaggattagcctaaacggcaaagggcaaaaatgccaaaaggcctatatatgtgacagctgatatcaagaaggttcctgacct

SEQ ID NO: 166659 - DNA, 601 bp, Human
tatgttacctgggtgattaattttggtccagcacatttgcaaaaacaaatgaggtgacagttgtatacgctttaaacttgacaagcattggtctaaatatagcatttcccaaaggaaaatacacacaacgtccatggaacacaagctgtttatagttagtgcactgaaaaaacatttttagctttaacaattatgtaatatttttattatgtttttaaaaagttatatctagatgtaaaagctacgattcccagacagtgttgtgcaggatgtggctaagtgaaaaaattcaagggagtasgggtgtcttgcataactgtggctcgcttgatctccctcactctgctatgttttcattcaaactatctgtcactatctgacattaattttttaaatgtgtgctatattactgaaagttttagagattctaataaaaatatgggaaaagggaattattaatataactcttcatcaaatggattcctaccccagttacagtaatcttgctttaatcaatcacttggagaagctagtaagcaatgtacctgaccaatttgcagagtcaattttttgagctgaaaggaatgttaatgctctcgtt

SEQ ID NO: 166660 - DNA, 601 bp, Human
ttaaaagataacataaatttctctaggttatattgctgatccccaggagtattctgaaggttctatccagaactccgccattttcattctttgataaaattgaagagtcttttaaagtcattgggaaaacactcaagattaaagatcttaatggaatctaagtgtcagcattagatgctctgctactttctaaggcaagcatgccaaggagaaaacaatggctgcgccagggtcagaataccttcaggtctttcttctggctccgacattgactagatgtgtgattttgtgaaaaagttgyattttctaaaatttaggaggttccttaagacttctgagttgaaacagaaatacaaagaggtggtaattgaggtgtgggactcaaaaacaattttaatctgctgaggttgtggttttattcatttaatagaaagttactgagcacctccttaagccaggcactactgtcaacctaatcactgcccttaacttaggaaaacaaatctttaatcaagaaattataaaattctataagtgatctaattacatgaattactgtaaagtgcccagtatgttacctgggtgattaattttggtccag

SEQ ID NO: 166661 - DNA, 601 bp, Human
tagtgagtctgcttcctgataatccccactaactctgcttaatatctttccacagcacttatcattatttgacatgtacatttgttgctcgtcctcccacagtgtaagatctatgagggcaggaattttgtccattttctttgctgctatatgcgcagaacttagaatagtatctggtaactagaaagggctcgatatacagttactgaaagaaagggatggggtgcaaattagaaagcgattgagggagaagagggaggaaggaaagaagaaggaagggagggagggagggacggaaagragggagagatggagggagtagagttaaacaaataagtaatataaaaggtatgaaaatgcagcaatagctgtgaagcccgtagaatatggcttgggaagcataggaataacaggctaaagtaacaagcagtttggttagagaagataaaggattacagatgcttgaataatatgctaaaggccgggtgcagtggctcacgcctgtaatcccagcactttagaaggccgaggtgggcagatcacctgaggtcaggagttcaaaaccagcctggccaacatggtgaaaccccatctctactaa

SEQ ID NO: 166662 - DNA, 601 bp, Human
ccaggttcatgccattctcctgcctcagcctcccaagtaggtgggactacaggcgcctgccaccatgcctggctaatttttttgtgtttttagtagagacggggtttcactgtgttagccaggatggtctccatctcctgaactcatgatccacctgcgttggcctcccaaagtgctgggattacaggcatgagccaccgctcccggccctcaaagaacttaaaacagaactaccattagaccagcaatcccattactggatatatagccaaaagaaaataaattgttctactagaaagayacatgcactcacatgttcatcacagcactactcacaaaagcaaagacatggaattaactgaggcacccattaatagtggattggacaaagaaaatgtggcatatatacaccatggaatattatgcagccatgaaaagaacgaagtcacatcctttgcagcagcatggatgtagctgtaggccaagaccctaagcaaattaacacaggaacaaaaaaccaaatactgcatgttctcacttataagtgggagctagacattgggtattcatgagcataacaatggaaactgaggactactag

SEQ ID NO: 166663 - DNA, 601 bp, Human
cgcctcccaggttcatgccattctcctgcctcagcctcccaagtaggtgggactacaggcgcctgccaccatgcctggctaatttttttgtgtttttagtagagacggggtttcactgtgttagccaggatggtctccatctcctgaactcatgatccacctgcgttggcctcccaaagtgctgggattacaggcatgagccaccgctcccggccctcaaagaacttaaaacagaactaccattagaccagcaatcccattactggatatatagccaaaagaaaataaattgttctactaraaagacacatgcactcacatgttcatcacagcactactcacaaaagcaaagacatggaattaactgaggcacccattaatagtggattggacaaagaaaatgtggcatatatacaccatggaatattatgcagccatgaaaagaacgaagtcacatcctttgcagcagcatggatgtagctgtaggccaagaccctaagcaaattaacacaggaacaaaaaaccaaatactgcatgttctcacttataagtgggagctagacattgggtattcatgagcataacaatggaaactgaggac

SEQ ID NO: 166664 - DNA, 601 bp, Human
cttctcaaaagacatttttttttcttttgagacagtctcgctctgtcgcccaggctggagtgcagtggcgcgaactcagctcactgcaagctccgcctcccaggttcatgccattctcctgcctcagcctcccaagtaggtgggactacaggcgcctgccaccatgcctggctaatttttttgtgtttttagtagagacggggtttcactgtgttagccaggatggtctccatctcctgaactcatgatccacctgcgttggcctcccaaagtgctgggattacaggcatgagccaccgckcccggccctcaaagaacttaaaacagaactaccattagaccagcaatcccattactggatatatagccaaaagaaaataaattgttctactagaaagacacatgcactcacatgttcatcacagcactactcacaaaagcaaagacatggaattaactgaggcacccattaatagtggattggacaaagaaaatgtggcatatatacaccatggaatattatgcagccatgaaaagaacgaagtcacatcctttgcagcagcatggatgtagctgtaggccaagaccctaagcaaattaa

SEQ ID NO: 166665 - DNA, 601 bp, Human
tctgataaacacagacacaaaaattctcaacaaaacactagcaaaccaaatcaaacatcaaagttaatttaccacgatcaagttggcttcactcctggtatggaaggttagctcaatatatgcaaatcaataaatatgatttaccacatgagaagaattaaaaataaaaccatatgatcatctcaatagacacagaaacagctttcgataaaatgcaataccacttcatgataaaaaccctcaagaaactaggcaacaaagaaatatacctaaaaacaataagagaccaaaatgacaaacycacaaccaatatcagactgaatgggcaaaagctggaagaattttccttgagatctggaaaaagttaaggatgctcactctcaccactcctgttaacactggaagtgctagccagagcagtcaggcaagagaaggaaataaaaggcattcaaacatgaaaaaaagaagtcaaactatctctcttgcatattacatgattttataactagaaaaccctaaagactccaccaaaaggctcctaaaactgataaatgacttcagtaaagtttcaggacacaaaatgaacatgtaaaaattagta

SEQ ID NO: 166666 - DNA, 601 bp, Human
gagtaagactccatctaaaaaaaaaaaaaagtcacagagtggcaaaccagctaggaaaaccagactcatccatcttctgtattcaagaaacccatctcacatgtaatgacaaccataggctcaaagtaaagggttggagaaagatgtagcatgcaaacagaaaacaaaaaagagcaggggttgctattcttagattagataaaacagactttaacaacagtaaaaaaggaaaaataagggcataacgataaagagttcaataagaagatttaactatcctaaatacatacgccctcaacaytggcacacccagattcataaaacaaggacttctaaggacctagaaagccacacaacaatagtgggggactgatagcattagatcatcaaggcagaagactaacaaagaaattctggacttaaactcaatgcttgtccaattggatctaataaacatctacagaataatccacccatcaaccacagaacgtaaattcttctcatctgtacacagaacatatactccaagattcaccacatccttggccataaaccaagactcagtacattttaaaaagtcaaaatcatgccagtcatactg

SEQ ID NO: 166667 - DNA, 601 bp, Human
catcactggctgggcgtggtgactcatgtctgtaatcccagcactttgggaggctgaggcaggtggatcatgaggtgaggagttcaagaccagcctggccaagacggtgaaaccctgactctactaaaaatacaaaaaattagccagacacggtggcaggcacctgtaatcccagctactcgggaggttgaggcaggagaatccatggaacttggagggcggaggttgcagtgagccaagatctcaccactgcactccagcctgtgtgacacagtaaggctccatctcaaaaaaaaaaaaatcaccaaggtatatagtcaccagaatgttcaaaggcaatattacagaaaaaatcttaaaggcagccagagaaaagtgcagatcacataaaaagggaactctatcaggataataacagatttctcagcagaggtttgcaagctaggagagattgggggcctgttttcagcgttcttaaaagaaatttcaaccaagaatttcacatcctgccaaactatgcttcataagtgcaggacaaataaaatcttttccaggcaatcaagtgctaaaggaatttgttaccactagaccatccttacaa

SEQ ID NO: 166668 - DNA, 601 bp, Human
atccaataatagctccatcaagctaacattgactttcttcacaaaattagaaaaaaattactttaaatttcatatggaaccaaaaaagagcctgtatagccaagacatcctaagtcaaaagaacaaagctggaggtatcatgctacctgacttcaaactatacttcaactctacagtaactaaaacagcatggtactggtacccaaacagatatatagaacaatagaacagaacagaggcctcagaagtaacgtcacaaatctacaaccatctgatctttgacaaacctgaccaaaaaaaacaatggggaaaggattccctatttaataaatggtgttggggaaactggctagccatatgcagaaaactgaaagtggaccccttccctacacctaatacaaaaattaactcaagatggactaaagacttaaacataagacctaaaaccataaaaaccttggaagaaaacctaggcaataccattcaggacataggcatgggcaaagacttcatgactaaaacaccaaaagcaatggcaacaaaagacaaaattgacaaatgggatctaattaaactaaagaccttctgcacagcaaaagaa

SEQ ID NO: 166669 - DNA, 601 bp, Human
caaatggaaaaacattccatattcatagataggaagaatgtatattttgaaaatggccatagtgaccaaagtaatttatagatccaataatagctccatcaagctaacattgactttcttcacaaaattagaaaaaaattactttaaatttcatatggaaccaaaaaagagcctgtatagccaagacatcctaagtcaaaagaacaaagctggaggtatcatgctacctgacttcaaactatacttcaactctacagtaactaaaacagcatggtactggtacccaaacagatatatagamcaatagaacagaacagaggcctcagaagtaacgtcacaaatctacaaccatctgatctttgacaaacctgaccaaaaaaaacaatggggaaaggattccctatttaataaatggtgttggggaaactggctagccatatgcagaaaactgaaagtggaccccttccctacacctaatacaaaaattaactcaagatggactaaagacttaaacataagacctaaaaccataaaaaccttggaagaaaacctaggcaataccattcaggacataggcatgggcaaagacttcatgactaaa

SEQ ID NO: 166670 - DNA, 601 bp, Human
ggtcttaacccgggtaagtacttaacacattgatcgtttccttcttcttttaacgctcttattcatttggcttccacatatttcattcttgtagtcactctttcagtctctctgtctagctctttttcatcttctcaacttctaaatctttgagtacaccaagctcagtcctcagacttctcttagatatctatgctctttctaggtgtctgcatctagttctatgtctctaatatcatctagacattaatgattaccaaatttacagtcctagacccagcttttccaagaaactctagamtcaactatgcaactgtattctcagcatctccacttgtatttctaacagacccctcaaattaatatgtttagagcagaactttgatgcattggtccaaacatgcatcttctaggtttgtaacttcatttacacacctgctgctctagccccaaactctagagtcattactgatacctcacttattttctcacctcatatctaatacatcagcaaatcctagtggataaccatgaaaatataacccaaatccaaatacctgtttccactgcttgcaccataatttatgtccccacaatcaca

SEQ ID NO: 166671 - DNA, 601 bp, Human
tttggcaatacatgtctgctaaatgaatgaaggaatacattattgtcttttccatctcccactctgaatatcttgtctttattatctgttgctgtatggtttgcactacataatattgtttcagtcaatgacagaccacatatacaacagtgttttcataagatagtattttttactgtactgtctctatctttagatatgtttaggtacacaaatacttaccattgcattacagttgcctacaaaattcaacagagtaacatgctgtatcggtttgtagcccaggagcaatgggctacamcaaacagcctaggtgtgtagtaggctataccatctaagtctgcgtaaatgcattctatgatgttcaatgatgaaattgactacttcatgacacatttctcaaaatgtatccctactcttaaatgacgcatgactgtttttgttgccttcagagaacatagcttcctccaccaggcttgctgccctgtaaggataggggctaggtccatttcactcactaatgtagatctgaagctttataaactgctaactacacagtggactcctgatagatatttgctaagttattaaagtagttgtt

SEQ ID NO: 166672 - DNA, 601 bp, Human
atggccaggcatggtgagctcatgcctgtagttctagcactttgagaggccgaggtgggcagattacctgaggtcagaagttcgagaccagcctggccaacatggtgaaaccccgtctctactaaaaatacaaaaattagctgggtgtggtggtgggcacctgtaatcccagttactccagaggctgaggcaggaaaatcacttgaacccaggaggcagaggttgcagtgagtcaagatcatgccattgcactccagcccaggtgacaagggagaaactccacctcaaaaaaaaaaaaaamaaaaaaaaaaaaaaaaaaaaacagccccaacgagttgagctaaaacttgtaggagatgggaaaacaaaacaattgccatggttaaaaaacaaaggggattcaaaattatttgcagagatcaaatgagctttctgggggaaggaatgagtcacaaagggaagggaaggaacagttatggagtatatagcatatgccaggaattgtgtgtgtgtgtgtttgtgtctaagggaagataatgttaagaagagggctaaagtttccctgtccatgactataatcttcaacaaaggcaccacctgt

SEQ ID NO: 166673 - DNA, 601 bp, Human
tgtcactctagctacttatttacctggtctctgtaaacatttgtctctgagatttctgaactcagggtattgtcataaagaaaaaggattatacttgttctataaagccccaaggaatggccaggcatggtgagctcatgcctgtagttctagcactttgagaggccgaggtgggcagattacctgaggtcagaagttcgagaccagcctggccaacatggtgaaaccccgtctctactaaaaatacaaaaattagctgggtgtggtggtgggcacctgtaatcccagttactccagaggytgaggcaggaaaatcacttgaacccaggaggcagaggttgcagtgagtcaagatcatgccattgcactccagcccaggtgacaagggagaaactccacctcaaaaaaaaaaaaaaaaaaaaaaaaaaaaaaaaaaaacagccccaacgagttgagctaaaacttgtaggagatgggaaaacaaaacaattgccatggttaaaaaacaaaggggattcaaaattatttgcagagatcaaatgagctttctgggggaaggaatgagtcacaaagggaagggaaggaacagttatggagtata

SEQ ID NO: 166674 - DNA, 601 bp, Human
ctcaaaattaataatcctttttctaaattaaggaaagagaaagtttatacccgtgctggtcagatcacatttgtatttctggatgatttctggagtttctactttgatgaattctgatatgttaggggaaaaagatggatggtgagatgagtagaatctgctttatgagaaatgattgaaggagaaaaggatgcttatttgggctgctggtagttcacagacgccttgaggagaattagagaaagttgtggtgatgtgatatcaggctggattcagccccacctgctttgtgccaggcaarggctacttatcagtatgaagtagctgtttagccaagggaaggctgatacctgcaattatctaagcagaggttgcaatctgctggctctagtatctgatcatgcccatagatacattttgtttggctcagacaatgctgaccagaattatgagaccatccgtgaattacttaggtggcaacaatctgttaaagtttagttgcaatggttgcttttggatggggcatgtgtattccagtttttccagttccctccacaaactggtggtacgccaatggtctcttttcttaagtcttgtcact

SEQ ID NO: 166675 - DNA, 601 bp, Human
aggttcattgatcccttaaaatcaatccagctctacttttatgagatctaagactcaaaattaataatcctttttctaaattaaggaaagagaaagtttatacccgtgctggtcagatcacatttgtatttctggatgatttctggagtttctactttgatgaattctgatatgttaggggaaaaagatggatggtgagatgagtagaatctgctttatgagaaatgattgaaggagaaaaggatgcttatttgggctgctggtagttcacagacgccttgaggagaattagagaaagttstggtgatgtgatatcaggctggattcagccccacctgctttgtgccaggcaagggctacttatcagtatgaagtagctgtttagccaagggaaggctgatacctgcaattatctaagcagaggttgcaatctgctggctctagtatctgatcatgcccatagatacattttgtttggctcagacaatgctgaccagaattatgagaccatccgtgaattacttaggtggcaacaatctgttaaagtttagttgcaatggttgcttttggatggggcatgtgtattccagtttttccagtt

SEQ ID NO: 166676 - DNA, 601 bp, Human
atgtgactttccaaatacagtttcctattgtgaaagaatgatctgatctgttaatatattctcctagcaacataagtattatgtatatttatattgtgtgtgtgtgcgtgtgtgtgtgtgtgtctcactgtaaataagcaagttagttgacattctggctaattagtgaggatcacttaacaaaagtctgtcttccacagacttattagttttattacacatgagtgaatgaacgaaataaatttcttttacatgcaaaactgatgaccagatgctagcatgtgctgtaccaaaatgcatycacaccatgagcccagccttgtggcttttctttctaaaccactgtataattattagatattgaacacagcaggtacataatagacatttattgagtgaataagtgaataaaaactgtaagcttatttcaagtcaattgaaatcagttttaagtagctaataatactaaagtactttctatacatgtgtccatccaagtcctttctcagaggtcaaatagtcactctagctcactgaccattttcataattcattcaatagtgctattcccaaaatgcagaccatgaaaatatggctttaa

SEQ ID NO: 166677 - DNA, 601 bp, Human
attctgggggtagaatagaggatcatttgggcgccacgtgaaattgatggtaatagaatcagtcaggaggctgcaacatgaatccaagtaaaaaaagaccagcaccaaactaagtcagggaagtagcaacagaagtagcatgtataatgaatcatatatttaataagtggagttgatagaatttgacaatttattgggtaaggggtgaaggagaaactgagccaaggatgataccaaaaattcttgctgaggtgccatttcaagatactggaaaaggccttaggtttagggggtcatgctracttagaagtcatctgggtggagctgtgtaataagcagttgaaagttcagtagttttgtagagggtctggctaatattatgtatttaggagtcatcgaaatatagtggtagttgaagacaagactatgaatgagcttatgcagactgtgtagagtgagaaatgactggaaaagatagaacccagaacacaaacaaatttatagtgtgggtggaagaacaaatccacacaggagtcgggaaatgtacatagggagagaaacatatctacctggaagggaagtgacaaatacctaagcaaga

SEQ ID NO: 166678 - DNA, 601 bp, Human
ctcaagaaaaaaaaaaaaaaaaaagatggcctgtatgacagtactactaagttccccaatcttactcccagagttttgataaaatatgtaggttttggttctgtaaaaaatgtcatgtaattgaaacagataatctacaacaatggcagagcattaaatatctcagcaccttctgacacaaagcaacaactttcatacacaagtatcaatgttgagaagcacaaagaagcttcaatatgattaagtataatcaccaacgtatgtttgatgatttatgctgaataagaagttaatgtctaakaatctaaggtagtacagttctttgcaaatcaattctgtaatttaaatttctataaatattctttaaccatctatttgggaggaagcattatacttgcaattaggatcaaggttagaaagatgctgtttctgcctttaacactataggcttgtgagacagatagaaaagtagaacacaattgtaactcagagtcatagtgttatggttgacaagcacaaaggagacaagggagggtacagggtttcctcacccagtctaggaaggctcagagaaatcttcccagagcaagtgacaagtaat

SEQ ID NO: 166679 - DNA, 601 bp, Human
gcttacttttattttatgacaacattaaaggcaaatcttattacaataactttaaatttataaaattaccaatatttatagcagaaactatatttctgtttgtttgacagaatggaatagaactcagaaaataacctttatttactccaccttttacagtgcttatctgtgataaatgtacaatgttaaattgacttgaacatgcctagtatagaaatgctatttttttccttattaactgtaatatcattcattactttatgctgaaacaaagatgggaacacagagattaaattcccartgatgataatgatcaggtaaacttagtacatttgagatgaccaaaatgaaaaaccttcacatggagaagtgatggattatcactaattgtgtttaacaaatgttaaaaaaaaaaacacttttccttttaagtgacttgacctgataatttctgacaaaagccctgttacagctgtccaaatttagcttaaagaattaacagaaagtatatagtgaagagatggcctggggctgggtgtggtggctcatgcccgtagtcccagtgctttgggaggcgaggcaggagagtcacttgaggcca

SEQ ID NO: 166680 - DNA, 601 bp, Human
ttcccaaccttgtgttgttttataatgtccacattagtcaaatgaagctaacaagaataatgaaaactagattttggctaaaaagagataaggaatctcactgtcattcaaattatttggcagattatataattctcctgagactcagttttctaaactgtacaatgaagaatgctgattccttacttatctcaaggaattgttggataaaatgtaatgaaacatgaaaattatctaaaaactgtaaagacttatataagtgtgagttatatacttctaagtcagcatttaccactagaamaatataaatattaccatgaaaagattcttattcagttaaaggttgtaggtagaaaattaattaaaattatttaaatataaagcaaattgaaatatttatctttcaattttttaaataaattagcagtctaatttgtcatgtatgaagaaagatgtttttactttttgaatgtaagtcagtaacaaaaatatttctcatttattattgtcattagtaccaagctatgaaattttaaattgattaatgaaacatttaagtttatctttaaatatatttcttgatacattcttgatgtgtaag

SEQ ID NO: 166681 - DNA, 601 bp, Human
caggactaggcgatgataatttttcagctccactatcatcttagggaaccattgtatatgtggtctgttgttgaccaaaatattattatgtggcacatgactgtagtttatattactgaattaggtgaatatgaaagagtaattaaatcattttatctaaaataaaaagaaattgatgaggctattttagtattatatggtaggtaaaagatgaaaaaatccagtaattttattaatgtctataacaatatattgggtatttcttctttatacttataatccaagacgtctacctcatacwtaactatataatcatattgtttgcaacttttctaatgaattaagaaactagatatcttgcattaagttacttgaactcactcacttgtattaagaagtaacaatactttcatacagaggaactcttcttggctaacttgaagcttgacaaactcctgtgggatctgccacatggtaaggcataatgaatagaatgatgattctttcatccgctgtcttgcatcacacacaatacacaaaagaaaaagcaacaggaaaaaaaatagtgtctcagccagtttaggtaatttatcagggaata

SEQ ID NO: 166682 - DNA, 601 bp, Human
cacagctttacaaaatatatttcttaaataataagacatgaaagtggaaaattactctttgatctatgaactacagaatgaatgttgtgttagcagaaatgaaaacattaatctccttgtatatatccataagagctcttggctgactaggtgcattgtcaatgagcaataatatttgaaagtagtattcttttctgagcagtaagtctcaatagtgggtcaaaatattcagtaaaccatgccataaatagatgtgctgtcatccagctttgttgttccattcataaaccacaggcagaayagattgagcgtaattcttaaaggccttaggatcttcagaatgataaatgagcattagcttcagcttcaagtcaccagcttcagcttcaagtcaccagcttcattagcccctaacaagagagtcaacctgtcatttgaagctttgaagacagacattgacttgttctctgtagctatgaaagtcctagatgacatcttcttccagtggaaagctgttttatctaccctgaaaacctgttttttagcacagctactttcataagtagcgataatcttacctagatcttctgggtaacttgct

SEQ ID NO: 166683 - DNA, 601 bp, Human
tcaccttctcccatgaatcacgaatgttcttaatggcatctagaaaggtgaatcctttctagaaggttttcaatttactttacccagatccatcagaggaaacactatctatggcagccacagctttacaaaatatatttcttaaataataagacatgaaagtggaaaattactctttgatctatgaactacagaatgaatgttgtgttagcagaaatgaaaacattaatctccttgtatatatccataagagctcttggctgactaggtgcattgtcaatgagcaataatatttgaaagyagtattcttttctgagcagtaagtctcaatagtgggtcaaaatattcagtaaaccatgccataaatagatgtgctgtcatccagctttgttgttccattcataaaccacaggcagaacagattgagcgtaattcttaaaggccttaggatcttcagaatgataaatgagcattagcttcagcttcaagtcaccagcttcagcttcaagtcaccagcttcattagcccctaacaagagagtcaacctgtcatttgaagctttgaagacagacattgacttgttctctgtagctatgaaagt

SEQ ID NO: 166684 - DNA, 601 bp, Human
atgctagcagtttgatggcaatttacccacaatagaacttctttcataattggagtcaatcctcttaagtcctgctgctgcattatcaactaagtttatgtaatctccgaaatcctttgttgtcacttcaataatcttcatagcatcttcactagaagtagattccaactcaagaaaccactttctttgctcatccataagaaacaactcctcatctttcaagttttaccacgaaacctcttcaattcagtcatgtcttcaggctttacttctaattttagttctcttgctcttttcacayatctgtagttatttcctccactgaagttttgaacaccctcaaagtcatgcaagagggatgaaataaacttcttccaaactcttgttaatgttgctattttcaccttctcccatgaatcacgaatgttcttaatggcatctagaaaggtgaatcctttctagaaggttttcaatttactttacccagatccatcagaggaaacactatctatggcagccacagctttacaaaatatatttcttaaataataagacatgaaagtggaaaattactctttgatctatgaactacagaatgaat

SEQ ID NO: 166685 - DNA, 601 bp, Human
atgccttcctgctgatatgggagaaaggtattaatatttaaatatttatcttatatccagccactttgttacacaggcatatcttggagatatagccggtttggttccagaccacggcaatgaaggaaatattgcaacaaagtgaatcacatgcatctttttgtttcccagtccacgtagaagttatatttacactatactagaatgtattaagtgtgcaacagcattatttaaaaagtgaacacaccttaactaaaaaacactttattgctagaaaatggtaacaatcatctgagtcttycctgagtcaaaatctttttgctgttggagggtgttgtctaaatgttgatggctgctgattggccagggtggtggttgctgaaggttggggtggctatgacagtttctcaaaataaggcaacaatgaagtttgctgcatcagttgactcttttgtgaataatttttctgtagcatgcaatgctagcagtttgatggcaatttacccacaatagaacttctttcataattggagtcaatcctcttaagtcctgctgctgcattatcaactaagtttatgtaatctccgaaatcctttgttgt

SEQ ID NO: 166686 - DNA, 601 bp, Human
ttttgtcttctttatataaatctcaagtatttgccattaagattattcctagatgatttatctttttgttgtaattttaaaaattgcttcattaagttttctaatgccttcctgctgatatgggagaaaggtattaatatttaaatatttatcttatatccagccactttgttacacaggcatatcttggagatatagccggtttggttccagaccacggcaatgaaggaaatattgcaacaaagtgaatcacatgcatctttttgtttcccagtccacgtagaagttatatttacactayactagaatgtattaagtgtgcaacagcattatttaaaaagtgaacacaccttaactaaaaaacactttattgctagaaaatggtaacaatcatctgagtcttccctgagtcaaaatctttttgctgttggagggtgttgtctaaatgttgatggctgctgattggccagggtggtggttgctgaaggttggggtggctatgacagtttctcaaaataaggcaacaatgaagtttgctgcatcagttgactcttttgtgaataatttttctgtagcatgcaatgctagcagtttgatggca

SEQ ID NO: 166687 - DNA, 601 bp, Human
gtaaaatgttatatactcatgatagaacattctgatattatggaaagatttatttaaagaaatgaaagttattcacaattctacaggataagctgtgtgaacattttggtgtattactcaagtttttttttctttttatacatgtatacagacatacccaagcatacacacaatattacacatgtttcataaattctatttgctaatctagctgttttatataacaacatattggttcttcctatgccaataatccaacatcgtttaatttttatcaaagtaattcatgtgtataatgttraaagtcaagtagtaccacatgattataaaaacaaaaacagcagcagcagcagcatcaatagagcctagcagtttcctgatagacttcttcccatccctattccagctccctagacacaactaccttcaactttttgtagcctgtgtcttttgatatttctatatttccactaaagttagttttagtttctactataggaaatgaagaaaatgaagctctcttatactagacactctcttcctcaactacatacatgttctcttctccccagagagagcttttggctcaatttttagctaa

SEQ ID NO: 166688 - DNA, 601 bp, Human
agaaaaagatgacattcactttttatgaaagagaaggggtttcaccatccctgccaatatcttgggtaattgtgcagcaataacttcagacatcatttctggaaattcaacactcagtgcccgggactggataaatgtattcaagcagtacagatgaagttgtttgacaagctgttggtttaacaaatgagtagaaaacatgtaataaaaataataaattcatatgctattcaaacatggcaatttatttttctaactatttataatataaatacttctcaaggtgtttttttcttaccayagtgaaaataactcccaccattttctagaataatatgtaaaatgttatatactcatgatagaacattctgatattatggaaagatttatttaaagaaatgaaagttattcacaattctacaggataagctgtgtgaacattttggtgtattactcaagtttttttttctttttatacatgtatacagacatacccaagcatacacacaatattacacatgtttcataaattctatttgctaatctagctgttttatataacaacatattggttcttcctatgccaataatccaacatcgt

SEQ ID NO: 166689 - DNA, 601 bp, Human
tgagggctctgggaggtgcttgtgacctctgctggttctggctcctcctcagtcagccaagccagagaagcagggtcaagagtggtgaagatttttgattcttccttcaaggaaatgaggaaagggaacatagatattagttgagaagggaaaggtaacatccccctttagctttagggctaacattcttacctcttcatttccaggaggtgaaacataggtacccccattttcatctgaagacaggacctcttgcaggtcctcataccaggcttccagctcccagctggacagtgtcccraaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaa

SEQ ID NO: 166690 - DNA, 601 bp, Human
gatttgcaagttttctctctttctcatgcgatgcagatattctgccatgggctctttaacacgatattgcctccggtgatctttcaccggttatgtaattaaaatgtccttcatctgtactagtaaggtcatcaaaataatttactgctctttgacttgatggcgaaaataggataacacctttcacaggatgccatgctccggggatgctgtccgaggtaccaagttctcgaggctgcctggggatggagggatgaagccctgaacagctaagcctggcgttggctacttggccagggamgtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctgg

SEQ ID NO: 166691 - DNA, 601 bp, Human
ttcccatctgagagacctctctccttacttctccataacctctcaggtagtaccccacaaccaaatccagtgattttttttccccttttacacgtttaagtaacagggactgcctggtgcaacatctgcctagaataaacctccttttggatccatgtcttgtccattcttcaagacctaaattcaaacctttcctgatgctacagaccacagtgagctttccctcctccaaatttttatgcgactgataggcaaacactgcactacataagctaataaatgccatcacttttcctcattrtttcaggtatataagtaaatatgggttcagttgttgtatttctacttaaaaggtaaatattcagggatgatacctcctatatttctcatttcctccctgtaaccagcacattactgttttgccagccttgaaggaaacttccttgtctgtatttattatcccaggtttcccagacaccgtcctatcttgctttcatcatactgttttgtacttttgccaacatttgttattgtgcatcttagaggcccttatgtccttctccttccttgctctgatgcttagcatgcttcccaactccct

SEQ ID NO: 166692 - DNA, 601 bp, Human
tcagggatgatacctcctatatttctcatttcctccctgtaaccagcacattactgttttgccagccttgaaggaaacttccttgtctgtatttattatcccaggtttcccagacaccgtcctatcttgctttcatcatactgttttgtacttttgccaacatttgttattgtgcatcttagaggcccttatgtccttctccttccttgctctgatgcttagcatgcttcccaactccctactgctccctgctccgaggctcagtgtcagacacaaaagattctcagtggttatttattcatccatatgaaaggtcagcaatggaggctagaagaacatgctttcttattaaattatctcattctaagctcacaaatctatgagagaaattactggcatcagctgtaattctcagatgaaaaccttaaggccttgagaagttaagtatctgcttatatctgagaagtaaaagaactcagacttaaaaccaaatttgcttaactgaaaaataattgcttttctacatcatgctgcctccaggaagccttccctgactgccaagaactcttcccttgagacacaattttagagctctgctatt

SEQ ID NO: 166693 - DNA, 601 bp, Human
catgaacatgtcattagctaatgggtacgtgtatttatgtcttcaggtagactataaatcttccaagaggagaaatgacatactatatctttatatagtctccatatctagcatggtggcctgtatatgaatatttaattgtttgtcaattatttgattgattcttataagaccatgaacaaacatttgttttctctctaaaatgaaataaaagcacctataactttacctctgaaaaggttatggagattaaagctttctattttatcatgacctggccctggcccaaagacctatgtcyatcagaaaagatacttaagtctaggagagtgaatgagtttacagtaatgacaaaagcattattccaaagagtgccttaaaattctcaaaatgctactaattttaattgatttgaaacagaaaacaaaaattatttattgaagcaacctgttgaagattaaccaaaaatcaagtgagagttagggtttaaaaagaacctgatattatcctaggggtttcattgtattatggtgtgttttatgttttatccacagaggacagatgctgaaatgattacacaagtaaaatcatgtgaccattt

SEQ ID NO: 166694 - DNA, 601 bp, Human
aaatcttccaagaggagaaatgacatactatatctttatatagtctccatatctagcatggtggcctgtatatgaatatttaattgtttgtcaattatttgattgattcttataagaccatgaacaaacatttgttttctctctaaaatgaaataaaagcacctataactttacctctgaaaaggttatggagattaaagctttctattttatcatgacctggccctggcccaaagacctatgtctatcagaaaagatacttaagtctaggagagtgaatgagtttacagtaatgacaaargcattattccaaagagtgccttaaaattctcaaaatgctactaattttaattgatttgaaacagaaaacaaaaattatttattgaagcaacctgttgaagattaaccaaaaatcaagtgagagttagggtttaaaaagaacctgatattatcctaggggtttcattgtattatggtgtgttttatgttttatccacagaggacagatgctgaaatgattacacaagtaaaatcatgtgaccatttttataatgtgtgagaattttttaattttgaaaacaacctaataatcattatgctg

SEQ ID NO: 166695 - DNA, 601 bp, Human
gatgatttggatatcctcttttaaacacatttgtttcagatgctttgtcctgaaaagtttttcttttgggttgtcgatcttcactttttatttgtaggatttctttacctatgatggatagaaatttttggtcagatatatgtattttgaatatttgataccacccatttaatgatatcgtaatgtcacaacaatgttcaatccagattatatgcttttacttctactttgtcaggcagccaattgtaagtcaaaggaagaattatcttgcagtatttccacatcccctatcccaaagttstttagatcaaaattgacaatatttggaggaaaaaaataaaaacagcatatagatttgatcataagcattccctgaaagatttcaatctaagaagactttaagggacagttcttctggaactaaaagattttccacagtagctaagggaaaatagcaacctgtaaccttgcttccctagacatggctgccattcatgttgtgccttagatcgaatccaagctcatccctcaagacctgtctggttgacctagaccacagtgttctctatccatttggtgctttgatgatgtataatcgatt

SEQ ID NO: 166696 - DNA, 601 bp, Human
ctaagaagactttaagggacagttcttctggaactaaaagattttccacagtagctaagggaaaatagcaacctgtaaccttgcttccctagacatggctgccattcatgttgtgccttagatcgaatccaagctcatccctcaagacctgtctggttgacctagaccacagtgttctctatccatttggtgctttgatgatgtataatcgattcctttccctgataccagtcatagccatcagaacgctcactgtccccaatacacctcttgtggctgaagaaaatgaggaacaataatrttgaaaggtaaagatgacaggatttggaatcagatagcactggaaacttggctaggttactaaatctctcagaggctcattgtcttctgaaaatggttaataaaatatggtggctgtgaaaaataaataatgtagttagtgcatgtaaagttctgggcacagcactgagtgcataggataaaatagctattactgcagtagtaacaataagctggttgtgcactagtgacactcttttcctcaaaaaagtagctgtgggttatacttgtgagggagtgacaactgattgagtaaggaata

SEQ ID NO: 166697 - DNA, 601 bp, Human
cccaatacacctcttgtggctgaagaaaatgaggaacaataatattgaaaggtaaagatgacaggatttggaatcagatagcactggaaacttggctaggttactaaatctctcagaggctcattgtcttctgaaaatggttaataaaatatggtggctgtgaaaaataaataatgtagttagtgcatgtaaagttctgggcacagcactgagtgcataggataaaatagctattactgcagtagtaacaataagctggttgtgcactagtgacactcttttcctcaaaaaagtagctgtrggttatacttgtgagggagtgacaactgattgagtaaggaataggaacccagcccagcagcaatccacccatgggctagtcatgacccatgagatgacctggcccaaattcagtaaatttaattcattatagaccatggtaattatctcagccaattatactggattcctcaggaaatctgactggctagttgctctagagaggagaatgcagtacagttaccatgagaaagcccattcaggccatgggaaactcagacattttatctaagtttctaatagctttccaaccccagtttcc

SEQ ID NO: 166698 - DNA, 601 bp, Human
gaaaactgtaggatcctggggttgctctttgtttacaactttaaatttgacattaacttccataaatatccaattgttctcctagtttttcctaaatagattcatttcatgctcattttgtatcaaaggcaaaagagtccaaagaaaagtgaacaatatacagaatcactattggaagcatcaagaacataaagataataacttaggtttaaaacatttgcaaagtgttgtaagtcattagagaaaaaagttttgacctggaatatttgggtttcactcttctaaagttttaagtagagggcaaagagattgtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcatgaataccgtgagtggacataatcaaattaaatcacgagataagttaggaaccctgata

SEQ ID NO: 166699 - DNA, 601 bp, Human
ggatcctggggttgctctttgtttacaactttaaatttgacattaacttccataaatatccaattgttctcctagtttttcctaaatagattcatttcatgctcattttgtatcaaaggcaaaagagtccaaagaaaagtgaacaatatacagaatcactattggaagcatcaagaacataaagataataacttaggtttaaaacatttgcaaagtgttgtaagtcattagagaaaaaagttttgacctggaatatttgggtttcactcttctaaagttttaagtagagggcaaagagatkgtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcatgaataccgtgagtggacataatcaaattaaatcacgagataagttaggaaccctgataatatgaaaaa

SEQ ID NO: 166700 - DNA, 601 bp, Human
agaaaaaagttttgacctggaatatttgggtttcactcttctaaagttttaagtagagggcaaagagattgtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcmtgaataccgtgagtggacataatcaaattaaatcacgagataagttaggaaccctgataatatgaaaaatgtaataactttgatatttttgtcagaatcactcatcattattttaaaaaataccaagtaataaaaaaatacaagaaggtcttttttaattatctcaaatctcattattcagaaataaccattaccagctttagataaactctattgcagatacttctgtatgaatatgtatagagagaagagagatatataaattgttttatagagctgagatctcatcatatgtgctat

SEQ ID NO: 166701 - DNA, 601 bp, Human
tatttaattacatgtttacttatttaattacataattcaacttttgtgagttatggactcagtgctttgtaaaatggggaaattagcatcctgacactttctctcagcttccctacttccacattccaatgtttgttaggtatatcattatttttgcattgtgttacatataaatattaaccttctactaataaccataatttatagtattgcttatattagttctttcttaaaattctaatgttaccacaagtccttttatcagaacttcaattacaaattcatttttattcatcttttsagtagctaggttttactgaaacatgaagaaattagcctaagcatgaaaaaggagctgtctcagtttcagattaaaggggaaaaaattggcaggggaagtcctgtttttaggtcacagaggagaatgtggtgataatatccacttaggaatcacaattatttcagaggattaagaggcaaggtcaatgttcagagggaaggaagaggtgttaggatgggggcttcaaggagatggaagttcagacactgctagtagacatgagagagggagtggacaaaggacagatcatgatttctgggc

SEQ ID NO: 166702 - DNA, 601 bp, Human
cagtttcagattaaaggggaaaaaattggcaggggaagtcctgtttttaggtcacagaggagaatgtggtgataatatccacttaggaatcacaattatttcagaggattaagaggcaaggtcaatgttcagagggaaggaagaggtgttaggatgggggcttcaaggagatggaagttcagacactgctagtagacatgagagagggagtggacaaaggacagatcatgatttctgggcagtactgcagaggcaagtgggaaagaatggatttatggtggcaccagcagacatcttaagmatgtcttaagcaacattcagattagggttgagaggtgagagaaatggaatcttccaaataatagagtgtcaatgaaatagaagaataggtaaattggaaataacagtgagagagatgaaagggagagagctatggttggtgagtgggatattgaagctcaaggctccaaaaattgagcacttccagataatgatgaagttcatggaagtgaattatcaaagtaaaaaggagatgaaggtgatcaagacactaaaagtaacatgcacaaggatttgttcacatacacctcattcatgctat

SEQ ID NO: 166703 - DNA, 601 bp, Human
atggttgctcctggggaacttcaaatctctcatacttctgcctgctgtaagtagaccaagcatgcttccactgccagagaacaccctcaggagagcggtgcctgaaagacattggcatctgtatgtactctgtacaggtgacctccagggtggaccaagggaaggcaggcagtgcatcaatatcatgtgctacacagaggacctaaagttacataaaattgaggttcgtcagaggctagaaagaaacagtttgtgagtgaggctgtatgtcagatcccctctacgtgtctcattacctagrtgtcactctagacttgatataaatcagtggttcagtctttagggggtacatcatagtttgaatcccattgtggactgttagcccagccctaaaatagttggtgtttgtggctaatccctcataggagtgtcacacaatctagttgtctgtctcattcagtctggaaagctggttcaattgtatcaacaatgcattgtctaaaccacagccagtaagcaacaaggctcaaatgctttttgcaatagttgttaggcacataaacatagtgtttgatctgctttccctcatgtataaaatgaa

SEQ ID NO: 166704 - DNA, 601 bp, Human
ctcattacctagatgtcactctagacttgatataaatcagtggttcagtctttagggggtacatcatagtttgaatcccattgtggactgttagcccagccctaaaatagttggtgtttgtggctaatccctcataggagtgtcacacaatctagttgtctgtctcattcagtctggaaagctggttcaattgtatcaacaatgcattgtctaaaccacagccagtaagcaacaaggctcaaatgctttttgcaatagttgttaggcacataaacatagtgtttgatctgctttccctcaygtataaaatgaagggttaaacgaatgtctttctaggatccgttcgcgctgattacagacaaatgggagtgctccatgtaaacaagtccagaaagtttttgtgatagatttaatatatagtgcatgtgaggccgtgactgtcagcagaaggaaagtcttcacaaagcaggcaataatacattgaggtaaatttacaatgaggcttataatttcaagaggtttaaaggaagaggtttataaagaaaaccacaggatgtgcaatgaaatgggcacggtttttcggaggattgcaagtagtttt

SEQ ID NO: 166705 - DNA, 601 bp, Human
tcccgtaacttagaagccaagaagaaaagaaagaacagtggtgtatcaccatgatcctagctcacctaataggcacattactccctgatattccaaagaaataatgctcatttttaattttttctttctgggatgatatatggaaatgttgcctgaggctagaaagaaagtttgtgagtgaggctgtatgtcagataaccactacctgtctcattatctgggtgtcattctagacttgatataaaacagttgttcagttcttagggggtacatcatagtttgaatcccactatggacagtragctcagccctagaataatggataaccatggacaacacaagctgcttcatactgttttcctgcttatggggaagagtggatcctggaattacagaagagaattgagcattatccgtggagaacaaatgcttaggaatggcataggagtaggcagggctggcttacagccaagtgtactgagtgctaagtcagtgacttacccctctctcccctagtttcccttccacacagcctcttacaaatcagctaattacagaagaacattcatacatgagttcttattttattaacaagtgtgtg

SEQ ID NO: 166706 - DNA, 601 bp, Human
gtttttttagttatttggcattctcacacttggatgctcagaaacatgtgagcaaatagcactgaatgtacccacaattatgtcttgtgctcagtttgtaagtcactattacgtaggtgagaccagagcagttactgtgaagtggaggtagctgcatttaagactgtgaacagcgcatcaagaagcacacaccacaacgtgtgtaatgcccctgccatgatacatcacttcaatctaatgatgagaaagcagatgatcccaattgagagacagtctgcaaaataactggcctgtactcttyaaaagtattaacgtcataaaagaaagacagatagactaagaaactcttccaaattaaaaaaagaaatgacaaccacatgcaacatgtgatcttggattgaactttgggccagattttttatttttttttccataaaggatgctattaagacagttggcaacatatcagtgatgtctgtaaattagaaaatgatatcacattagagttaactttctgatgttgatacttatactgcctttttcttagaaaacacacacacaccatctacaacttattctcaaatgattcaccaaagtaata

SEQ ID NO: 166707 - DNA, 601 bp, Human
gatgagaaagcagatgatcccaattgagagacagtctgcaaaataactggcctgtactcttcaaaagtattaacgtcataaaagaaagacagatagactaagaaactcttccaaattaaaaaaagaaatgacaaccacatgcaacatgtgatcttggattgaactttgggccagattttttatttttttttccataaaggatgctattaagacagttggcaacatatcagtgatgtctgtaaattagaaaatgatatcacattagagttaactttctgatgttgatacttatactgccttkttcttagaaaacacacacacaccatctacaacttattctcaaatgattcaccaaagtaatacgtatatgtaggaaaataattttttaaatgcagtaaaatgttaacaattggggactctgggtgacatggctatatgagttattttcactattcttgcaacttttccataagtctgaaattatttcaaaagtaaaaaaattactgctaaaagaaaaaatgtgtacattgatgcaaaactaacattgaggtctctccctctatgaaatagagctgggttaaactttgtcaccaacaatggg

SEQ ID NO: 166708 - DNA, 601 bp, Human
ttggcaacatatcagtgatgtctgtaaattagaaaatgatatcacattagagttaactttctgatgttgatacttatactgcctttttcttagaaaacacacacacaccatctacaacttattctcaaatgattcaccaaagtaatacgtatatgtaggaaaataattttttaaatgcagtaaaatgttaacaattggggactctgggtgacatggctatatgagttattttcactattcttgcaacttttccataagtctgaaattatttcaaaagtaaaaaaattactgctaaaagaawaaatgtgtacattgatgcaaaactaacattgaggtctctccctctatgaaatagagctgggttaaactttgtcaccaacaatgggtttctgtcccagctctgccactatagagcagtgtgaccacatccacataattcaactttttgaacctcatttttctcatctatgtaatccagatgtcaactagaaatacctggacccttgagatgtagataagatccactcaaatccccataatgtaccctgtagaagtcttaacccttcccaatattcctttaaattctaggagtggagctaga

SEQ ID NO: 166709 - DNA, 601 bp, Human
ttaaattctaggagtggagctagattttcattttacttctggatacagttttctacttctaccaaaactttccagttaataaattatgtctccttcctacccaaacaatcattcttcacaatggttactcaagtgtaaaattcagccaactcccttgatttcccttcaccaaaaaactcttaccattcacccaaggcatctgtgactagaatgtattttcctgaagatgtcacaggtgccaggaggggatttatgttgcaaacacaaagaactttaagtaagcacttgctttgaggagtcrtttcatcccctcatcactgggcacgggcggtggcctcttcctgcccagcctcacatttcttgccagatcctcgccaccttcttttatctgccccttggtttctttagtatctcctcctctcatgggtgtgggcagattcttcccaggcagagcaggtcagatctccttgctctctaggcacccatgacctcaggtacccaccaaccatcacagaattatcccaaatagagacagtttcctcccgaagaagagctcagatgattacattctcaccctcagagtctctgcaaagtgagacat

SEQ ID NO: 166710 - DNA, 601 bp, Human
attcagccaactcccttgatttcccttcaccaaaaaactcttaccattcacccaaggcatctgtgactagaatgtattttcctgaagatgtcacaggtgccaggaggggatttatgttgcaaacacaaagaactttaagtaagcacttgctttgaggagtcatttcatcccctcatcactgggcacgggcggtggcctcttcctgcccagcctcacatttcttgccagatcctcgccaccttcttttatctgccccttggtttctttagtatctcctcctctcatgggtgtgggcagattyttcccaggcagagcaggtcagatctccttgctctctaggcacccatgacctcaggtacccaccaaccatcacagaattatcccaaatagagacagtttcctcccgaagaagagctcagatgattacattctcaccctcagagtctctgcaaagtgagacatagtgctagatacacgtggaggtcatctccagtggaaatatgctgagattctatgaagtgcacctgctttaaaaaaatggaaattactttttcaagcagacagatatcaaacacaagttcctttcctctagccttgttat

SEQ ID NO: 166711 - DNA, 601 bp, Human
tgtcccctagtggtcctaggctgtcaatcagactatcccatccttgcctgggagagcagctgttgtttcactgatgataaataattctgcttgaaaaaaaaaaagtggtttctctttagtgatggaaatagatacttaatttgtgttttagattagacatagtcactcttatgttgttgataattaagaaataaaatcactctggaagttgttcttctctctccctttgctctgaagttgaaactcaggcctgtctattaggtacctttagaattatcactgagatcattttaccttgcamacaatccagggaaatcagtaatcatctctgggcagatatcagtaatgtgcaaaacccatttcctacttgacttggaaggagaaagaaatgttaggaagagtgaaaaatgaatggggaaaaagaacacatcagttcttctccacatggtctctcatcctccagcagcctaccccagacctaaattcaaatgagcttccctttctctcccatccctactcctgggcatcatgttctgcctataagagattgcatgcaattgaaggaaataaagaacggtctctgagaaagtcaataaaatgc

SEQ ID NO: 166712 - DNA, 601 bp, Human
catgagaatttaacacttctttttatctgttcacaattggttgccagttccctggagttccctactgctgggaaaatggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcrttcacttctttttctccttccttctggaaccatgcatattttgccttaagagaacaaagtgatgatataaaaaaggtgtggtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtag

SEQ ID NO: 166713 - DNA, 601 bp, Human
atggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcgttcacttctttttctccttccttctggaaccatgcatattttgccttaagagaacaaagtgatgatataaaaaaggtgtggtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgca

SEQ ID NO: 166714 - DNA, 601 bp, Human
ggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcgttcacttctttttctccttccttctggaaccatgcatattttgccttaagagaacaaagtgatgatataaaaaaggtgtggtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcaca

SEQ ID NO: 166715 - DNA, 601 bp, Human
gaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcgttcacttctttttctccttccttctggaaccatgcatattttgccttaagagaacaaagtgatgatataaaaaaggtgtggtgtgtgtgtgtgtgtgtgtgtgtgtgtgtttcaatgaagaaaacatttcaaaacatactaaatgmccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcacaaagctcttaagcagctgcttctcagatgctcagaagacagtggatcttgggtctgcactccaaaagcaa

SEQ ID NO: 166716 - DNA, 601 bp, Human
gatcagtcaatttacctgtttattgcataagagtaagctcgtcagaggttcaaattttagctttatgagaccaattagctccattttctttcatagccaagaaagaatcccaaagaatccagactcaagggtcccaagatcacagcagtggggatgtcacccatcaacctggctgtccttgagtcccactcatctccatcaggaattccaggccaaaatctcatggattcctagtcatggttacaaaggggctgggacgtagagtaggaccaccacacaagcagtgtggatttacactcargagagctgggatttctgcagagagctcccattcatctggtcaggccctggcaccccctgagccacagtgtcttctctaaaaaaatgaggcagctagaccaagccaggtatgcaactcagtagcctaaggtaacacaaccgtggaaagggagcttagtgtgtgaccataggaagtgcaggggtaggtgggttctgatttgaaactaggaaatacatgacctttctgaggtcattcaaatttaaattttaaaatatttttacatttttaacttgcatcttggaaataatttagactttaaaa

SEQ ID NO: 166717 - DNA, 601 bp, Human
caggaaataaacattgatataatactattagctacaggccttattcaaaatgttccagttgtcccactagtgtccttttttctgatccacgattcaatccaaaatatgattatatttaatagttatgtctccttagtttcctctaatttggaaaagttctgcagctcttttttgtcgtttatgaacatgatgactttaaagagtactggtcagttatgagtttgtctgatggttctacctgaataaatacacgttatgtatttttggtgagaaaatcacatgaacaatgtgcccttcttartgcatcatagcatgactcatcactggtgaagttaacttagatcgcttgggtaaagtggtctctgccaggtttctccactataaagatacatttcccattgtttattattgtatctcacctattaattttagcatctattggagatgtttgccggccacaattactattattatgacattttctgaatgatgatattcaatgtccatcatttcttctacatttattaatggcaattccactgtaaggaagagttttccctgcacctcagtttacatttaatttcttattttaaaaaaacac

SEQ ID NO: 166718 - DNA, 601 bp, Human
tgagcctggaattatcacacgaaatatttatgttaaatttgccatggggaatatggcttttagtgaacaggaactaaatcacaaaagctacaatgttctaaaaaatttttattcacagaaaagacccctggttaagttggctatgccttgaagatcatccagtatctgctgatctgagtccaggcctgtccccctgtgccagggatgtcccttgagagcctttatctgagctgctccaagacggtgtcatcagttgacagacagaaccaatattattgtagagttttatgttaacacagcygtgaaagctgaagaaataaaacttttttttcagctagctacttgtttctgtagtccattgctgagtaacaaaccaacccaaaatttggtggtataaaacagcaattttattatactcatgaatgtgggaatttgtaatccaggcagggcacagtggaaatggcttgtctgtggtccacgatgtgtggaggctcagttgggaagactcaacagctagaggatgactggtatggctggagttggaatcatgtgaaagcttcttaatatgtgcatttaacaccataaatgggatgacttgaaa

SEQ ID NO: 166719 - DNA, 601 bp, Human
agttcacatgccataaaatttatcctctaaaaatttgcaattcagtgatctttagtagagttgcaaagttgtgcaatcattaccagtatctaattttagaatatttttaccacccttaaaataaatcctggaccattaacaatcactcttcatttctgtcccctctcagccccaggcaaccactaatctaatttccagctctatagatttgtctattctggacatttcatataaagaagtgatacaatatatgaccttgctgtcaggcttctttaacttagcattaagttttcaaggttcwtccgtgtttttaccatgtgtcattgcttaattcctttccatttagaaataatattccattgtacatatatatcattttgtttactgttttatcaattgatagcaatgtgggttgtttctagtttttgactatcatgaataatgttgctatgaacatttgtatacaagaatttgtgtaaatgtatgttttcatttctcttatatgcacccgtacatggaattgctgggtcatatgacaagtctatatgtttaacattttaagtaactgccaaagagctttccaaataggctgtaccatttt

SEQ ID NO: 166720 - DNA, 601 bp, Human
actttgttcttctttattaagattattttggctattcttggtctcttgagtttacatttgaactttaggataagcaaaaatgacagctgagattttgaaagtaattgtatagaatttacagataagttagggagcattgccattttaaaaaatccgtgaacatgagatgcttttccatttatttagatctttaatttctttcagtgatgctttgtacttttcagtgtatacatcttgcacttcttttgttaaatttattccccagtattttacttatttgatattattttaaattgacttrtattcttaactttatgcttggattgttcattgcttgtgtatagaaatataattgattttgcatgttaatcttatattctgcaaccttgctgactcttttgtcaattctaataatttttctggattcattataaatttctatgtacaagatatgtcttctgcaaatagagatagtttttcttctttctttccaatcttgatgcctttatttctttatcttgcctgatggcattagctaaaatctccagtacactcttgaatggaagtggcaagagcagataactttgtcttgttctggtct

SEQ ID NO: 166721 - DNA, 601 bp, Human
aaatagagatagtttttcttctttctttccaatcttgatgcctttatttctttatcttgcctgatggcattagctaaaatctccagtacactcttgaatggaagtggcaagagcagataactttgtcttgttctggtcttaagaaaatcattcagcctttcaccattaactatggtgttagctgtgagtttttcatagatagatttatcagattgagaaagttccctttcattcctaatttttttttttttttgagacggagtctcgctctgttgtccaggctggagtgcaatggcgcaakctcggctcactgcaagctctgcctcccgggttcatgccattctcctgcctcagcctcctgagtagctgggactacaggagcctgccaccacgcccagctaattttttgcatttttagtagagacgaggtttcactatgttagccaggaaggtcttgatctcctgaccttgatatctgcccacctcagcctcccaaagtgctgggattacaggcgtgagccaccgcacccagccttcattcctaattttttaaaacgtatttattataaaagaatgttgtattttgtcacatgtttttctg

SEQ ID NO: 166722 - DNA, 601 bp, Human
ccagccttcattcctaattttttaaaacgtatttattataaaagaatgttgtattttgtcacatgtttttctgcattgggatgttcatgtggtttttgttatttattctattgatatatttattatagtaattgattttcagatgttaaaacaactttgcattcctggggtaaatcctacttggttatgatgaaaatcctttttatatgtgactggattcagtttgctactattttgatgagcatttttttgccatatttgtaagggatcacaatctgtagttttcttttcttgtggtatytctgtcttttcttcatgtcagggtgacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttat

SEQ ID NO: 166723 - DNA, 601 bp, Human
tttctgtcttttcttcatgtcagggtgacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttrttgatattctttatttgatgattcaacattctaacactttcctttagttctttagatatggtttctttgaacatatgtctgggtatagtgatatctatatataatatcatgtgaatatttatagttatatagtttagtctttgtctagtaagtccaacatctgggcttcctcagagagtttttattattttttcctctatgtgtggagcatatgttcttatttctttttgtgtctcacaatttttcttgaaaatttgacattttaaatactgtaatatgacagtttggaaaccagagtta

SEQ ID NO: 166724 - DNA, 601 bp, Human
gacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttattgatattctttatttgatgattcamcattctaacactttcctttagttctttagatatggtttctttgaacatatgtctgggtatagtgatatctatatataatatcatgtgaatatttatagttatatagtttagtctttgtctagtaagtccaacatctgggcttcctcagagagtttttattattttttcctctatgtgtggagcatatgttcttatttctttttgtgtctcacaatttttcttgaaaatttgacattttaaatactgtaatatgacagtttggaaaccagagttacctctccccaggttgtttgttgttgt

SEQ ID NO: 166725 - DNA, 601 bp, Human
aactcatccttttttatggctgcatagcattccatggtgtatatatgccacattttctttatgcagtctatcattgatgggcatttgagttggttccaagtctttgctattgtggaacttaaataaatttacaagaaaaaaaacccatcaaggagtgggcaaaggatatgaacagacacttctcaaaggaagatacttacgtggccaacaaacatatgaaaaaaaatgcaccaccactggtcattagagaagtgaaaatcaaaaccaaaatgagataccgtctcacaccagtgagaacggygatcattaaacagccaggaaacaacagatgctggagaggatgtggagaaataggaatgcttttacactgttggtggttagtgtaaattagttcaaccattgtggaagatggtgtggcaattcctcaaggatctagaaccagaaataccatttgacccagcaatcccattactgggtatatacccaaaggattataaatcattctactctaaagatacatgcacacatatgtttatttctatttgcttatttaatgtctttctggactaattctataaagtctgtaatttctataatgtgc

SEQ ID NO: 166726 - DNA, 601 bp, Human
tcttaatatgcatcaataatggaaaggctaaataagtcatggtatagcccatgtaatggaataatatgcagccattcaaaagaaggaagtagtctaggtgatgaagtaatatgtaccataaaccccatgacacgtgtttacctatgtaacaaaccttcacatgtacccccaaacccaaaataaaaatttgaaaaaaggaggtagtaagtgaaagtctgtgatagcatctgagtgacaagagaagaaccactttgcataatatgtagtgtgtgtgtgtgtgtgtgtgtgtgtgtgtgtgtggttaagcaaggaagaagatctaaaactcactcatttgactattaaggaaataatcatttgctcttacaagtaggtaggcctagaggaaaaaaaacaaaaaggtaacctaactccaatactgccaaaaaagaaaacatgaagaatttttactttgttatctgtgtttttcggttttctaaatttactctacattttctttatattaaaaataaaataataataataaatattctttaagaaatatttgagccacactgaggttctatgtgatctaaaaatctcagattggccccatctatgt

SEQ ID NO: 166727 - DNA, 601 bp, Human
caaaagaaggaagtagtctaggtgatgaagtaatatgtaccataaaccccatgacacgtgtttacctatgtaacaaaccttcacatgtacccccaaacccaaaataaaaatttgaaaaaaggaggtagtaagtgaaagtctgtgatagcatctgagtgacaagagaagaaccactttgcataatatgtagtgtgtgtgtgtgtgtgtgtgtgtgtgtgtgtgtgtttaagcaaggaagaagatctaaaactcactcatttgactattaaggaaataatcatttgctcttacaagtaggtargcctagaggaaaaaaaacaaaaaggtaacctaactccaatactgccaaaaaagaaaacatgaagaatttttactttgttatctgtgtttttcggttttctaaatttactctacattttctttatattaaaaataaaataataataataaatattctttaagaaatatttgagccacactgaggttctatgtgatctaaaaatctcagattggccccatctatgttagaaaacttttctatcaaatcaaccacatctgcttcccttttcttccaaacactggatggcaacacacacaccaa

SEQ ID NO: 166728 - DNA, 601 bp, Human
cacccttttactggctatcttctcctgagttattattgggtgaggacttcgggttgcctgggaacatgttttggcctgtgatggatgggaagacaacaagcagtttaatgagtcattttacggaaggtttctactggtgaatccacatgctcagaggaggttgccatgccccacgttgtgaacggaaagaatgagagagccagtcagtgagcagctcacagcaggcagtggacttctcagtatccatgcatgactgtggccatgagactatctcagcctttctttttatcctatattttcyagcactgatctaatttgccttcatgtctcagctgtctacttgatgttcatcacccccatttttttaatcttcagtctttaccttgctcttggactccaggtcccattttctactccctgtgatggctcaaattcaactttcccccaatcaaacatatcatcttagcaacaaagtggcttctctcccagtgttcccacttcttgcctttcagaataggacctttagtaatcatattttccaccatcccccatacctacacactcatccaattgggtagattctgatttctgttacaagaat

SEQ ID NO: 166729 - DNA, 601 bp, Human
aactttacttttgcagtaacaattaagctgcctgtgctgccagccaaggccaagtattcttaaaggatctgtcatagaagccggcaccaagacctaagggagaagctctctattctatgtgataataaccttggccttggctataccaattcattacctggggatacccttgggcagtcatatggacagggatcttgccctgaacccaaggtgggcaccagtagacaaagatcaccctggtgcaccgtgacatttgtcttccctacacttcaaccctatgccataaccttgccatttatgkccagttgttttccttttagttatgtattttcttaaaagtcccattggctactcttcttccacgattaaaggcgttgctccaagattattcagaaacatataaactgggggcagaatgaaagagacatttaaaaggcttgggctgggaaagagaactgaggcacagtagaactcaaaagtccctgtttggtcagagagactatttagcaccactggcctgagcttttcccattctaacacatatgatctctgaaatgctgattcttgaagtatacagtgacacttttaaaatataaaatgg

SEQ ID NO: 166730 - DNA, 601 bp, Human
gggacaatgtgtctggaaggttttgataatgaaaataatttgaagaggtaataaatcaattcaacactgaaatgaaataatgaaactaaaaataccttctcaacatcagggtcaaaaacaaatattttatgcccaaaagctctgtaagatttgttcaacattagctagaacaataccaacaaatcttaaagccaaacctatcttcagtccctggtcaacatatcaaaacctcataaattctacaagtacctgaaaagcttccgaagagtagatttatttaagataatatttgcttcccagmtctgtcaaaccatacttgcacatctgaaatagaatattaaagtgaaatatattttaaaaacatgaaggactcataattctatgagtaacacacactagtcttatggaagcaaaataatttaattaaaaaataacctgaacttcatttcttgagagaggttatatttgagaattaaaaacatttatttcctttactaagcaattttactagaccatacaattattcctcatttttaaacatgtttcagttttacaagtcagaaacttctatcagtccaataaaaactttccttgcttctct

SEQ ID NO: 166731 - DNA, 601 bp, Human
ccaaacctatcttcagtccctggtcaacatatcaaaacctcataaattctacaagtacctgaaaagcttccgaagagtagatttatttaagataatatttgcttcccagctctgtcaaaccatacttgcacatctgaaatagaatattaaagtgaaatatattttaaaaacatgaaggactcataattctatgagtaacacacactagtcttatggaagcaaaataatttaattaaaaaataacctgaacttcatttcttgagagaggttatatttgagaattaaaaacatttatttcctytactaagcaattttactagaccatacaattattcctcatttttaaacatgtttcagttttacaagtcagaaacttctatcagtccaataaaaactttccttgcttctctcatctcaaagaatggatgatatttcctttgtgttctatatttagaagctatatctttctagcttctttcttatccaaatgtatccacatgtttaataaccataaaaggcagccacacgttctggtagtgatctgtttttggtctttaagggtctattcttgaatatatctgtggagttttcaagatactgc

SEQ ID NO: 166732 - DNA, 601 bp, Human
aataccactggagcaaaagaaaagtttcctattctttaaaatcaactggacatgatttatatgatttgtgtgtattgtggccaaactctccctttcaattatagtagttaattatttgattatttattataaattaaaagggaagagaagggaaaatgctgttatcttttggaaagtctattttcttttctttctttctttctttttttttcctgagatagagtctcactctgttgcccaggctggagtgcagtggcacgatctcagctcactgcaagctctgcctcccgggttcaagtgwttcttgtgcctcagcctcctgagtagctgggattataggtgcgtgacaccacacctggctaatttttgtatttttggtagagatacggtttcaccatgttggccgggctggtcttgaactcctgacatcgggtgatccacccgccttggcctcccaaaatgctggaaagtctactttcaaattgaaaatgtcacggagaaaaatctcctccccctcttttgtcttgaccacaccttcctccagtggataactaatggaatttgaggtgacctctacttaccatcaccatgactgcatgag

SEQ ID NO: 166733 - DNA, 601 bp, Human
ctgacatcgggtgatccacccgccttggcctcccaaaatgctggaaagtctactttcaaattgaaaatgtcacggagaaaaatctcctccccctcttttgtcttgaccacaccttcctccagtggataactaatggaatttgaggtgacctctacttaccatcaccatgactgcatgagagcctcacagtctgggggctgggtaaaaatagaaattagatagttttagtgcctttttaagggatttatacccaaagaataggctgttttttatccttatacttgttaactctaagaggatraggtctgaggttgtgaggtgctgctctgagaaacatatagaaattttccaatttatcttccaaatgttttattgaaggaaaaaaataaagcatatagatttgattatattttacttattaagaaacatagtcatggtaagtttattaatattatgagaaacacaaaagggaaaatagcattttgtatttttctagaactttttattctacagggcatttgtggctgctatttcttcatattctcatttccttgtagcataaattggacaaagggtggattctgagttccccaaattctca

SEQ ID NO: 166734 - DNA, 601 bp, Human
gctgagtatgcagttggcctcggttccctggtgaccctcacagtggaagcatttcacctttctgggggtgagcctgtagcatttaaagttaatacttttgatacaaaatatttcctaaacgcaagctgacttcttcatttgctgtgagaacaatgggacacgaccagggtccattgtgaaagggaaattccacccttgtgatgtattgagacacaatatcagtttctaacccttaaggagttttcaaagttaattttaaccatgcataagttccactttgcacactttagaattcactccctaaggcgtgattcttctaggagaaattaaacaaagatggggtcttcattttggatttcccagaaacagactctgagatgcagagttgtatgccagagacttcttggagagcaaggaagagaacactgggcaaagggagaagctgagcaaatgggctttcaacaggggcctcagtcaattttacaggaaactcagaaacaggggtggcccttcagagttaccccagtgtgaggcaaaggaaccggacctttgtgcccccataatgaccagttattggcatgggtactccctcaaaggaaac

SEQ ID NO: 166735 - DNA, 601 bp, Human
gttccctggtgaccctcacagtggaagcatttcacctttctgggggtgagcctgtagcatttaaagttaatacttttgatacaaaatatttcctaaacgcaagctgacttcttcatttgctgtgagaacaatgggacacgaccagggtccattgtgaaagggaaattccacccttgtgatgtattgagacacaatatcagtttctaacccttaaggagttttcaaagttaattttaaccatgcataagttccactttgcacactttagaattcactccctaaggcgtgattcttctaggaraaattaaacaaagatggggtcttcattttggatttcccagaaacagactctgagatgcagagttgtatgccagagacttcttggagagcaaggaagagaacactgggcaaagggagaagctgagcaaatgggctttcaacaggggcctcagtcaattttacaggaaactcagaaacaggggtggcccttcagagttaccccagtgtgaggcaaaggaaccggacctttgtgcccccataatgaccagttattggcatgggtactccctcaaaggaaacatagtcttaggtaaatcacgtc

SEQ ID NO: 166736 - DNA, 601 bp, Human
agatcatgggcgacatgataagctggggaaagaactttgaattgactctgaatgagatgtggcttctgtgcctatgggcaaataatagacaatggggtagaggtatggatgagggacaactggactagagagatccatgcaaggtgattgcaatatttcagaagagaaaagccagtggcataggccaggatagaagtggtggaggcagtgagaaacaaatcagatctgggagtatgttgtgaaggtagtcttcaaattcgttgatgcatttgctgatggattagatgaggaatgggagagraagtgagaaggcaaaggtgactcctaagttgttggcctgcattactatagaatgaaatggcacttatgcatatggacaagatggtgagaggagcaggttgatggggagtggttagggaattaagagtttagttttaagcacgttaacatttgagatttgtattaagtaaccaagtggagataatgtgaaatgaacagatggacttaaggatctaggagagaggtcagagttggagatataaattgagaggcatccatctattgttagtgttcaatgccaggagactagttgagcttacct

SEQ ID NO: 166737 - DNA, 601 bp, Human
agaatctagctcttaaacctgcaatcccaactaggcactaactcagagccaagaccgcgttctgcaagctgccaggtgaagttaccaggaaacagcctctgtttgacatgtcaagggaagaacctgaattgggcacctctttttaattttgagaaactataaaagccatgagaaagatcatgtttgactgtaaaccaaaaagaaaaaaccttaccctccaattaaggaaaataaaattataagttgttgttgatttaattctgatcatattttcatagatttcagaaagatatagtttttwaaagaatttcctgttaagattcaaaattttttctaggatataatttctcactcctcaaacctctgcttcaaaataaattttattcaatatttagcataaggagactataaagttccttaatggtgacataaatgaacagttataatcgtatgtctatctagctactgaatatttctaagataacgttttgtgaggcaaaagtggtttgaagttggtgatgcctcaaaaaaaaatttttttaatactctttagaactctttctgggtattttaaaattggtttagctatttttcctttttg

SEQ ID NO: 166738 - DNA, 601 bp, Human
ggccaaattaatctatcttccatgtgagaacccttcaaacatttgaaaatagttatcatgccccctggaccttcctagagtaagcattcttagttctttcagatgttttcattgaatttggcacttctttcccatgccttcctgattacacctctctgaacattactggagaacaatacattataacatccaggtctgctctgattatttcagagtagtattgcatgctcacttcccgtatctcccacattttaaaagctattcttctattagcacatcttaaaatcattttagcattttktggaagtcatagatctcacattgattaatagtgaacctacaattagctaaaatttctaggttcttctaaaatacactcataatccatccttgaaggatcgaggtattggttctaaaacaaggaacctttaaaaaggatttattttttgaattttcatcttattagagttcattctgacctgtcaagattttattagatttggattcagtctcctttccactttcttgtcatctatgattttgatcagcatcaatatcttcaacagttcttaagaaaaaagttaaatagtacaaagaaaaa

SEQ ID NO: 166739 - DNA, 601 bp, Human
tctggcaatcaaatatgatagaaagaaaggttcgaaaactgtggacttttactattgttcatagagattcaggctagagtcttaagttttgtgctgacaaatctaaaagtaacctgactaaaaatgtgtagcaactgagtttaaaagaagctcaaataaaattatctttaaaaactcaatccaatgtaagattaaataggaaatacattggatttacattttctttgaagtataaggaaacgtgcagtctgctgggatccatcacactgcttggtctggaaaaagaggagggtgaattcaraactcttgtccctctctaaattcttgtaaccttctaatctctctggagtgtaaacttgtggccaagattttgagctctggataaattctagttttaatctcaggtccaccactcactcacttgccagttacataagtttacattgttatttaacatctcacaaccacatctatacaatgtgggtaataataatattacttatctgaaaggttgatgtgagcattaaatgaaatgatgctagggtaaacgttcaaaagatgacagccatgaccaataatattttgttctctagcattcgat

SEQ ID NO: 166740 - DNA, 601 bp, Human
catatttgccttctccttctttttcctggagacttctttcttctccctttaaaagcaaatatttttacttgaaagtatagtaacccaggtgaggttcaccttcaagactctccatctgaggtcaaactgggcatgtgacatttctcagttgatttaccatccacgttgactacccatctattaggcagattttggagacaacctctttgtcctcctaactgtgcaatggaattaggcttctcccttatcgacaatgaccccatacctaacttcagccttcctggaactccctttttatctraacacttctcctggccctgatgaagaatgcagtccagaaggaaagccagtgaactttaaggtcaggtgctcctgtcccttgggagcaaacctcggtaaagactagatcccaaatgtgggtgctatatacaactagttccaccccttactatgttaccagtgttcccatggtgatgctgagaatgttacaaggacctttcactcagctattgtatcagttcaggctgcttggtctgggcatgccaataaccatatataaatgttttgtttctctttattctaattaatctgcccacttaac

SEQ ID NO: 166741 - DNA, 601 bp, Human
tcaagagtgagcatttttttgaaacgcagttaagacttcagtttcctgcaccgaagaactaagtcactggcaacttgtcatgctagagaaaaaggcaggggacaattccatctcaggtatcatcacttcacgttgcttaccctacctacctaaatccagctagcatgtttgctcagccccacgtcagctagagtagaaattacttatccacttctcctctacacaaacctctctttatgagtacagataaggaaaacaagcctgccaaatgacagtttgtcattgcaggagccatggccaraatccacatttcccatatctaatgagtgtgactccagccatgttcttcatttacatttatatcgttcacaggaatccatgtagccctgacttttgtgggcattgttatatcaactccacccccaccattgccatctcatctggtttgggagttaacaaagctctgtcatcttctgagtactgtgtgagatggcccagaaaggtatcattgttctcacttgggaacattgttcccactaaatggagagatggaggtttatggagctaacagtcaaagagtagcagtcacatccaggtcttc

SEQ ID NO: 166742 - DNA, 601 bp, Human
aatctctcactagccctgaattcttcagtagactgtattttgagctcctgctgcaggcaactgcagacagattggccacataagagcagtagccttcagaccaaagctcagaggaagtgccaaaacatgtacaaaccctggatgggttctggccttggcaatcatgagccaccattactgttaaggaattaggagtggaatagtggaattttccttgctccagattttaaggacacactcaacttcatccaggccccagcacatcacagacccacctatgagtcagtactaatggcagtaytagtggcctcaaaggacatttgaagaaaaattgttacttaccagaccccaccagagctgctgagatgatcccatgtaaccctaactacagagttacctttagcttttttcagttaaattgtattttatgtgagttttaattgacacaaaatataattttgaaagcctgcaaaaaaatgcataaatgtaaggcagaaatggccaggacattcctccaaataactctgcctggaaaacaaaatcttgctgtcattactggattgttcttgttttctccacatgaacaaggtttggataatga

SEQ ID NO: 166743 - DNA, 601 bp, Human
caatagggtgtatacatacaggttgtatatgtaaagagagatatttattttaaggaattggcttatgcaattgtgaaggctggcaagtccaaaatctgcagggcaggccagcaggctggaaatgccaacaagaatttatgctgcagctcgagtccatggcagtctggaggcagaattccctcttccttaagcggaccatagtcttttctcctaaaaccataagataagacccacccatattttgagggcaatctgctttactcagctctgctcacttaaatgttaatcacatctaaaaaaraaaaataccttcacagcaacatctaaactagtgtttgaccaaacatctgagcctcgtggcctagcccagttgacacataaaattagccacacatccagtgggcaagacagacaaagtcacaatagacatcgaaggctactggcggggactgagagaaagtggggagtctacaagggtgaaggagaggaaagcaccgtgaaaaatacttgcaaatatttattcatgaggtcgggaggcatttcagggatcttgcaccagcatgtgcgtgtctgtgtgtgtgtgtgtgtgtgtgtgtgtgtt

SEQ ID NO: 166744 - DNA, 601 bp, Human
ttttcttttctcacagaaatggaatctggaggcaggcagtatagagctgatatgagagctccacaaagtcataaggaacctaggctcctttatttttttggctctgtcattctgaacatataacttccaatctcgagatcacaaaatgactgctgaaactctactgtcacatccctgttccagacaagaaaatcaagaaaaatctaggggtaaaaagtgtctttcataggagtccaaaaatatcattgcccacaccttttggcaagaaatattgggaagtataattttgtgactgagcacwttgcagtcctcagtaatataagggttctattaggaaggtcgaatacagcgcatggatattgagtagataagcagcaacctctaaatgtgtcccatatcttgatctttttattcatagagtcctcactccaaaatcaaatacatattacctgcatttctttttatttctttcatggcctcaattttaactctaattcattttgcatttattttagtatgtagtattttaaagcattttttcttgttttagaaagaaaagaaaggccttaaagatctgcccccattccatctttccaaaaga

SEQ ID NO: 166745 - DNA, 601 bp, Human
gtcccgctgtttagcccaggccggattgcagtggcgcgatctcggctcactgcaagctccgcctcccgggttcacgccattctcctgcctcagcctcccgagtagctgggactacaggcgcccgccaccgcgcccggctaatttttttttgtatttttagtagagacggggtttcaccgtgttagccaggatggtctcgatctcctgacctcgtgatccacccgcctcggcctcccaaagtgctgggattacaggcgtgagccgccgcgcccggcctgcagtcctcattttaaggcctgcstattttatgcttctccagtgttttcctttttccctttctagtcttctgctggaataaccaactttactttatttctcctgccctcacacatgaaggttagacagtttcatactgaattcagaagccacaatccattttcctctgagctctgtaaaatatatcacatgttctcttagcatttggtatttccactggaaagtctagtacctgggaagctccatttgatcctccttcctttataatgtttttcccccttgtctaaaagtttataggacttttcctttatcctataaattcaga

SEQ ID NO: 166746 - DNA, 601 bp, Human
agagtctagggatgtctctgtttttcctcgcagagacaggtctgtatttagcccccttgctcacagttgagagattgctgtccacatacttcaggcccagaaaaggaaggagtgaaatgctgagatttgctctggttttatttcacctgttcagagacccaggggaaagtgtcagagttcaagggatggtcacaacatccagcctgactcccaccccttctgctgaggcagccatgagttagccccagcagtctccacagttcactggctacacctgccctcattagaagtccacagcccygtcctcccaacagagccatctgtgtctattgaacccagtgtgtgcactgctgtgggcgcctgttacccagtggcattgatggaattaaaatgcatctccccaaggcctggccggctgagtgacagggcatagatgggttccccagaggtccttgcccattccccagaggtccttgcccagcctatctgcatgaaatatggaagaaatgctagctaacttaaattatgcatgttgtctgatttacagcccaagtataggtttcagtttttgcatcccttttagttccttctgcagtttagg

SEQ ID NO: 166747 - DNA, 601 bp, Human
gagttcagagcaatacatgatgaactgcacacaaactctttcggccttggtaactttcctgaggaaatagatgtcagacctaatcacaactcttttgccattaagtcttaggggaaagtttctcttgaaactatattggtatttagaaaaagctttgaatctaaatgtcatgcatctctcatttagatagataatttgtgagggaaaatagtctggatgctattggctcattcattcgttctactaaaggtggaatgatatgttaatgtcttatcagccaagtcaacctagaaataagaakgtcaaccatgttaaattgtaagattattcaatcttatagattataattccctatagcatgcagagttatttcacaggctttatcttcttaatttgacaaattttttagagaccctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgag

SEQ ID NO: 166748 - DNA, 601 bp, Human
ccctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgagagccctagagggatgaaagagagtttgtcaaagcccattctgaagtgaataacacggtcataagaatgagccatggggaatatgacaaacagcctggtgtggccaaagggtrgtggtggcagtggcagaagagaagcagcctgagagatggttagggccagaacaagagccataggatctctcctagtacaggtgggcttcaactatccgcgtttttacatgttgctttggcaaacttgagagaattgatgaatgccttctatcccttcaccaagattgtattgaatcctcttccatatacctaccagcagtgttctaggctctggggatacaacatactccctgatttcatagagtttacattctctatgaaacagataattaatttaaaaagcaataaataaaaatctat

SEQ ID NO: 166749 - DNA, 601 bp, Human
cctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgagagccctagagggatgaaagagagtttgtcaaagcccattctgaagtgaataacacggtcataagaatgagccatggggaatatgacaaacagcctggtgtggccaaagggtartggtggcagtggcagaagagaagcagcctgagagatggttagggccagaacaagagccataggatctctcctagtacaggtgggcttcaactatccgcgtttttacatgttgctttggcaaacttgagagaattgatgaatgccttctatcccttcaccaagattgtattgaatcctcttccatatacctaccagcagtgttctaggctctggggatacaacatactccctgatttcatagagtttacattctctatgaaacagataattaatttaaaaagcaataaataaaaatctata

SEQ ID NO: 166750 - DNA, 601 bp, Human
agagtcaaatttgagctgagagccctagagggatgaaagagagtttgtcaaagcccattctgaagtgaataacacggtcataagaatgagccatggggaatatgacaaacagcctggtgtggccaaagggtagtggtggcagtggcagaagagaagcagcctgagagatggttagggccagaacaagagccataggatctctcctagtacaggtgggcttcaactatccgcgtttttacatgttgctttggcaaacttgagagaattgatgaatgccttctatcccttcaccaagattgtrttgaatcctcttccatatacctaccagcagtgttctaggctctggggatacaacatactccctgatttcatagagtttacattctctatgaaacagataattaatttaaaaagcaataaataaaaatctatatatcaagaaataaatactctgcagagtattaaagcatggaatattagtcttttctcactttgctataaaaaaacacctcagactgggtaaattataaagaaacgaggtttaattggctcatggttctgcaggctgtacaggaagcatagtggcttctgcttctgggga

SEQ ID NO: 166751 - DNA, 601 bp, Human
tcttgaaatagcaactcactggataaatggacctaccatttagcaattttcaagatttccaacctgctttgatttcctctctaggtagttttttattttgtgtttcagcgggcatcaactttgcaatatcaggaaaaaccagagccaggcttgaaaataatgctgagacatctagactcaaacccgggacacaagtgggaatgaatcaagccgggaggatttttccaaatctacaggaagtgaaattcttctgctccaggcaatgtttatcacccatgtagaaacctcattggtttggcarttgtgagctaacagggtatggcctgagttatgctctgaatagcttacagttactgccttggatgtgaacgatttgggagggacaagtctgtgcagtggcctaaagtgaggcgtgagtttgtgcctagcttgtctgtgaaattgggtttgttttttctgcttttactacacattaagccagatgaacacaaggacaccagttgttacttttgaatgatttttaaaattacatctctagtagggaatattgatttactttattgattttttaagatcctttctatttctttagtgtctgcta

SEQ ID NO: 166752 - DNA, 601 bp, Human
cggcgcctttctggtgccctccacgccctccacgggcaggggcggagctgaggggcccacacagctccctctgccccaaacggggcagagaatgagtaggtgcctgcagccaggggcgcgcccatcctttcgcacacaacaggctcctgttctctaggcagtgattaagtgagaaaaagagaagcctggcttgggggtgagtctggcgctgggtgaatgtgaatcgccgacacggtctcctgcagggctgcggcgtcctggcccgtggctgtcattctgtcccggtgcttcacccccggcyggtgtgaagccagtgtgaatccatggcccgcgcggacacacccgccaagcaggcacaggagcaaggggctctagctgcgtccactccccagggttaaaaattaactgtccggccttgctggcatctctgttgacaacgcgatcattcctgctgggagcgagtgcgccacagagattaactctgcctctccagtcaggccgcctgggttccactcctaagccttaccctctttaaggctcgttcttcataggtcagatggatctcagtcgtcctgaccgcatagggttgctcaggcataga

SEQ ID NO: 166753 - DNA, 601 bp, Human
attctaagtgaatctagagtgctggcaacccagaatccttttccaggattcaggatggaatcttacaggagatacacagtcctataaaaagttagaataataacgcagcatcaatttgtgcttgatcattaagctaataatgcctcctttctccaccagccccatgtttctgatactgtgatgtgtgatgttgtagttgtgaaatgtaatattgtgatgtggcagacagattataagagttgaatgcaccaggagatttcctgtggcattataagagttgaatgcaccaggagatttcccrtgacataagtaattctcaggccctatgaagtgcaggctttaaaaaaatctggttcagcagccaaaagtcatcaaaaattaatgctagtattttctctctcagagaatgctaatgggaacatgttctaaagtccacttttctttccttccttgttttctcagctttttgagagtgccacattctctctttttgccctgacatctcccagcttcccaaacattctgactcagtcttttcttctctcccaacagatgctcctgctagctcttagttaggtaaatcaacttagcctctctatat

SEQ ID NO: 166754 - DNA, 601 bp, Human
ccttccagacccagttgacccatcttttctttccttttctcactggagtgggcataatttcctgccatttcccactgtgctgccgccaattctggctgtgtccattagtgtccctcttgacaaacttggatttgaaaaatgggcaactaaatcttcatttattagacgtgtttttcttttactaacagctgccatctgttcctctccacctcaatacaactcccccaatccctccagcatcctttttggacattttcattccagttcctctttattcatgtgcacattcaattgccagacmgtttttgaaagagtagaaataagaagtaacagaaaatagaaataataataaaatactacccccaaaataaaagagacatgggaagagtttcttttttcaaaagggaacacataaacaacacatgaaaggttggaaaataacaaagaaaataattttttaaaaaaagatgtagacgcaggaaggacaattatggaatggctggaaagattaataataaccaaatagcttgagggttgcctgcagcagagatgaagagaataaatcagaatagaaaaaaggtttgcctgattctattttaca

SEQ ID NO: 166755 - DNA, 601 bp, Human
agtggcaccttcatgacttaatcactttccaaaaggccccagttcttttttgttttgttttgttttgtttttcttgagatggagttcactctgtcacccaggctggagtccaatggcgtgatctcggcttactacaatctccacctcctgggttcaagtgattctcctgcctcactctcccagagtagctgggattacaggtgcatgccaccacgcctggctaatttttgtattattagtagagatggggtttcactatgttggccaggctggtgtcaaactcctaaccttaggtgatccrcccacctcagccttccaaaatgctgggattacaggcgtgagtcaccgcacccagccaaggccccacttcttaataccaccataatgggaagtaagttacaacacatgaattctgagggacattcagaccatagcaaatagtgtccttataagaagaggagattaggacacagacgcacacagagggatgaccatgtgaggaaacacagggagaagacagccatctgcaagccaaggagaggtgcctcagaggaaacaaaacatgccaacaccttgatctcggacttccagcctccagaac

SEQ ID NO: 166756 - DNA, 601 bp, Human
gtccttataagaagaggagattaggacacagacgcacacagagggatgaccatgtgaggaaacacagggagaagacagccatctgcaagccaaggagaggtgcctcagaggaaacaaaacatgccaacaccttgatctcggacttccagcctccagaactgtgggcaaataaatttctgttatttatagccacctgttctcacagccctagcaaactaatataatcggttcacagtcatctttttggtacttccagaaacaggagattaagtaacatacccaagattacaaagctattaaygtggagccagggttctaacttcagtctactgaactacaaaaccaagttctgcatattttaaactttcctctgaagcagaaacaaattataaatagggactaaatagaaagtaactaaagctttgttatatgtttcttcaattgctcagttttccatgggcagcacagggcactcattgctgtttcttttctacagcctccagcctaggacagcatttttgtttataagatataaaagccagccagtgttttatccaggtgagctgacactcttgtgtcccacccactgtcctcaggcctg

SEQ ID NO: 166757 - DNA, 601 bp, Human
ggctatgtcaactttggctcacccctaagtcctcaggacacaggacataagcagatgcattttccgagggcgcccggcctaactgtaagtctcgtgaaggcaggggccaacatgaatacatcctgtatcctccaaagatttagcaaaatgctaggtcctgtgccctaccccgacccccacccgtaaataccaaggaaggaagacgccctctgccccttcccctctcctccctggggcagagcggcgcccggacctgctcgctgccatggcaacgcggcgctccctcccatagacagtgcamcctccacgaagtcaccgagcagctgctaccgctgtgtctccgccagtgccatttctgcttcctcgaattttaaattggccaggataatacaacaaattaaggtatttgctggtttctattaccattttttggtaaatcactttttccctattaatgcatgggaaagagattgccagcaaacacaccattaatttcactgagaaaaagctttaaatgctcagtcatgtttttctaatacaattcagtgcttccaaatttatttactgctgcctcaaaaacaccaagtaaatcatgctttta

SEQ ID NO: 166758 - DNA, 601 bp, Human
gaaccagcagcaccagtgtcacttgggaattggttaggattttctaagaccctgctccagacttacggaatcacaaactctgagagtggggcccagcaatttttgttttaataagctttcctgaggattctgatgctgcttctaaatgtgagcaccactgctctagaagaacaccaagaaactgagctgtgcacagcattcaccattgctgacctgctagaaggttgatggttttcaccgtagcattcgtaatcttggttgtatgcaccctgcctttattttactatatatgcaatatagwctttgaagtccctgtcctaccaagagaatcctaccttattttgggctttggctgctctaaaaatgaaaagttttgaaaagcacaagtcaccctaaattggatcctgggttgttttttgatgggggcataaagaacatcattgggacaattgatcaaatttgaataaggtatagattagataatagtattgtatcaatgttaatttcccaatgttcacaactgaactgtggctatgtaagagaaagtgactgtttctaggaaacacatactgaagttttttaacttcagagagcatactgt

SEQ ID NO: 166759 - DNA, 601 bp, Human
aatttgaataaggtatagattagataatagtattgtatcaatgttaatttcccaatgttcacaactgaactgtggctatgtaagagaaagtgactgtttctaggaaacacatactgaagttttttaacttcagagagcatactgtttgcaactttcaaacagttcagaaaaaaatgattttgcatatgtcgtatgtgtagaaaaagaatgataaagcaaatgtggtaaaatgttatatttagaaaatctgaatgaagagtatgtaggaattctaaatactcttttcccaatttttgtattrtttccaaattaaaagtttacaaagaaaaagcaagtagatccaccatgacttgtgctccaaatgtatgcaactgattttgcagaatctcatgcttcatgctctatcctgttttggagcataactttcctccctccaaaggaaacaagagacacctatggaaatgctgatggagcgagggtggtcaccaggcatggagcagcacaggaacacaagcttcttgaggcctcccaacttgataatcttcacagctggaaatgtcccccttccttcagaatttctctgacattattgtctgtcctg

SEQ ID NO: 166760 - DNA, 601 bp, Human
catagtctcagggggctcagacttctttacaggctgactggcttgccctaggccaaaacgcaagatgtccttttctgacgtattcttgtaagtcagacagcatcacagcatcactttgtgtgtgtgtgtgtgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgagatttggcacacccatcacccragcattgtacactgtccccagtgtgtagtcttttatcccttgccccctcccatccttccccctaagtcccccaaagtccattgtatcatttgtatgcctttgtgtcctcatagcttagctcccacttataagtgagaacatacgatgtttgatgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcat

SEQ ID NO: 166761 - DNA, 601 bp, Human
ttgtatgcctttgtgtcctcatagcttagctcccacttataagtgagaacatacgatgtttgatgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacytatttcatgataaatcagtggttgaatcagtcacatgctcatccaggtcaaagagaggaacacaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacgcca

SEQ ID NO: 166762 - DNA, 601 bp, Human
atgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacctatttcatgataaatcagtggttgaatcagtcacatgctcatccaggtcaaagagaggaacmcaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacgccatcctttctttaagccacagctttataaaaacctagtcactcaaacccaggctagcaactagt

SEQ ID NO: 166763 - DNA, 601 bp, Human
tgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacctatttcatgataaatcagtggttgaatcagtcacatgctcatccaggtcaaagagaggaacayaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacgccatcctttctttaagccacagctttataaaaacctagtcactcaaacccaggctagcaactagtt

SEQ ID NO: 166764 - DNA, 601 bp, Human
gacactttttcatgattttgtcagatactctgaatttaagtagattactgctttcaacagaatatgacgaaaaccacagtggggcattcttgggcttgcttttcagtttttgcgatgttcttagggaaaaggtcttactgggtcaggtttgccaggctctgcccttggagcacattttcagcacttggttggaagaagattcatttaaccctcagctgtagatgagaacaggatgcagcaaatttactgcaaaccagaaaataaaattggcttttctatccaagaaggaaataaagaaaamtctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccaggtatggtggtgcatgcctgtagtccctgctactcaggaggctgaggcaggagaatttcttgagcctgggaggttgaagct

SEQ ID NO: 166765 - DNA, 601 bp, Human
agatgagaacaggatgcagcaaatttactgcaaaccagaaaataaaattggcttttctatccaagaaggaaataaagaaaactctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccrggtatggtggtgcatgcctgtagtccctgctactcaggaggctgaggcaggagaatttcttgagcctgggaggttgaagctgcagtgagctgtgatcatgccactgtattccagcctgggtgacaaagcaaaaacccatctcaaaaaaaaaaaaaagcattaggagaagagaaagagggaaataaggtctaaatgtcccctttctgcatacaatgtgcctgggttcaggtcagatcaggcaggtactggaacttgggttcaggtcaggcaggccctggaacttgggccagttgctcttac

SEQ ID NO: 166766 - DNA, 601 bp, Human
gatgcagcaaatttactgcaaaccagaaaataaaattggcttttctatccaagaaggaaataaagaaaactctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccaggtatggtggtrcatgcctgtagtccctgctactcaggaggctgaggcaggagaatttcttgagcctgggaggttgaagctgcagtgagctgtgatcatgccactgtattccagcctgggtgacaaagcaaaaacccatctcaaaaaaaaaaaaaagcattaggagaagagaaagagggaaataaggtctaaatgtcccctttctgcatacaatgtgcctgggttcaggtcagatcaggcaggtactggaacttgggttcaggtcaggcaggccctggaacttgggccagttgctcttacctgtccctgaac

SEQ ID NO: 166767 - DNA, 601 bp, Human
cttttcagaccccatacaacagttccataaaagtgatcaaatttcacattgtgaaacgagacacgatgcagctttttaaaatgctgacgaggcatgaacaacctggtggctttcatttgctttttgacctgagcatgttttgaagtggaggagacaagtgaacaaagtgaacagaaatcagtgaactccatcagagaaccacggtaggcttgttcacaagctgctgtgagccaccacgtcctgggtttctttgttttgcagcaacagtagctggaacacaaacattgagctcatgatccgycgacatttcctcattggctttggccatttagcattgcaggcccagcccatgttgatttttttattcctttacaattaaaatgttttggttgtttttgttgttgttgtttctgcttgaaggcttctggaattttgtctctatcactgcaatttaaatattccctggaatatggctaaatacagatctcatgttattaatcttgcctagagtgaagtgagcctttcattctctacactgaagtgttttgcttcgtggcttttccaacggttctgtttatttgtttgtttgttttccaggaat

SEQ ID NO: 166768 - DNA, 601 bp, Human
acgagacacgatgcagctttttaaaatgctgacgaggcatgaacaacctggtggctttcatttgctttttgacctgagcatgttttgaagtggaggagacaagtgaacaaagtgaacagaaatcagtgaactccatcagagaaccacggtaggcttgttcacaagctgctgtgagccaccacgtcctgggtttctttgttttgcagcaacagtagctggaacacaaacattgagctcatgatccgtcgacatttcctcattggctttggccatttagcattgcaggcccagcccatgttgatttttttattcctttacaattaaaatgttttggttgtttttgttgttgttgtttctgcttgaaggcttctggaattttgtctctatcactgcaatttaaatattccctggaatatggctaaatacagatctcatgttattaatcttgcctagagtgaagtgagcctttcattctctacactgaagtgttttgcttcgtggcttttccaacggttctgtttatttgtttgtttgttttccaggaatattgttaggaatattcccaagctgaggagctggtacacactgataaatctggaac

SEQ ID NO: 166769 - DNA, 601 bp, Human
aaattcccaatgtttaaaggattggccgggcgcagtggctcatacctgtaatcccagcactttgggagactgaggcaggtggatcactttgaggtcaggagttcgagagcagcctggccaaaatgtctctactaaaaatacaaaaatgagctgggcatggtggtgcatgcctgtaatcccagcaacttgggaggctgaagcagcagaatcacttgaacccaggagacagaggttgcagtgagccaagaccgcaccactgtactccagcctggaaggcagagcgggactgtctcaaaaatarataaataaaataaaagattgcagggtttaaattgaatctcttcctacccttactgcatatttctctgacattctgaacaaataagtgattaaaaaatgacaatccaccagggttcttatgtttccactcacacacttgaaagttgtgatttatagctcccgaagtgaagcgggccgcccccagtatctacctcctttccataagctgtgtattttggaaatgtatatgtctacgtattattttatgtttaccctttcaaagaaggggtcttgctgaaaaattcccttgttttcaggaacc

SEQ ID NO: 166770 - DNA, 601 bp, Human
tgattctggcagaaaactgtttttaagagggacagacacaagagtagaataaccacatgtgctctcaaaagtcagacttgtttacagaaaaatctatctccacaactttttttttccacagtgttccatgaacatgctccagggccacctctcaatactcacatgtgcaatatgcatttttgcatctttccaatcctgtccagcctgcttcagctgctgttcagtgagaaccatgtgttcccaaaactgtaagtttagcctggccacaggggtaattgattttctttgatttgtttgtatraagcactatccagtcccattttacaagaaggagaattggagtagacagtttaaggagtggactacatactgtaaatgttcttgagtgataaggtgtgtgtcacacccagcaccagcaaattacacatacacacacacatacagcaaaattagcatcattcagaagttcttcccacacattccaagaaacattgttgagatggtgttattattccatgcttacttatttagaatgcatttagtgttaagcaatctataacgctcttgtttgtttctttgcttgtttgtttgtttgtgacag

SEQ ID NO: 166771 - DNA, 601 bp, Human
tggagtagacagtttaaggagtggactacatactgtaaatgttcttgagtgataaggtgtgtgtcacacccagcaccagcaaattacacatacacacacacatacagcaaaattagcatcattcagaagttcttcccacacattccaagaaacattgttgagatggtgttattattccatgcttacttatttagaatgcatttagtgttaagcaatctataacgctcttgtttgtttctttgcttgtttgtttgtttgtgacagagtccttctctgtcacccagactggagtgcagtggcrtaatctccgtgcactgcaccctccaccccactgaggtcaaccaatcctcctacctcagcctccctggtagctgggactacaggcatgtatcaacatgcctggctaatttgtgtattttttgcagagacggggtttcaccatgttgtccaggctggtctcaactcctggactcaagcgctccacctgcctcagccttccaaagtgctgggattacaggcatgagccaccaggcctcgcctataaagctctttaataaacttttttttttttttgagacagggtcgtgctctgttgctcaga

SEQ ID NO: 166772 - DNA, 601 bp, Human
tggctaatttgtgtattttttgcagagacggggtttcaccatgttgtccaggctggtctcaactcctggactcaagcgctccacctgcctcagccttccaaagtgctgggattacaggcatgagccaccaggcctcgcctataaagctctttaataaacttttttttttttttgagacagggtcgtgctctgttgctcagactggagtacagtggcacgatcatggctcactgcaaccttgacctcctgggctctagtgatccccacctcagcctctcaagcacctgggactataggtgcrcaccaccacacctggctaattgttttctttttcttttcctttttttctttttttttggtagagatagggtcttgctatattgcccaggcttgtcttgaactcctggcttcaaggaatccttccaccttaacctcccaaggtgctgggactacaggcataagccatgcacctagccaacaattattttttatcacaacacagcgaggttcctgctataattatcctgactttacagatgagaaaacaaatgtacagaaagcttaaaaaacttgactaaggccaaacaactagcaagtggta

SEQ ID NO: 166773 - DNA, 601 bp, Human
atcacaacacagcgaggttcctgctataattatcctgactttacagatgagaaaacaaatgtacagaaagcttaaaaaacttgactaaggccaaacaactagcaagtggtagattcagtatgtgggcctagacagtccttctccagagactgactctcactatccctttattcagcactctctgtattgcatgagaaaaaatacatgttgcatctgtagctgaacttcatacaacgcacaccaactacatttgggagacagattcatttatttacaaattcccagtggccaccaaaacatytgatagttaaaaagcccatcttaaatgtttgtggaaatgaatggaattggatggttttagtagcttcaatttgactcatctaagaaaatagtataacccacatgtagctgtcctcctgagggtggcctctgttttcactatctgccagccatgaaacagggctgcttcatccctgcacagatatcttcagtagaacttgtcagcaaccaacctcacttctccagcatgaatattagctctctctctgcatgcgggaggcagaataatgaccttctcaaagatgcccacattctaagccct

SEQ ID NO: 166774 - DNA, 601 bp, Human
aaatgaaagttgttaataagctggctttgagacagggagattatcctgaattatctgaatggccccaatgtaatcacgagtatccttacaagaggaaggcagaagagaaagtcaaggtgatatcatacaagaaatatttcatccactgttgcgccgttaatgatggagaaatgggatcataagccaaggaatgaggaagcctccagaagctggaaaaggcaaaaaaagaatccctgccccctacaagagcctctagaaggagcacagccctgctgacaccctgcttttagacctctgattyctagaactgtaagagaatgaatttgtgttgttttaagccactaagtcggtggccatctgttacagcagccacagaaaactgcccactgcaggatgaaaagccactttctcctggtatttctcaaaggctaatctaagagcatggattgttctgtatcttccaggagcactattgcaaagtcgattcattacttttttcatttgttccgcatcaccgtgctggggctcattaacgccctgtcatcgggtgctctgtgcgtaagtagaagtgtgttaagaatcaatcgctctgacctttatt

SEQ ID NO: 166775 - DNA, 601 bp, Human
agctggaaaaggcaaaaaaagaatccctgccccctacaagagcctctagaaggagcacagccctgctgacaccctgcttttagacctctgatttctagaactgtaagagaatgaatttgtgttgttttaagccactaagtcggtggccatctgttacagcagccacagaaaactgcccactgcaggatgaaaagccactttctcctggtatttctcaaaggctaatctaagagcatggattgttctgtatcttccaggagcactattgcaaagtcgattcattacttttttcatttgttcygcatcaccgtgctggggctcattaacgccctgtcatcgggtgctctgtgcgtaagtagaagtgtgttaagaatcaatcgctctgacctttattccctgttggtgttttgtcattcgtgggctgcttggcttgacatatgaattactctccagctgcctggtgctggggaggcacagtcaccagcccccaaatatttcagacatatgccaattgcaatttcaacacacattttttttctaccgtcaccctggaactgttccattggcaatgcatgaaatatgaacaagaggaaataattga

SEQ ID NO: 166776 - DNA, 601 bp, Human
ggagcagctggggctggggtaccatcattagcctgtggccatggaaacagagtcaaggtaactgacccacaggaccaagacacatgaccttgatgctattagctctttccattgaagcttgctggccatatacagcataattgaatgaaactgcagaacttcttcagtcagatccacctgtgccttccagaagcacattaatgaggcccccctccggcacagaatgggaactaggcaatccagacacatccccacccagcatcctccttctggttcactagcagaactggatcatgaatcracaaaatgaaggaggctttgcaagaacaaagcttttggaacctgtattcctgggtggtgctggagccattcattcctagccaggtgccatgagcactttctctgtgggccctgttggctcccctttacctctcacccccaaacgcctttccagggaggtgtagtgctgagtgcactggtcagatgtggggacactgactgttcacagctggagtgaagagggacagagacttctcctcgtccccccaccatccttctgttcctcctcccatttgtcctcccaggagctctccttattaga

SEQ ID NO: 166777 - DNA, 601 bp, Human
atgaaactgcagaacttcttcagtcagatccacctgtgccttccagaagcacattaatgaggcccccctccggcacagaatgggaactaggcaatccagacacatccccacccagcatcctccttctggttcactagcagaactggatcatgaatcgacaaaatgaaggaggctttgcaagaacaaagcttttggaacctgtattcctgggtggtgctggagccattcattcctagccaggtgccatgagcactttctctgtgggccctgttggctcccctttacctctcacccccaaacrcctttccagggaggtgtagtgctgagtgcactggtcagatgtggggacactgactgttcacagctggagtgaagagggacagagacttctcctcgtccccccaccatccttctgttcctcctcccatttgtcctcccaggagctctccttattagactgaggccctttagcctgcctgcaatggaaaacagagccattcacctggcccaggcaggctctttggggtgctacaatgtgcatggccaaagctattcatgtattaaagaggcttagctagctttgcttctttactgcacttac

SEQ ID NO: 166778 - DNA, 601 bp, Human
cctccttcacaatattacacagaaggcagctgtgtgcctacaaagaagtcaagctatattcccctttctgtgagatgaaggatacacaacccaatccatctcaattcttaccagcttcccaaagcgtgaaacgaaacttcccagccctgcctctaacaccttgtgagaggaagaacttactctgtcactatctggtgcccagctctgtgagcacaccccagaaatgcctcagatcctctaccctccccaggaagataacagtgacaaggatgaccaggccagggcccagaggtaacttctrtcttcagccctaatcctgtgtcccatatggatgcgtcctcaagcccatccatgggtgttagagctaaagtgttttaacctaccaagaaaaaaaaaatcctcagactataataaaggcaaggtatcttaccatgcaaattaagaggtttttcataaataaaagattcatgctctttgggtacttttgctacatttttaatacttcctccagcacactggctcactacgctggctggtcatttgaattacctggaaagttttaaacaccgctgaggccagggcccattcctagcaactctca

SEQ ID NO: 166779 - DNA, 601 bp, Human
gggtgttagagctaaagtgttttaacctaccaagaaaaaaaaaatcctcagactataataaaggcaaggtatcttaccatgcaaattaagaggtttttcataaataaaagattcatgctctttgggtacttttgctacatttttaatacttcctccagcacactggctcactacgctggctggtcatttgaattacctggaaagttttaaacaccgctgaggccagggcccattcctagcaactctcagttccctgctctggtggttggcctgagcacagggcttttgccaccttcccagstgattgcactgtgcagtcaaggctggggacctctgcttcgcgaggacaccttgttttcttgtagtgatgttaactccagtctctgcctcctccatctccacatgcctttcactctgtgtgtctgtatgtcttcacatggcattctccttgtttctaggccctcttagtataatgacaccagctgtattggattgagaacccatcctaatctagtatgacctcatcttaactaattacacctgtagtgaccctatttccaaataaggtcacattctgaggtactggaggttagcgccttaa

SEQ ID NO: 166780 - DNA, 601 bp, Human
attttacacaatcaaggacatcatagattaataaaccagtatttttagcaacatgttagttttgtgttttatgctccttttcttgctctcacttcaagcaaagacgtccctcaccatctttggagcaggtttcccctttgctcccctttctcctggcccctcccaccccagcacagtcaatgctaattaacagctgtttaattatcagcccagcagggaagtgatcatggcccaggtcctcagagagttatatgcacagttaagttgtcccagatactggaagattgactgtgttatgtgmccatagggagaggcaatgcggcttagtcgaaagttcatagcattgagaatccatcaacctgatgactctgccatgttttaactgttggacaatggcttccaaacctttttttcctcaaccgtaacaataccaaccccacagttttgttgggaagattaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggca

SEQ ID NO: 166781 - DNA, 601 bp, Human
attaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggcatggtggcgaatggctgtagtcccagctactcgggaggctgaggcaagagaatcgcttgaacctgggagtcggaggttgcagtaagccaagatggtgccactgcactacagcctgggtgacagagcaagacttcatctaaaaaaaaaaaaaaaaaattaatgtagtaaaagtaccttgttaagtatacaatcatatgcaaatgcacagggatgttttctgcttcatcttagcatggtcataactggcacatcatagagagactagaggtgggtaagggatgggtagagttgcttgagcaacatttgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagcca

SEQ ID NO: 166782 - DNA, 601 bp, Human
ggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaraaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggta

SEQ ID NO: 166783 - DNA, 601 bp, Human
tccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaawgcaaatcaaaaaccacagtgagataccatctcacaacagtcagaattgctgattaaaagtcaaaaaataggctggatgcggtggctcatgcctgtaatcccagcactttgggaggccaagacgggcggatcacgagtcaggagattgagaccatcctggccaacactgtgaaaccctgtctccaaaaaaaaatacaaaaaaaaattagctgggcgtggtggcacacgcctatagtcccagctactcgggtggctgaggcaggagaatcgcttgaacccgggaggtggaggttgcagtgag

SEQ ID NO: 166784 - DNA, 601 bp, Human
ccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaagacgggcggatcacgagtcaggagattgagaccatcctggccaacactgtgaaaccctgtctccaaaaaaaaatrcaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacagaaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaa

SEQ ID NO: 166785 - DNA, 601 bp, Human
ggctggatgcggtggctcatgcctgtaatcccagcactttgggaggccaagacgggcggatcacgagtcaggagattgagaccatcctggccaacactgtgaaaccctgtctccaaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacagaaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtg

SEQ ID NO: 166786 - DNA, 601 bp, Human
ataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacrgtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtt

SEQ ID NO: 166787 - DNA, 601 bp, Human
catggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttayatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacactt

SEQ ID NO: 166788 - DNA, 601 bp, Human
tcttcctgaatccacatcagtcctctctccttaatagaaatgttccattgttttatttcacttaatgacccctaccacattatcttctttaagaatactttactcagccaggtgcggtggctcatgcctgtaatcccagcactttgggaagccaaggctggtggatcacctgaggttgggagttcaagaccagactgaccaacatggagaagccctgtctctactaaaaatacaaaattagctgggtgtggtggcacatgcctgtaatcccagctactcaggagcctgaagaaggagaatygcttgaacctgggaggccaaggttgcagtgagccaagatcatgccattgccctccggcctgggcaacaagagcgaaactctgtctcaaaaaaaaaaaaaaaagaatacttttctctatctaattcttactttagggaaactcactttgagtcatcaccaaagcctgtctgttcagtgcaaccataagtaaatgctctcataaaataatggtaacgggtcaggcacagtggctcacgcctgtaatcccagctcttttggaggctgaggcaggcagatcacttgagctcgggagttcgagac

SEQ ID NO: 166789 - DNA, 601 bp, Human
ctcagccaggtgcggtggctcatgcctgtaatcccagcactttgggaagccaaggctggtggatcacctgaggttgggagttcaagaccagactgaccaacatggagaagccctgtctctactaaaaatacaaaattagctgggtgtggtggcacatgcctgtaatcccagctactcaggagcctgaagaaggagaatcgcttgaacctgggaggccaaggttgcagtgagccaagatcatgccattgccctccggcctgggcaacaagagcgaaactctgtctcaaaaaaaaaaaaaaaagaatacttttctctatctaattcttactttagggaaactcactttgagtcatcaccaaagcctgtctgttcagtgcaaccataagtaaatgctctcataaaataatggtaacgggtcaggcacagtggctcacgcctgtaatcccagctcttttggaggctgaggcaggcagatcacttgagctcgggagttcgagaccagcctgggaaacatagcgagaccccccccaatctctacaaaaaaatacaaaataataataataatggtaaggtgagcatgtatatgagatgaacttgcttt

SEQ ID NO: 166790 - DNA, 601 bp, Human
gaggctatgaccaacaactagtggaattctcttcagttctgaaaaagtgcaccagtgtatgactgaagattagcaaaactatataaaagtcaaatcagaggtctgggaagagtaatgcaggggtttcaacagacagagtaacaggggacataatgaagtcacaggcctaaaagaaaggatccaatgactttgcaaggggctagcaagaaagcttggagactaaagtagcaaaaagagcttctattaatgcttcctaaaacaatggcaggaaatcaattccatggggcttaactgatgcaggcctggaggcactaaaacccattttgcctggtgaagtgagcattttgtgggtcaccaacagttcatcatgatccatttggattggccaagctatgtttaaaaagggatcagtgactccaaaccaacctgaactgcagggcatattgacagaaagggagtgactaattcgtaaatgtgaatgaagctttattttatttaagattaaaaagtgatgaacaagagagagaactaaattacagacttgtggacggctacattacaggaattcatcacaatttcccttctggggcttcagagcttg

SEQ ID NO: 166791 - DNA, 601 bp, Human
caatgttttagcaatatcataacagccactgatcactgtgggcttttgccagtacaagctctgacttcattattttttttacaatccatcctggagaaaacctacacagtacaaagacacatgaagattgggagtggacatattactgtggaattgctctttgttttcctttctttcttttctgaaatatttttgggggccaggatgaggagccttaggatttatttttctgcattagaacatgcactaaaggtgagccagttttctttaattcagttcaacaaatacttttgaacaagayttagtgtggtggcactgaaattacaaagattaactaggacatgtcatctcctgcaaaagatattgttatttagtaagaagttatattcaaataagaataatccaaaacaatatgctgtaaattcaaaacatgaggtagaaacaaagagctatgaaagtgagcatttaattctaaatcagggagggtttcctgcaatagcagctctcttatggaaaaagtttaaagatagtgatctagttataagatattaggggattgaaactatgtttgcatatttacagaaaacagaaaacacaaagt

SEQ ID NO: 166792 - DNA, 601 bp, Human
tacaaagattaactaggacatgtcatctcctgcaaaagatattgttatttagtaagaagttatattcaaataagaataatccaaaacaatatgctgtaaattcaaaacatgaggtagaaacaaagagctatgaaagtgagcatttaattctaaatcagggagggtttcctgcaatagcagctctcttatggaaaaagtttaaagatagtgatctagttataagatattaggggattgaaactatgtttgcatatttacagaaaacagaaaacacaaagtgtttataccaaaaaaaaaaaaatggagaggaaacactataggtaggttgggagggacacccaaaagtactgtttcatggaagatgtggcctttgagctggtcctgaaatattagatggctatagagtatgtcaagtaaatatgtacatgggtgctttacaacaccaaactaataccattctctgctttgaaattcctgtaccagatcaatactgggcaagctgatggcactcctggccttgatttgaatgtggctgaagcctgggagctgggatacacagggaaaggtgttaccattggaattatggatgatggtgagtatt

SEQ ID NO: 166793 - DNA, 601 bp, Human
aaaatctgggaagagcctggctgggcgctgctcactcagtgttgctcatgcagttatgatgttagctgggctgcagtcttctgaaggccccgctgggctgcacatccatgatggtgcactcctatcgctggtggttgttgctggttgccactggagctcagctgggaccgtcaaaaagagtgcccacatattgtgctttactatagtttggtcttgatgtcttactcaccagagtggctataaactctatcctgccccaacaggactccaggggattggctgtagatgtttacaatgtgcyttagtccgttcctgatgctgtaacaaaataccttagactaggtcatttataaataacagagatgtatttctcacacttctggaggctgggaaatcacaaattcagtatctgataaaggcttgctctctgcttccaagatggccccttgttgctccatcctgtggaggggacaaacactgcgtcctcccctggcagaaggggtaacaaagggatgaactctctccctcaagcccttttataaaagtacgaaccccattcatgaaggcacagccctcaaaacctaatcacctcctaaaggcc

SEQ ID NO: 166794 - DNA, 601 bp, Human
actgaccattttgctggggggatgtttcttggtttgcttttggggatttgtttgttgtttccttttagagacagggtcttgctgtgtctcccaggttagtgtgcagtgatgtccttatttttgtagagacagggtctcactatgttgcccaggctggtcttgaactcttggcctcaagcaatcctcctgcctcagcctcccaaagcaccgggattacaggcgtgagccaccatgcctgaccaaaattgacggtctttgaattaggatccagaacaagggttaacaacatttaaaaatattygtctttaaatattctgatgcctttccctctgaagacttcgggaggcaagtgggagaagaaggcataatgatttagggaggggactatagtctcccaaactatagaaagcagccatagtgacagcaattgcttcactcatcaaaatcaacagtgaaacctaacacacgtaccgtagattagtgactctcagtccagttactcattgtataaccggaaaaaaaaagaaaaatttcttttcagaaatatgcatcctaatacaagctcttttggggaaggcaaatctctaatggtggcctagcc

SEQ ID NO: 166795 - DNA, 601 bp, Human
tgatgtccttatttttgtagagacagggtctcactatgttgcccaggctggtcttgaactcttggcctcaagcaatcctcctgcctcagcctcccaaagcaccgggattacaggcgtgagccaccatgcctgaccaaaattgacggtctttgaattaggatccagaacaagggttaacaacatttaaaaatatttgtctttaaatattctgatgcctttccctctgaagacttcgggaggcaagtgggagaagaaggcataatgatttagggaggggactatagtctcccaaactatagaragcagccatagtgacagcaattgcttcactcatcaaaatcaacagtgaaacctaacacacgtaccgtagattagtgactctcagtccagttactcattgtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctggg

SEQ ID NO: 166796 - DNA, 601 bp, Human
caccgggattacaggcgtgagccaccatgcctgaccaaaattgacggtctttgaattaggatccagaacaagggttaacaacatttaaaaatatttgtctttaaatattctgatgcctttccctctgaagacttcgggaggcaagtgggagaagaaggcataatgatttagggaggggactatagtctcccaaactatagaaagcagccatagtgacagcaattgcttcactcatcaaaatcaacagtgaaacctaacacacgtaccgtagattagtgactctcagtccagttactcattrtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctgggccaagcataccacatgcattcatttctttagtccttacattgttctcacccccagttgatcaaaaaggaaaattagcacagagtccaagcaacttgcct

SEQ ID NO: 166797 - DNA, 601 bp, Human
agtgactctcagtccagttactcattgtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctgggccaagcataccacatgcattcatttctttagtccttacattgttctcacccccagttgatcaaaaaggaaaaytagcacagagtccaagcaacttgcctgaagtcttgcaggcagttatcagggtggttgggactcaaatgcctgtctttgactccacagacctacgtttgtaaccattatgctagatggtgtcaagaacctgccctgtttcttggagggttagatgctcaggtgtaactgctgcaaagcttatgtggttttgcaaacccaaatgagagcttttcaattgcccttggagtttcttgatgctttctgaggtccaagggtctgatggaactcagcagtgctcatagtccctgattttacccttgg

SEQ ID NO: 166798 - DNA, 601 bp, Human
tttcttgcccagccatgttctcttattatttccatgccagagtacattctcctaatccattgctgtccatgccctgttaaataataatcacttttcctccccagggccggtttcatttcagagaaatgccagttgatgctttaaaaatgtcaagatttctacaaatctcttttagatcagtgctctgatgagccatccatctcactgtcacaaagctgtcttgggcagctgtctctccgctctggcagtgcagcccaccttcacacctccacacagaagggaggtgcaagactgggagctstgtgatggggcactcacccccatggcaagccttctggcaccagccccataaagagggcactttcttgggcagctttcctgaggacacagtggcaggtattaacctttggttcctgtgttattgttgtcttttcacagggattgactatctccacccggacctggcctccaactatgtaagtacaagccaactttggtggggaaacagatgcatcttaaatgtcctggtgtccctggctattaggaacatgcacatgtctacatgtctatacacatgcatgcaagtacaggagcatgcaca

SEQ ID NO: 166799 - DNA, 601 bp, Human
caattcacacgctgctttcctgatgaagcccacaagccctttaaacagaatcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctaygttgcacaaagaaagtgggaatattccatgtgtttcatgcactgggcaagaagaaacaaggcattcaagggatcttataaatctagaagagcataaattgagaggagcatcttttttaatattaggaaaaactattaaatgaatcattggcagagtccagccaatgtggccccagagagaaatgacagaaattaaaccaaagctatattcccagcaatgataataatccatgtctatggagaagaccattgtaaactgcctgtgccagcggtcctgtgtgtggagtctgaggaaacagcc

SEQ ID NO: 166800 - DNA, 601 bp, Human
ttcctgatgaagcccacaagccctttaaacagaatcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctatgttgcacaaagaaagkgggaatattccatgtgtttcatgcactgggcaagaagaaacaaggcattcaagggatcttataaatctagaagagcataaattgagaggagcatcttttttaatattaggaaaaactattaaatgaatcattggcagagtccagccaatgtggccccagagagaaatgacagaaattaaaccaaagctatattcccagcaatgataataatccatgtctatggagaagaccattgtaaactgcctgtgccagcggtcctgtgtgtggagtctgaggaaacagcccttctccctgtctcct

SEQ ID NO: 166801 - DNA, 601 bp, Human
tcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctatgttgcacaaagaaagtgggaatattccatgtgtttcatgcactgggcaasaagaaacaaggcattcaagggatcttataaatctagaagagcataaattgagaggagcatcttttttaatattaggaaaaactattaaatgaatcattggcagagtccagccaatgtggccccagagagaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagct

SEQ ID NO: 166802 - DNA, 601 bp, Human
agtcattgaagagactcatatttagagaacaagggcttgcataaaagaaaggatggttacccagcaaaaagtgtttggaggtcaccagtctgggtcatttgtcctggaaggcgagtgtctctatgttgcacaaagaaagtgggaatattccatgtgtttcatgcactgggcaagaagaaacaaggcattcaagggatcttataaatctagaagagcataaattgagaggagcatcttttttaatattaggaaaaactattaaatgaatcattggcagagtccagccaatgtggccccagaragaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagctgtctgctggtcttctcatgcacttccttaaagggactgccctggacacagtccttgctgcctccccctgactatggctgactccgctagtgccttcacctttccctgcctcctccataactgcaggg

SEQ ID NO: 166803 - DNA, 601 bp, Human
ttttaatattaggaaaaactattaaatgaatcattggcagagtccagccaatgtggccccagagagaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagctgtctgctggtcttctcatgcacttccttaaagggactgccctggacacagtccttgctgcctcyccctgactatggctgactccgctagtgccttcacctttccctgcctcctccataactgcagggccctggagatgtgtcaggcaggggattgagaagtgctgcattgcattttctccaaggctctgatgtatctggggctgttcctcacagagagcaagtgtggcagggatcatggcctccagggtcggtggtcctccctccgagggctgtccccactccaccctctgcagacagaagcattgatattctccacagttccctccatctccaggacccagtgcctcacagggcagccacgtg

SEQ ID NO: 166804 - DNA, 601 bp, Human
ctcctctgagatctgcaataccagaatacacctgaagaactcttatcggttctgtgagtctcaagttcttttttcttcttttctttcttaagaacatttttctgattaaaaaataaatgcatgttatctgtcaaaaaatatgaaaaagcataaaacagattcaaaactagccataataccaccattcttattattttgacatatttggggcctttaatttctatgtgtctatttttaatgaaattgagctcttattgcatattcttcccttctgcttgatgtgccataaacatttttatgytattaaatattctccaaaacataattttaagggctacatggcattagctcatgctataatttatttaaacattctgatctccaattgttgaacaattaggttgtttccaatcagtgtttcactgtaagagggagatgagatggcagacagtaacatgggtggactccaagccataccatgctaaggagaactgaaagaactggaaaagcttttcctggaaaaaagaaaacaggcacattgagtatgttttcaaatatttcaaattctcctggtacaatgaggcattccacttgttcagta

SEQ ID NO: 166805 - DNA, 601 bp, Human
ttgtttccaatcagtgtttcactgtaagagggagatgagatggcagacagtaacatgggtggactccaagccataccatgctaaggagaactgaaagaactggaaaagcttttcctggaaaaaagaaaacaggcacattgagtatgttttcaaatatttcaaattctcctggtacaatgaggcattccacttgttcagtaatttctcccaagaaaattctcaccaatgggtggtaaccacagaagcaaaattttaactcagtcaaaggaagaactgtctagtgattaagatagtaaattaytgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataa

SEQ ID NO: 166806 - DNA, 601 bp, Human
accaatgggtggtaaccacagaagcaaaattttaactcagtcaaaggaagaactgtctagtgattaagatagtaaattattgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggygacagagggagactctgtcttgaaaaataataaataaataaataaataaataaataaataaataaataaataaaaataaaagattagtaaattaatgaaagtaacaaattcttcatacctgaaaatattcaagaggaagtttgatggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtat

SEQ ID NO: 166807 - DNA, 601 bp, Human
gatagtaaattattgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataaaagattagtaaattaatgaaagtaacaaattcttcatacctgaaaatattcaagaggaagtttgatggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtatcaaacacttggaagctgacaatgaaattatatatatttacatatggctgtgaaaatgttctgcctct

SEQ ID NO: 166808 - DNA, 601 bp, Human
accccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataaaagattagtaaattaatgaaagtaacaaattcttcatacctgaaaatattcaagaggaagtttgayggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtatcaaacacttggaagctgacaatgaaattatatatatttacatatggctgtgaaaatgttctgcctctggtatagatgagaaaactgaacacctaactacctcgtgcttgattcctcagcagagggcccaaactggctggttttta

SEQ ID NO: 166809 - DNA, 601 bp, Human
atttggaagaggattctaggaagcaggggtagaggacagggaatgagtccgggaaggaaaggtagcttgtaaacggggcagttatcaaacaagacagcactgtgggcactgaggcttaatctcactgggcagctctgggagacagcatagaatatgtgagccagagtgatcccccttgggatgtgatgcctcaagaagctggggtatttatgtgacaacttcgtcagtcattggttgagggcttgtcccaaaagatgttcctacctccccacagcctggggaaaagccctgggcagaggtrtgggtacagacagctgcagcttaccagggacatgagggtttcaggctgaagggggatgtagcaacgtctgccccagagatgccttggaaattcattaaaggttaaaataaatagacatgttctatgttgaaaaaactccttgtggttactgatttattttcagtgaggattgaaaactctacccaaggctcctcaaaaaaattactttataatcaaaccaaccaaaatgtttctgaaagcagaattattttcaaagcttggttattctgtatattaagagaggaaacagcatatgctggt

SEQ ID NO: 166810 - DNA, 601 bp, Human
tgtggttactgatttattttcagtgaggattgaaaactctacccaaggctcctcaaaaaaattactttataatcaaaccaaccaaaatgtttctgaaagcagaattattttcaaagcttggttattctgtatattaagagaggaaacagcatatgctggtagtccagtttattcccattaaactaagaataaaatacttggaaaattgcaaatcaatatataaatgtaagttgttagtgttaatctaattcaaaaaatccacactgagcctgctgagtgttgggagtaaaggataataacrgccacttggattattactctattgttctatgattgaatttcatcggagggatccagtcccactggtaaaagttcactattccaaataattaaaatttttctttttctatcccaatagtcatgacacgaaatgagtattagccaagaggctattttagaccaggttaaaattataacctcctttacccatcttcgctataataactgggtattttctctaagtcaatacaatggctgtggattgaacctgctatgtgcaagccccagaggaagagagataaataagacacaggcactctct

SEQ ID NO: 166811 - DNA, 601 bp, Human
gaaatctcctggtatttaagccattgcagggtgggacatcaactcctgttctgatggctgggaggatgggccacttcttgcactccgtcttctagcttggaaactgtgagtgatgctctgagcagctccaagatcctgtgctgagaatctgtctagattcatgacacttcatgagcttttccaagaattcttgagtgcagcaaatacagaagtttgcattgactcaactccacatccttccctagaccacagcttctgccatgggactctgtagaatctccctttaaagaggtgaagtgtrtttcctaccccttgactttggattgggccttgtgacatgttttaagcaatagaataatctagaactgacagtgccagtttggagcctaggccttaagaggccttgtgtgctcccaactgcctacccacgcctctgccatcgccattagaagggcattcccaggctctcctgctgtaccctagaggagggtgagagacatggagaagagcttccctgctgccacggcctgaagcaccaccacccacactggcctacagagctgcagtaagaagcagagctgcctagctgagccccaccaaa

SEQ ID NO: 166812 - DNA, 601 bp, Human
gaagcactccaagattctgatggttaacctactcattcattttggcacttcattcatgcattcaatcattcattcattcaacagtgcagtttacctataatgtttgactacatcacagttagatcataagctctttgtaaggaagtgtgtactttgtaagtgttttgtgtccctcttaacacttatcacagtgttaagcaagcacttaatacatatttgttaaattgcattaaatgttaactcaccaatattattgcaagtaataccaggaactaaattatatgatgaccctctatcgacratgatcagaaactgcagcatgcacaaccctctgtgtaattcctagttctcaaccacctcataggtggatgccaccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatccctcaagttgctggaaatgcaattaggttcctagataggagaggacaaattatgttctttggttccgt

SEQ ID NO: 166813 - DNA, 601 bp, Human
atgttaactcaccaatattattgcaagtaataccaggaactaaattatatgatgaccctctatcgacgatgatcagaaactgcagcatgcacaaccctctgtgtaattcctagttctcaaccacctcataggtggatgccaccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatcyctcaagttgctggaaatgcaattaggttcctagataggagaggacaaattatgttctttggttccgttcaaaatttggaacattatttatgttccagggttgctatttcaccaacagaagtgatcataagagaaaaaggcccacccctacattcctgcacttttccattctttagatgggtcctgacaggtgactgtctctgaagtgggtgcctgctgagagctcagaagagctgccagcacaggaagtaccttgagcttgacagaagtgtgcacattgggccccagggggcatgtggcc

SEQ ID NO: 166814 - DNA, 601 bp, Human
agaaaccggcacagtactcagccccgaatgactcagatgttatgaagtattgatcacatacattgcttctggcttttaggcctatgaatatttaaataagcacattaatattgcatatgaaactgaggcttaaataacctttgtttcttattgaaaggaagggctggcattttcaatgtgctcttgaatgctggctggatcatgatgagcactttagcaccagatcagactgaatactgagaatggggactttttaaaaatcactttgatagaccgtcagtcaaatgactatcacttaatrcaactcatgtactagaggaaactatttatttttacagaaacatactttgctttaaaaatagggcagaaatgaaaccttgcttaacaaaatgaaactacttgtatggacctaaacttacagctatagctgaaagcaaagaaaatatctggtcattctattatttttaattattcaattgactagtatttgtttcattgaacttagtcagcattcaagaaagccgtattgttcccactgtgcaaaatgctatactaggggcctgaattatgaagtgtgaaaaatccagtccctgaccttggg

SEQ ID NO: 166815 - DNA, 601 bp, Human
ccatttatcactaaacacacctgttcagaaaaagtgtagcaatgtttactgataagccacaagaaagtcatttatgcaaatataagaaaattgaaagattactattctcaactgcctttgttcctttctttgtcttcattatcggtatatacgcactgaattcccaaaatgtgaaatattttactggcttttttatttgggtttctatctcatagaaccaaaaacctttaggtgaccaagccttacaaataattaacttggcaataacccctggctacagctgtggttcaaaatgctgctyctgctgagctgacatccattttcactttgtccctctcctcatgtgcctgtttcccaatcatactgtcttaaagccacagttctgggtgtctaaggcaggcctgaccagatttctgaacccatgtcccccacccaggaggggagtagtgggttgatgccacagcaaaatgggcagtcatccacactgcttgcccatgtcttgttgccaagcaacagagcccaagtgggtgtgtccactagagccacacctacatgggatcattgcctgggcaaatgtggatctgatggagaccaaacgtct

SEQ ID NO: 166816 - DNA, 601 bp, Human
tatgggtattggaccaccctccctttttttctccacaacaccccacaagcatacacacacatattctttctctatcatgtaaagaatgttccagaacactaggtggaaaggagccagtccctgtgtagaggcctgtgtggtgacagatgggcactgagtcatttgatacagtcagcaccttgcaggaattcttaccaggcactttaccaacaaaaaatatattatctgtgaataaaaccatggccaaggctattaaccacttcgattaatcactcacaagcggtcacaatgatcctatactacatggcagctttattggggagttttgacttgttgcttgcttgattattaataactcgcaaatccatctctcctcccgtggagagttggtagttggctaacgaagtatgagaaccatgtgttgtctcccacctcttctccctgccgtggttctgatatttctccattgatttctgtggaatagcaggagtgttagttcccagaatttgttgagtatttactgtgtgtttggccttgtgttttatatgcatgatcacatttaatgagcgtgttaagccagtgaagtgggtactttcttacc

SEQ ID NO: 166817 - DNA, 601 bp, Human
aagcatacacacacatattctttctctatcatgtaaagaatgttccagaacactaggtggaaaggagccagtccctgtgtagaggcctgtgtggtgacagatgggcactgagtcatttgatacagtcagcaccttgcaggaattcttaccaggcactttaccaacaaaaaatatattatctgtgaataaaaccatggccaaggctattaaccacttcgattaatcactcacaagcggtcacaatgatcctatactacatggcagctttattggggagttttgacttgttgcttgcttgattattaataactcgcaaatccatctctcctcccgtggagagttggtagttggctaacgaagtatgagaaccatgtgttgtctcccacctcttctccctgccgtggttctgatatttctccattgatttctgtggaatagcaggagtgttagttcccagaatttgttgagtatttactgtgtgtttggccttgtgttttatatgcatgatcacatttaatgagcgtgttaagccagtgaagtgggtactttcttacccacctgtcatagacgggaaactgaagatcagagaggctagtgattt

SEQ ID NO: 166818 - DNA, 601 bp, Human
ttaaaaccaacaggtggctctcccccttccctgtgagacttagcctgtttgcctttgtcctgcttactcacgatgaaccagactctacaatccaggattctccctaattaaaggcttggaagactgtcacactagctcttcccacagttgagtccatctcaacttatattgcacaccctgtgtagccacttcctagttcttaagatagtctgtggttctgtatttttgttttgttgcatgtgttcccccattagaatgtcagccccaggaggatgaggccacggggatctgacctgtcttkttcacctctttatccgcagcacagcaccatggctggaaccaagtgagtggtcagtaggtatctgtgagatgactgactggctgaggattgaacacttggctttcctctttttcttttgccttcaccttttaatttcttctggccatgctttctcctcacatagctcctatctctgtctttttgctatgcttctccttatttatacctcagtcaacaccagcattttgttatgaaagaaaagctgcaggtcagtgccacaaagaagacaatttccccaggaaatgaacacttcagtacttc

SEQ ID NO: 166819 - DNA, 601 bp, Human
aaaagaaaaagaaagaggaaaaaaaccaacatgagcatgttcttaactaatgagctatgcttatccactgttccactagaagagaattttccaaatatggacactctattcacaagtctctcttgagaaacgtggtgttacagtgtcaccattattaatattaaacttgatgcaccatatttacaaatccttccaaagggaaacaaacctgccctggaaacaatgcttataattataatcgtggattctatctgttcctcacagggaatgcttaaaatatcaatttaaatgcaaatgaatyttatcattccaaattagactcatcccattgtgttgaaattaatatagaaaataacaccgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaag

SEQ ID NO: 166820 - DNA, 601 bp, Human
cgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaagcacttaaatctgtatttaagtgactacatactatttaaaaataaactatttgaggccrggcctggtggctcacacctgtaatcccagcactttgggaggccgaggtgggtggatcacctgaggtcaggagtttgagaccagcctgaccaacacagcgaagctccatatctaccaaaaaaaaaaaaaaaaaaaatacaaaattagccgggcatggtgtcacatacctgtaatcccagctacttgggaggctgaggcaggagaattgcttgaacccaggaggtggaggttgcagtgagccaagatagtgccattgcactccagcctccccaacaagagtgaaactctgtctcaatcaatc

SEQ ID NO: 166821 - DNA, 601 bp, Human
gggagttattgtttaatgggtatagagttttagttttgcaagatgaaaaagttatgaagattgtttgcataggtacttaacattactgaactgtacacttaaaaatggctaagatgatgaattttatgttacatattttttaccactattacaatgaatacatcgttttttaaatcaaggtaaaacaaggcttaaaagatttcctcccaacactccaatggatcatccagcacatcctcccaagtgagcacaatccacttttgagacctttgcactaaatacctagtctgtagccctgccytcagtgtaatcagcaaaagattctgtattaaaacataaaatcctctgtccagctagatgttaagatctctgtctttaagggagataaaacagaataataggaatggcaccaataaggatcatgcagacaggtagatctgggtccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaa

SEQ ID NO: 166822 - DNA, 601 bp, Human
aataggaatggcaccaataaggatcatgcagacaggtagatctgggtccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaaactgtagtatattagttacctattgctgcatctcagattacccccaaaacatggcagcataaaacaaaatacatatatatattttgtttcacaccrtttttatgagtcagaaatttaagagcagtttggctgggtggctccgtgtttctcgtgaggttgcagtcagcatgttggccatgactgcagtcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctca

SEQ ID NO: 166823 - DNA, 601 bp, Human
tccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaaactgtagtatattagttacctattgctgcatctcagattacccccaaaacatggcagcataaaacaaaatacatatatatattttgtttcacaccgtttttatgagtcagaaatttaagagcagtttggctgggtggctccrtgtttctcgtgaggttgcagtcagcatgttggccatgactgcagtcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctcagaagtcacacaccacaattttgaaatgtcctattggttatatgggt

SEQ ID NO: 166824 - DNA, 601 bp, Human
tcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctcagaagtcacacaccacaattttgaaatgtcctattggttatatgggtcagccttgttcattgtaggggactgtatacaaggtcatgaatatyaggaagcaagaatccctaggatcccaactgggaggcggggacaagtggctgaatagagcagacatagtttctaccctcaaggaccttagcaactagagggtaaaatagactccaaagaaataactacagaaataattatgatctaggtgctttgctacagcggaagagtactcggtgatataaatgtgtttaatatggagaaccagatctgggctgccagttaagggaagatttccctagagtagctatccctatgctgataccttaagaatgaggaggagttagccaggaatctggaag

SEQ ID NO: 166825 - DNA, 601 bp, Human
cattggagaagtagaaagagaaccgactgtataaactttctgagccatgaggattcataacttcatcctaggagcaaagggaagcttcagggtggcagggagggggaataacatgcctagatttggcatttttcaaagatttgcctgctaaagagacagattgggagtgaacaagaaaggaggcagggagagcagatgggggcttttctaggagaaagattatttgccaaagagctgttatggttaaaaggaagatagagagagagaaagaatgtagttaaagcaccctgaacttcagagrtgctccctaaatagtctttctctcttcctcttaaaacagaaaccttcagggacacctaacataagatgatatctgcaaaacatatatctctaaaaaaagcagacaaaaacacaatcacttagcgcgggcctcattaggcacctcataagttcaggcactagggtcctgaaggagtcttgtgcacaggaaattcaggaggggagtcagcagtgagcttaaagcctcgctccaccaccagcaggaacccggactgacccacagagagcgctgaatagcatttatgatgcttaatcagaaagc

SEQ ID NO: 166826 - DNA, 601 bp, Human
aagtagaaagagaaccgactgtataaactttctgagccatgaggattcataacttcatcctaggagcaaagggaagcttcagggtggcagggagggggaataacatgcctagatttggcatttttcaaagatttgcctgctaaagagacagattgggagtgaacaagaaaggaggcagggagagcagatgggggcttttctaggagaaagattatttgccaaagagctgttatggttaaaaggaagatagagagagagaaagaatgtagttaaagcaccctgaacttcagaggtgctccckaaatagtctttctctcttcctcttaaaacagaaaccttcagggacacctaacataagatgatatctgcaaaacatatatctctaaaaaaagcagacaaaaacacaatcacttagcgcgggcctcattaggcacctcataagttcaggcactagggtcctgaaggagtcttgtgcacaggaaattcaggaggggagtcagcagtgagcttaaagcctcgctccaccaccagcaggaacccggactgacccacagagagcgctgaatagcatttatgatgcttaatcagaaagcatgcagcg

SEQ ID NO: 166827 - DNA, 601 bp, Human
ggagtcttgtgcacaggaaattcaggaggggagtcagcagtgagcttaaagcctcgctccaccaccagcaggaacccggactgacccacagagagcgctgaatagcatttatgatgcttaatcagaaagcatgcagcgttgatctggaaattaattggatgctcggatttttcgcacatcatggagagttagatgttacaaagattttgacgggaatatatttagtaacagtatcactgatgttcagtctcaagcaggggcctgtatctactctggggctcattatattctgagtgacaaygggtgcttagtaaatctcctttgattatgatgatcaaccaagtcactcagagtgtctttaatagataatgagaaattgtaccagagttggggttttctaaatatgaaatcaaactgcaattctcatgacccactgtgcttttatttatttaatcatttttacttaactgattcactattttaataggtagttttaaaagttaactctacattaccgccataaatggaaaatctcacttgccatataaataagacaatcataaaaatagataccgtctacccctaaaatctgccatgtaca

SEQ ID NO: 166828 - DNA, 601 bp, Human
gataatgagaaattgtaccagagttggggttttctaaatatgaaatcaaactgcaattctcatgacccactgtgcttttatttatttaatcatttttacttaactgattcactattttaataggtagttttaaaagttaactctacattaccgccataaatggaaaatctcacttgccatataaataagacaatcataaaaatagataccgtctacccctaaaatctgccatgtacagctcaggttgggcacagcacaccctgagaactgctggacctggatgtgcttgtagtcaagggtyttggaaggaacagccgtggtcatcagttcacacagccaggatacaggggatatgcccttatgtgacatagggcatatatgatatagagtatatgtccacacattccaatatcaatatagggagagaatggtggagagagaaagggagatctctcaaattaacaacaatgaatatcgactgaacctgaagaaacagatgctctttggttcatggaaagggtgtgaacagatgctcaggcctgaacactgctcagactttgcagcttcagggaccatcggctaagagacttgtcttctggac

SEQ ID NO: 166829 - DNA, 601 bp, Human
atatacttaaagataggtatttgtgagggtgaaacctacctacaacctcttacactgctagtgcaaatgtcaaatggtgcaatccctttggaaaaagtttggcagtttcttgtaatgttaaacacacacttagcatacaaccagcaatcccactcctaagtatgtactcaagagaaacaaaaaggtatgtttataaaatggcatatacatagcagctttatatttgcaaaacttggaaataattccaatgcccgtcaacaagtgaatggataaataaaactgtgatgtgtttatacagtgraatactatcccacaacaaaacaaacaaactgctgctgcatacagtacaataggcaaatctccaaatgttgttagctaccaacaaagacaaatgcaagagtacatatactctctggttccatttacatgaagctctaaagccggcagaattcagatacagcgatagagatcagaacagtggttgcctaaggtaggtgaagattaactgagaagggcatcatatggtgagacaactcctcaaggtgatgacagtgtccactatcttgattggcatgatggtgactcagatttacatactgct

SEQ ID NO: 166830 - DNA, 601 bp, Human
caaaacaaacaaactgctgctgcatacagtacaataggcaaatctccaaatgttgttagctaccaacaaagacaaatgcaagagtacatatactctctggttccatttacatgaagctctaaagccggcagaattcagatacagcgatagagatcagaacagtggttgcctaaggtaggtgaagattaactgagaagggcatcatatggtgagacaactcctcaaggtgatgacagtgtccactatcttgattggcatgatggtgactcagatttacatactgctaagatgcagcatgcaygcttaagatcacatatgctactgtaaattatacctcaattaaaaaacatgatttaaagcacaacctataagcaaaagagccagtttagaaatcagttaccaccaaaaatgccctgtgaatgtgggaagaatgagtggagaagcctgcccatgtcttgcctcagaattttcactgcccacctgctcacctccctaggttgtctcaggcataaacgaagatgatagatgtcagggcacttggaaactctccaatcgctgtacactctaaaaggggtctagtttaatcatttgtactaatttc

SEQ ID NO: 166831 - DNA, 601 bp, Human
taggttgtctcaggcataaacgaagatgatagatgtcagggcacttggaaactctccaatcgctgtacactctaaaaggggtctagtttaatcatttgtactaatttcttagaaatgcatcactcttttttccttatttgcctttttaatatagaatcaaggcttgctcatcatcaaaaagattcaaacattacagaagtgtagataaaataaaaactgcaatttcccttctctctcctctccttttcctcctctatacaacccactcactttccaattttggtgacgtggcagttctgcrtggatctttccagattttttttctcccccaactgcaatcatacagtacaccgtatcatgcaacctgctcttttatttaacaacatattctctccaacagtgtggatattccgtcatttgtttaaccaagcccctaatgattgacattttgggtttcccctaaagttttgctgttataaactacgagacgaatgtgtttccttgatcttcttcaaatccttgtgtgaatatccctttagaataagttcttagaagtgaaatttctgagtcaagtagtacatgcaatattaattttaataaa

SEQ ID NO: 166832 - DNA, 601 bp, Human
gcaacctgctcttttatttaacaacatattctctccaacagtgtggatattccgtcatttgtttaaccaagcccctaatgattgacattttgggtttcccctaaagttttgctgttataaactacgagacgaatgtgtttccttgatcttcttcaaatccttgtgtgaatatccctttagaataagttcttagaagtgaaatttctgagtcaagtagtacatgcaatattaattttaataaaccttatcaaattattctctgaaaagattgaatcaatgcatagtcctcccaggagaatcycttctcattttgatctcaaagacaggaaaaataaagttgagagaatgctgaaatattcaaagattctccgatgcccttgaaaagcagaagtggagctgacatcaacatggccttattttcgctgctgacttgaaacttccataatgaggaaataaaacacatgatttaaaaaaaataaaaaaactcatcaatgagattaatgagagttgagagcctatgacttgaacatttgctggttaatagatgtagggatggaaacagtgttgtgccaattactgtaattaaccagaaatgaagaca

SEQ ID NO: 166833 - DNA, 601 bp, Human
tccttcaggaaataggacactttccaactaacacagttaggctatatcccccaaggtattatgtttttccttgaatggagtcaaacactttctaaactcgagagaatatggccctgaaggaaactacgcctgttcctgtgatgaaatgacctgacaggaaagcactcagcatcttgctgacaagtcaggaagaactcacaacctgcccagtggtcattttagtcaattttggggggaaacagttcttttgaataggtcccctaaaaaaggcttgaaagaagaattagtacattccaaagcwgtgattagaaatcatcataattttctaccaggagaagagcactttattattacttaaaattactctagtccaatagccaattgctatattttatgttaacttttatttacaggaagtacaatgtattccttttggtgcactgttccatgagttttgacaaaagttcatacagtcaagaggcagaacatccccatcacccaaaaaactttcctcctgctgccccttttcccactcgcagtcctggcaaccacagatctgctttttattcctacagttttgtctcttctagaatgttataca

SEQ ID NO: 166834 - DNA, 601 bp, Human
tgattttttggaaaatatatgcagttcccaaatttgaacaataaatgtgcatttataatgtaagattatgctcccagaaagctaaaaaaaagttagaattatcataattacataatccctattatacttcaactcttagacataatttttaatcatttatcttcaaaaagatgaatatttttaaattttttttcttttttttcaatcactattaagcacagttgagttaaatccagtaagcattctgttgggactaaagattttctgttcaaagcacacctaatgatttctctcttgtttsaattgtattaaatttatgagacctctattttatctctagtgtcagtttatttcatttccattttccacttgttttcctaaaataacaacaaaatgcaattaaaatgtgtaaataatgctgcttacaacacctccatagctaagtgtggtataaataaaagtggtatggcactagcacattaaaaaaggaggcttgaaatatcaacatttaatgtaaaaaaagtacaagtacagtaatggaaagctgaatgtttaaagatttggaaactcttggaagcatgcttgtgttgctctaccgaat

SEQ ID NO: 166835 - DNA, 601 bp, Human
ttttcttttttttcaatcactattaagcacagttgagttaaatccagtaagcattctgttgggactaaagattttctgttcaaagcacacctaatgatttctctcttgtttcaattgtattaaatttatgagacctctattttatctctagtgtcagtttatttcatttccattttccacttgttttcctaaaataacaacaaaatgcaattaaaatgtgtaaataatgctgcttacaacacctccatagctaagtgtggtataaataaaagtggtatggcactagcacattaaaaaaggrggcttgaaatatcaacatttaatgtaaaaaaagtacaagtacagtaatggaaagctgaatgtttaaagatttggaaactcttggaagcatgcttgtgttgctctaccgaattccaaaggcaaacagttttattttaataatttcgttagctgggcatggtgacatgtgtctgtagtcccaacaacttgggaggtggagacaggaggatcgcttgagcccaggaatttgaatccagcctgggcaacatagcaagaccctggatctgttttctgtacctatagttttctctatgataataac

SEQ ID NO: 166836 - DNA, 601 bp, Human
aagctgaatgtttaaagatttggaaactcttggaagcatgcttgtgttgctctaccgaattccaaaggcaaacagttttattttaataatttcgttagctgggcatggtgacatgtgtctgtagtcccaacaacttgggaggtggagacaggaggatcgcttgagcccaggaatttgaatccagcctgggcaacatagcaagaccctggatctgttttctgtacctatagttttctctatgataataacaaaataataataattttgttaatgttcagagcatgagtgagctccacctgamaactcttataatgtcaaatgatactgacgtcaacaaaacaacttagacaattcttgaaatttgcttatttatctgatacatttgttgagagtctattatgtgcaagtggtatcaagtaaaaaacccagtgcatatccttgaaccacttggagagaactggaggggatggaaaagcgagggatatctgttcacagcagagtgtcatgtgggaagaggacatgtccttgaaccacttggagcgaaccgtaggggatggaaaagtgagggacatctattcactgcagagtgtcatgtgaggag

SEQ ID NO: 166837 - DNA, 601 bp, Human
agcgaaccgtaggggatggaaaagtgagggacatctattcactgcagagtgtcatgtgaggagaggacaaggaacagggaggcacgggggttggatgagctctcttcctggttcttgaaaatgccacgaatgttggtggtagcaggaatggcaaagagcaccatgagtcagggacgtgtcatctccaaaaggtctagggcagagtatttccttcccaagaaaccagtgtcccataattcacctgctggaacccctgtgcacaaagggattgtgtgattaatgtagattttggtgtttcatmttgtagcaacttaataaggtatgtgcccagcttctaaatgaaggctataatcacttttccatagtttatgaattatgaagttggattcccatcccaaatgctgtccaagttttttggcttcaaaaccaattaaaatgatgaatagctgtgaaaagaaccagaagtgcatttaatctttcttcagaacagttggggatcagttcttttttgtcacatttcacattagctgggaacataaacttggtcttgttcaaaggttcaaactacttcttcctgaaagagaaccgatctacttaactt

SEQ ID NO: 166838 - DNA, 601 bp, Human
aggcaagtccataactgcagctgtggtaagcccatctgcaggctgccctcttcctgtcctgagtcccggagggcatccctgtgtgatcactggccttaacctctcattaagctatcaaagctaccttccactgcttttcttaaacccacgtcttttctatttccttcaacttcaaattagccattgtttccacatcatcctctcatgacatgatagggaatgaagtgatgatggctcacagcactgctggggctgcttttacaagaagctcactcaaagtcaacttattttttttttttttgaaacagggtctcactgtgttgcccaagctaggatgatacagttgcacaatcatagcttgctgcagcctcaactcccaggttcaagagatcctcccgcctcagcctcctgagtagctgggactacaggtgcgtaccaccatgcctggttaatattttttatactttttgtagacatggagtcttgccatgttgcccaggctgagtcaaggtcagttttgtcaccatgcggggcatagagagacctcagcagtgaaggcctctaggaaatgggagaaatccaaccaggctggaacaaggct

SEQ ID NO: 166839 - DNA, 601 bp, Human
tgatggctcacagcactgctggggctgcttttacaagaagctcactcaaagtcaacttattttttttttttttgaaacagggtctcactgtgttgcccaagctaggatgatacagttgcacaatcatagcttgctgcagcctcaactcccaggttcaagagatcctcccgcctcagcctcctgagtagctgggactacaggtgcgtaccaccatgcctggttaatattttttatactttttgtagacatggagtcttgccatgttgcccaggctgagtcaaggtcagttttgtcaccatgsggggcatagagagacctcagcagtgaaggcctctaggaaatgggagaaatccaaccaggctggaacaaggctgggagaatcggccagttctagggcagttgcctaagtagaatgggtcatgaattcgaatctgcttcaagcgatactcaggtcaaatttggacaatgaggccaagcaaagacttgagcacagaatcaaagcacacctagagttacctatgtgcatctccgtttttgctaaatccaaattacaccttactatactgttaacttttatttgtctatatcatttgttggaatc

SEQ ID NO: 166840 - DNA, 601 bp, Human
gacctcagcagtgaaggcctctaggaaatgggagaaatccaaccaggctggaacaaggctgggagaatcggccagttctagggcagttgcctaagtagaatgggtcatgaattcgaatctgcttcaagcgatactcaggtcaaatttggacaatgaggccaagcaaagacttgagcacagaatcaaagcacacctagagttacctatgtgcatctccgtttttgctaaatccaaattacaccttactatactgttaacttttatttgtctatatcatttgttggaatccagaaaacatacwttgtttctttccaggaaaaagtcaggtataaaaataagtgtgtgttgaaatataagcacattttaaaaagaaattagctcctattctcattcctgcagcttggcattgagtttgtctgtaattgggtgtgttttaaaattaaaaatttgaaataaacgttaagcagcaggagtcaaaaataattcagaccgtaatattcatcaaaacttgtttaatagcaggaaaccctccactctgaacttttactcttctttcttgcagaatcaatccctccagcagccctcaactaccagaagcaca

SEQ ID NO: 166841 - DNA, 601 bp, Human
aggtataaaaataagtgtgtgttgaaatataagcacattttaaaaagaaattagctcctattctcattcctgcagcttggcattgagtttgtctgtaattgggtgtgttttaaaattaaaaatttgaaataaacgttaagcagcaggagtcaaaaataattcagaccgtaatattcatcaaaacttgtttaatagcaggaaaccctccactctgaacttttactcttctttcttgcagaatcaatccctccagcagccctcaactaccagaagcacaaaaattcaatatatttttttttttgagatggagtctcactctgtcgcccaggctggagtgcagtggcatgatctcggctcactgcaacctccacctcctaggttcaagcaattctctgcttcagcctcccaagtagctgagattacaggtgcccgccaccatgcccagctgatttttgtatttttagtagagatggggtttcaccatcttggccaggctggtcttgaactcctgacctcatgatccacctgcctcggcctcccaaagtgctgggattacaagtgtgagccgccgcccccggccaaattcaataatattatgctt

SEQ ID NO: 166842 - DNA, 601 bp, Human
catcaaaacttgtttaatagcaggaaaccctccactctgaacttttactcttctttcttgcagaatcaatccctccagcagccctcaactaccagaagcacaaaaattcaatatatttttttttttgagatggagtctcactctgtcgcccaggctggagtgcagtggcatgatctcggctcactgcaacctccacctcctaggttcaagcaattctctgcttcagcctcccaagtagctgagattacaggtgcccgccaccatgcccagctgatttttgtatttttagtagagatggggyttcaccatcttggccaggctggtcttgaactcctgacctcatgatccacctgcctcggcctcccaaagtgctgggattacaagtgtgagccgccgcccccggccaaattcaataatattatgcttagtagtcacacactttctcttgttttcttttgttttctttggctcattagacctctccttcagaaccaaagaaatccattgtgacaactctgttctcagagctgactttttccatagagagaacttcagtctgagacatgccaaggagttcttgacgctcccaaaattaacacct

SEQ ID NO: 166843 - DNA, 601 bp, Human
gacatcagtagaattgacagtcaaaataaatgcaacgtaagcaactgaagcagggtgtttctgcctgccaatgcttgcctctgtcagataagaagaaggattaacaagtatagggaggtgttaaagccatgggggcacttagcagagactttgtcactggcataataaggattgcaggagcgttttgcaaggagccacagtcctgccgtgcgatgccatgttatttaacatgaaaagcaggcaccacgtgtaagcatctcatggcattttcagtcaatgattgtcaagctgtactcagaarcccaggggccaccaggtagtgttgaagaggctctagaaaaaagaggaagtatttcagattctgaggaattcagtcgtcagtgttatttgtcttatagagagtatgatttttttttaaatcctatttctataaggaacaacataatcaacagagaacaaagaaacaggttgaaccctgccgttgaaatcaggagaattaaccttctcattggaggcatatttgctggtttaggcctcaaaggcattacatcaaccttggatgagacaatttactaaataaaaccatgttattaaaaaaatg

SEQ ID NO: 166844 - DNA, 601 bp, Human
agccatgggggcacttagcagagactttgtcactggcataataaggattgcaggagcgttttgcaaggagccacagtcctgccgtgcgatgccatgttatttaacatgaaaagcaggcaccacgtgtaagcatctcatggcattttcagtcaatgattgtcaagctgtactcagaaacccaggggccaccaggtagtgttgaagaggctctagaaaaaagaggaagtatttcagattctgaggaattcagtcgtcagtgttatttgtcttatagagagtatgatttttttttaaatcctayttctataaggaacaacataatcaacagagaacaaagaaacaggttgaaccctgccgttgaaatcaggagaattaaccttctcattggaggcatatttgctggtttaggcctcaaaggcattacatcaaccttggatgagacaatttactaaataaaaccatgttattaaaaaaatgaatggaccatacaaaataatatatttcatgtgctcccctagctctttagtgaagtatggccctctgtgggaggttaaattattagctaaatgtatatacttggatttaaacagaatgatccact

SEQ ID NO: 166845 - DNA, 601 bp, Human
accctgccgttgaaatcaggagaattaaccttctcattggaggcatatttgctggtttaggcctcaaaggcattacatcaaccttggatgagacaatttactaaataaaaccatgttattaaaaaaatgaatggaccatacaaaataatatatttcatgtgctcccctagctctttagtgaagtatggccctctgtgggaggttaaattattagctaaatgtatatacttggatttaaacagaatgatccactgatgttctaggaagtaaatgcactaacttattcttttttatttgccargtatttgcttttcttttaaataatgcatgcagtagaatatgattaatataattctgatgcagaaaagcaagattgcacacttaggagagaggtctctggagccagactgcctggtctaaatccctgctctgcccttcatcatctgtgtgaccttgggcaaagtattcaacctctctgtgcctacactgccctgcttataggatgaggatgacaataagggtattacccacataaggacatcataaggatgagtaatgcatacaaaatatctaagagtcccctatacaaaatacgcactcc

SEQ ID NO: 166846 - DNA, 601 bp, Human
tttgccaggtatttgcttttcttttaaataatgcatgcagtagaatatgattaatataattctgatgcagaaaagcaagattgcacacttaggagagaggtctctggagccagactgcctggtctaaatccctgctctgcccttcatcatctgtgtgaccttgggcaaagtattcaacctctctgtgcctacactgccctgcttataggatgaggatgacaataagggtattacccacataaggacatcataaggatgagtaatgcatacaaaatatctaagagtcccctatacaaaataygcactccatatgtgctacctgatatcattacagtaaaaaaaaattacacaaaatgtaatttttactaattttaattacaaaatgtaattaaaactaagtcttccttccaccctagaccccacgcctctccccaggcaaagtactgtaaaaagacccttgtgcttcttctcagaactactctatacttaccatcaagtccatccctctcttctgtgcaaatgggagcccactatccactctattctacatattgccttttttgcttaacaacatttcttgggaatgagttcattgctagtt

SEQ ID NO: 166847 - DNA, 601 bp, Human
ttatttggttaaatgccttcagggaaagtagcaagacagaataaaaggacaaatgcaatgcggtttcttgttctgagttcctgtagctgtggaattacattggcagttaatcattaccacgttgtactcgtgatcataaactcctgttatttaagatgttattcaagtctcacaagaaacatcttgtcttctgtggcacaatttccttgaggtcgggtttgtgcacaactataaccatagagacctgtttcttgtgcttcgtggacatgctagtaggtatatagtgccatttgtgtgaaaytgaaaatgacattccctactggtgggtgaactgggaaacagcaccctgtctatgggcaaattagaaaagatgtccccttctgggtggacaaatgagcaaaaggcagcccctctgggctgaccaattcttttttaaagcctcctccaccttggggtgtgggggtggtgcacatggcttggtaagtccaatgcagaccctagttgctccctgtgggcaggaacccctggcgcaatgcacaacctgcacaactgtacacaacagccctgattacagaatccattttcacaattttgtagttgg

SEQ ID NO: 166848 - DNA, 601 bp, Human
tagcattcaaggccagtttaacttattcctgtacacaaataactttatgggagacagcattgtaattcaaatcaataaatgactcggtttggctgtacaagcataaacagaacgcttgcaaaatatggttcctccttgctagaaaccatttgatttttagccagaaaacatacagccaaacaagaataacaactgtttgccttccttaatgttcagtgtagactgttacccaaggaattaagcattagtcatcaaaacttcattgcaaaggcaacaaaataattggggttcctgagttatcatccatttcaacattcagaggccaatttgaccccagacaatacaaggtctttcttcttgttataaaagtggttgcagagttctgagggttctctgctgtaagctctgctctcagaactctccaggtcctgcttccaacccctgccatgtccggccaaactattttcccagagtcaggagcagagccaacagcctcactcagacagaccccagtgataattatcagcccaaaagataagcccaagtggaaagtttgagaagccagtcactcaggcagcagctacaaagggacaaacactct

SEQ ID NO: 166849 - DNA, 601 bp, Human
tattaacttgtgtttctctcgatattcctaccccactaactatacctaagaatgctgttatctctgaaaaattcagaggttaggagaacagaacacccttggggaagacaagttactatttcaaaatagtatctctgaaaaaaacagaaatccaaatatcgcatgggaagtcagtgggagaaaggccaaatctgagagggtctcccaggaacacggattgcgggccagatacagaattaaacttttaaagtgaatgaaagcaatctggggtctaagtggggaaggagtcgaaaaactggcracttgccagtagttatggtcagtggagacgagaagacttcctcctctctgaaagccaagtgttgaatgaagacctagatcctggaataaaggatcaacatgcttaagactccaggcaaattactgggccaaatttcagggtgactcctgcccaagtacagcatttatttaaataaattagcattacaactctgattattacaactactggtgattttgtcacctaaacaataaaacaaaaattaatggaattagtggagttgctcttaaaaacattatgccaccacattaggcttacaaa

SEQ ID NO: 166850 - DNA, 601 bp, Human
tgacagagaatagtacacttttgaccatatgctgtagggcataagagttcatacagatacttattgaagtttgtaatggtacatttctttgtttgatctttcgattgatgtctgttcccgcaactaggctataagttacataagggcagggatgccaccattgtattcccgtacttagcaaagtctctgacatatattggactcttaatgatatttgttgagtgaataaataaggtcaattgtggacaacgtcagggccttgggcatggggtttaaaacccataaggggaaaggaaaccakcctatgctagtctgaaggaagaagctggttgtgagctttctgtgtaaagcaaggaaactctagaggccatctcacttgtgatgtgagaactagaacatctggccatctgtccaaggaaggattaaggaagcttaccctacaccttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaa

SEQ ID NO: 166851 - DNA, 601 bp, Human
tagaacatctggccatctgtccaaggaaggattaaggaagcttaccctacaccttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaaaccccaaagacatgctttggctccaacacaattttgtgaggtttggtccagtgcagcacactaatccagcactccagggaggactagaaaygtttaaagtctcccagcgctttccctttactgcgcctctggctgtacggacctaatgagatgccttgtgtttttcagaatgccgaagcaagttacgacttcagcagcaacgacccctatccttaccctcggtacacagatgactggtttaacaggtaaactgggccttgggaggtctctttgactttaggctttggggttttattctactttgttttgtttcaggcttgactaccaccagcaaaataatccccatgcttcattaaattatattgtgatttttcttcttagtggttacatt

SEQ ID NO: 166852 - DNA, 601 bp, Human
aaacttttggcatgaagtgtgttttatctctgtgacttctaaccctagatggtagcatatatttagcaaataaaccatttcagacacaagaatgtgaagttaccaaatgtgtgccattaagctggggtttagacagaattggcagtggccatccagggcacagtgctgagaagggccatgagagggtctggcttcagcaggattgattaccagctctccgcatgaatatcagaaagtgcagtggcaacatatccactggctacttgctgtctttctgtaactagtaggtactaaattagtmtttgatggattgatgtaagcacaaaaatataaccaatggaaagattatcccccaatctcattttctgaacccaaacaaaatctaccctagtcaaatcttcctgggcaatgtgctataaaaatactccttaaaaaaactaaaaggttccactccaagatggccaaataggaacagctctggtctgcagctcccagcatgatcgacgcagaagatgggcaatttctgcatttccaactgaggtatctggttcatctcattgggactagttggacagtgggtgcaaggggtcggaggatttcc

SEQ ID NO: 166853 - DNA, 601 bp, Human
gaggatgtggagaaataggaacgcttttgcactgttggtgggagtgtaaattggttcaaccattgtggaagacagtatggtgattcctcaaggatctagaactagaaatatcatttgacccagcaatccaactactggatatatacccaaaggattataaatcatgctactataaaaacacatgcacacatatgtttattgtggcactattgacaatagcaaagacttggaaccaacccaaatgtccatcaatgatagactggattaagaaaatgtggcacatatacatcacagaatactrtgcagccataaaaaaggatgagttcatgtccttttcagggacatggatgaagctggaaatcatcattctcagcacaccatcacaaggacagaaaaccaaacactgcatgttctcactcataggtgggaattgaacaatgagaacacttggacacagggcggggaacatcacacaccagggcctgtcagggggtgtggcagactgggggagggatagcattaggagaaatacctcatgtaaatgacaagttggtgggtgcagcaaatcaacatggcacatgtatacctatgtaacaaacct

SEQ ID NO: 166854 - DNA, 601 bp, Human
ggagaaatacctcatgtaaatgacaagttggtgggtgcagcaaatcaacatggcacatgtatacctatgtaacaaacctgcacgttgtgcacgtgtaccctagaacttaaagtataaaaaaaagaaaatttaagaaaaactaaaaacactaaggaaatgtcttctctcttaaatatttcatttgcaaacttgttctcaaaattataattttaaaccagctaaaaacctccaattaggactaattagtgcttagggcaataaaactcatcattgtcagcggtaagaattcccaagtgtccarttacccaagacacagtcatagtgactcaggcaagcatgatccccatgccttagggagccaatgattaagacagagtgtccactttgaccagtaaatgggttcttttcaattatcaagtcattttcaaagatcctcacgcactatggcttgttattacaaagactggatgatgccaccactcaaatcgcagctactttcaaacataactaccattgtaaatgattatgggaggctggtgaggtgaagctcaagtccacagaaccaagaaaatccttagttcaaaacatcaccattaccctg

SEQ ID NO: 166855 - DNA, 601 bp, Human
tcatctattctatcaagtaggctcttgaaaccccaaagtcttaccctgtagagctcattggacattagccagcaaacgtggtcgacgccaaactagccaggaagtctctgcatttcagttctaatatgtctaacactggagcttctttctccaaagccaagggtgaaaagactgcagctggccaccatgggtcttctgttgtctaagaatctgtagatgcagagagactggagaccagaagacaaagacagcctcatgtgcatgaacttagccaagttgcacactggcttgctgactaatytgtcttatctccttatctctgtgaatgcagatccctgaaacactgttgtagaaactggttgtcagaaacagaactaaggagtcaattgaaacaatcataggaccagtagccaggaaaggaagagaggtaaaaaaaaaaaaaaaaaaaaaaaaaaaaaaagacgaaaaaatatctccacatcaaaattatcctaaaatccactattccaaaatgcctgaaaaaaatacacctaaaaaaactaaaaatcaggatattaatttgtactatatgaaatcggttctatgaagcagtcttgaaaaa

SEQ ID NO: 166856 - DNA, 601 bp, Human
tggttgtcagaaacagaactaaggagtcaattgaaacaatcataggaccagtagccaggaaaggaagagaggtaaaaaaaaaaaaaaaaaaaaaaaaaaaaaaagacgaaaaaatatctccacatcaaaattatcctaaaatccactattccaaaatgcctgaaaaaaatacacctaaaaaaactaaaaatcaggatattaatttgtactatatgaaatcggttctatgaagcagtcttgaaaaagactttatcataagttatttttagtttgttcagagtgataaatgcatgggtgacayacattttaaagaaaactaaatgatggtggaaacataggcaaaaacaaaagcatggacatgaaaagaaccaattgcagctgaaaaatacagcctgtggaataaaatctcaataaatggtataaaatctagcctggatgcacttgaggagttaattatcgaattgaagataacagcctgtttatcaaaaacctacagcaaacattattcttcatggtgaagctttgatagcattctctaagtctgacaagatgtgggttctccctatcatccctttaattcaacactatgctacatttcata

SEQ ID NO: 166857 - DNA, 601 bp, Human
attttaaagaaaactaaatgatggtggaaacataggcaaaaacaaaagcatggacatgaaaagaaccaattgcagctgaaaaatacagcctgtggaataaaatctcaataaatggtataaaatctagcctggatgcacttgaggagttaattatcgaattgaagataacagcctgtttatcaaaaacctacagcaaacattattcttcatggtgaagctttgatagcattctctaagtctgacaagatgtgggttctccctatcatccctttaattcaacactatgctacatttcatagcygatcaaatagttataaatctaagaaaaggtgtgagatcattaagaagaaaattataaaatttacaaaagaataaaggagtcctaaataaatagagtggcatactaagctcagggataagaagatggaacaatataaagatatcatatcaaattaatatattaattcattgcaatttcaattaaagtttcaatagattattcagtggaactagacaaaattgttttaaaattgatatggaaaaacaagtggccaaaatagaagaagacaagtaaggaggaggaaaaaaggagaaaaaagag

SEQ ID NO: 166858 - DNA, 601 bp, Human
attacacaaccataataatatgagattgtagggttagcatacagagagacaaaaagatcaagaaacagaatagagagtgcaaaaacagacaccacataaaaggaaccctaatatatgattaagatagcaataaaaacaataaggaaatgatggagtgaaggtattcaataaatgtgataactatgcacatggggagaaataggcacccacaccacatactgagcataaataaattccaggagaatgaaagacctaaatggatataaatcttttaggaaaaaataaagaaaaacatctttaygatcatgacatagggactgatttcttcccttttctccccaattgatttagaagtttattttgccaaggttaagggtcatgacccatgacacagcctcaggaggtcctgagaacaggtgcccaaggtggttgagtcagagcttgattttatatgttttagggagacataagacattaatcaatacatgtgaagtagacattggcttggtctggaaaggcaggacatcttgaagcaggggcttccaggttataggtagattcaaagattttctgattggcaattggttgagttattacctaa

SEQ ID NO: 166859 - DNA, 601 bp, Human
aaaggtgtgtctgggttaagataagggtttgtggagaccagggttctttttatgtagatgaatctcctaagtggccactcttagaggcaatagatgacagatgattcctgttcagacctttaaaaggtgctagactctcagctaatctctccaggattggaaaaagatctggaaagggcagaggattctctacagaatgtaaattagggatggatttcttaagccactaaaccacatggaaaaataaatgattaataaagctggctacattaaaattaaacacttttgtacaaaaaaaaaagtcacaataaataaatttggaagacaagccacagactagaagacgtgcagcaaattttatggaaaaaaaggcttaatatagaaaatttgtaaagaacagctacaaatcaatgaaaaataaataaatacccttgtagaagaaatgggccaaggttattaacaggaaattcacagaaaagaaaatctaagccaaatagcctatgaaaagattaccttgctagtgatgaggaaatgcaaaatgaaacaataacataccatttcacaccaactggactagcaaaaatggtaacattcaacaatg

SEQ ID NO: 166860 - DNA, 601 bp, Human
ttttcaaattatttgtaatagcaagcaaattgcaaacaaattaaatacctatcattagaagtataaataaataaatcacagcatatttataaatggactactacacagcactaaaaatggatgaactagaattcacaagttaacttcagaaaatgtagcaaatgaagccaattttacatagatcatacactaggaaattttatacagtttgaaacatgcaaagagtgacatgtatgcttatgcatacctgattataagttcataaaaatgttctgaacagcaaatttagtacacttgttamctctgaggaagcaaagaggggaaggaatggcatcagagagggcctcaaattgtatctgtaaagatttatgttgtttcttggcgcggagggggttgttttttgttttttgagacagagtctcactctgtcgcccaggctggagtgcagtggctccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtca

SEQ ID NO: 166861 - DNA, 601 bp, Human
atttataaatggactactacacagcactaaaaatggatgaactagaattcacaagttaacttcagaaaatgtagcaaatgaagccaattttacatagatcatacactaggaaattttatacagtttgaaacatgcaaagagtgacatgtatgcttatgcatacctgattataagttcataaaaatgttctgaacagcaaatttagtacacttgttacctctgaggaagcaaagaggggaaggaatggcatcagagagggcctcaaattgtatctgtaaagatttatgttgtttcttggcgyggagggggttgttttttgttttttgagacagagtctcactctgtcgcccaggctggagtgcagtggctccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtcaggctggtctcaaactcctgacctcgtgatctacccacctcagcctcccaaagtgctgggattacaggcgtgagccacagcgccc

SEQ ID NO: 166862 - DNA, 601 bp, Human
tccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtcaggctggtctcaaactcctgacctcgtgatctacccacctcagcctcccaaagtgctgggattacaggcgtgagccacagcgcccagccttttatttttatttgagacagtctcattctgtcacccaggctggagtgcagtggcgtaatcttrgcacactgtaacctccgactcctaggttcaagcaattctcatgtctcagcctcccgagtagctagaactacagagacaggccaccatacctggctaatttttttgtgtttttagtagagacggggtttccaggctggtcttgaactcctgatctcaagcaatacgcccaccttggcctcccaaagtgctgggattacaggagtgagccaccacacccagcctataaagaattatgtttttctaaaaataatccaaagtaagaaaaatgtttggctttgatagacttggatggtggctata

SEQ ID NO: 166863 - DNA, 601 bp, Human
cacaccagcctcaaagtgcgcattaaataaacgaatgccaaaagtccatcatgcaccctgcacacacctagtgagagggtaggggaattcgaccactagacaaggcagccattttttttctgttcatcaaagactgctttgtactgatccttgtcacccaacatctctttttgtgggatccttcaaattagtttatgtcacttattattagaatttatccttccaaaacagtttatcgagtaggatctaataaaattataggaataatcaataggaataagattaaaatgtgctagttcakgttatcctagtagctgtaacaaataaatcttggccctgaaatattagtggcttagcggcttagcaccaaaagaagtgtatcactcacccaccagtccatctctgtgttcctggtggagcagctctcctctaagcagtgattaggggatgcagactcctttcatctttggcataggtttccaatgttcctgggcttttttgcatcaaactacttgaggggaaagagagtgaataattgcccaagggtaatttttatgggccaggttaacaaatagcatttacccatctgctcacatatttg

SEQ ID NO: 166864 - DNA, 601 bp, Human
aaatcttggccctgaaatattagtggcttagcggcttagcaccaaaagaagtgtatcactcacccaccagtccatctctgtgttcctggtggagcagctctcctctaagcagtgattaggggatgcagactcctttcatctttggcataggtttccaatgttcctgggcttttttgcatcaaactacttgaggggaaagagagtgaataattgcccaagggtaatttttatgggccaggttaacaaatagcatttacccatctgctcacatatttgccataactcagtcacatggccacayacaagtgcaagggaggatgggagccttactgcagcctggggagaaaagagaatgactggtgaccatttagcattttctgccaccaacaaaaaccatgttacagagtgagagacaatactgtaccagaatacctagttgaatggtgatatggtttgactctgtgtctccactgaaatctcatcttgaattgtaattgccataatccccatgtgtcaagggcaagaccaggtggaggtaactgaatcatggggtcagtttcccccatgcggttctcatgataatgagtgagtcttacaagat

SEQ ID NO: 166865 - DNA, 601 bp, Human
aataggattacatgatagttaaagatcatggttaagagcagggctttggaagcagcagacctgagtttgaattcttgtcctgcctcctatttgagaagtgacttcacatctatctaagcttcagttttctcatctttaaaatggggataataataggctgttgtgaggatttaataggataatacatgtaactctctcagcacagggcccatctcatagtaggtgctggtaaaagaggttgttttattcatattgctggatatatctaacactattccctaagtgtagtacatatataaayacatgcttttggctggaaaaactaagtgagatgatcaaatcactctgatggaaaagccagcagtgtggatggaaaaggtgtgcctgttctttctctcaggaaatccacagggttgcgcacagggcctcaggttttcatttggacaccccagcagcccctcaatacaggctattcacaaaagccccaatacagtcaccctgacagtccagctgtgaaccctggctccccacacgtgagccatggtgtccctctagccttgttcattcattgtgtcagtaatctactgccatgataacgctg

SEQ ID NO: 166866 - DNA, 601 bp, Human
cctcaatacaggctattcacaaaagccccaatacagtcaccctgacagtccagctgtgaaccctggctccccacacgtgagccatggtgtccctctagccttgttcattcattgtgtcagtaatctactgccatgataacgctgcataacaaattattccagaattcagtagcttgaaacaataagcattgattattgctcccaagtctatagtttggctggaaagttctattgatctggaccaggctaggcttgtcttggctgagctcacccttgtctccctggtcagctggcaggttgstgggggctgattggtttaggatgacctcactcacatgttgatggattactgttgactggggtgtcaggcattacaggttatgtgtctttcatcatccaataggctagcccgggcttactcacatggagcctagacagggtggcaagagaaagcagaaaagccacatggtctcctgaggcccaggctcatcacttctgccacattctttcagtcaaaataaatgacaagagaagtccagattcaaaagcccagggttgtgagaaggcttggtgttaggaacaatcgtaagaaacctctatt

SEQ ID NO: 166867 - DNA, 601 bp, Human
cagtaatctactgccatgataacgctgcataacaaattattccagaattcagtagcttgaaacaataagcattgattattgctcccaagtctatagtttggctggaaagttctattgatctggaccaggctaggcttgtcttggctgagctcacccttgtctccctggtcagctggcaggttgctgggggctgattggtttaggatgacctcactcacatgttgatggattactgttgactggggtgtcaggcattacaggttatgtgtctttcatcatccaataggctagcccgggcttrctcacatggagcctagacagggtggcaagagaaagcagaaaagccacatggtctcctgaggcccaggctcatcacttctgccacattctttcagtcaaaataaatgacaagagaagtccagattcaaaagcccagggttgtgagaaggcttggtgttaggaacaatcgtaagaaacctctatttatggctgattgctaattagtgttgcctaatttagcaatgaaatgtttcttcccatatgttcctctggagagcccatggcattcctctcccccgcttaagggccaaaattaagatac

SEQ ID NO: 166868 - DNA, 601 bp, Human
cctctcccccgcttaagggccaaaattaagatacagaagacttatttaatatctttactttgttcaagctggttcacatacacttgtcctccagcctttggtgaactgttttaggacagggacaggtttaacacaagggccgacctctgcagtgacactgggtttacatatctgggtacatgataggcgggtttcattcttgttccaaagagaattttgaggcatgaaatatgtagcctttatggaggcaggatttactttgactcatacagagaaagaaaatgtgtgtgtgtgtgtgtggattttcaatccttgcatgtgatatttttaagggctggtgcgatagctttgcttgccccaagaggatgtcccagacagtgcactagttgatgctgcagaaatggaaaattcctagggatatgtagccaatgaaccccttcacccacatttcctgattgtttgccacaatttgaacagtgagtggaaagaccttgtgcattccgcaggccatactcgcactgtcccagcagacctgggaatgtgcccatttgattcagtagttgttccacccaccattaaaatggacttttctagccacact

SEQ ID NO: 166869 - DNA, 601 bp, Human
tagttgttccacccaccattaaaatggacttttctagccacactcagcagctcacagctgtaatcccagcaatgtgggaggcttagatgggaagatcgcttgagcccaggagtttgagaccagcctgggcaacatgggaaacccccttctctacaaaaaatacaaaaaattagccaggcgtggtgcacacacctgtggtcccagctactgaagaggctgaggcaagagaatcacctgagcccaggaagtcgaagctgcagtaagccaagattgcaccactgcattccagcctgggtgaccraggagactctgtctcaaaaaaaaaaaaaaaaaaaaaaaaaaaaaaaagaataaataaatataaataaagtggacttttcatggttggatctggtagttccagatgatttgtaccattggaatcttttgcatcttgaatgctgtttgggtctgaaaacacagccttctcagtgattcagcttatacttgttttatttctctattgcggctttacaaaccaccccaaaatggggcgctttacagaaaactaaaagacaggtagataatggtttgctcagcactttaagtcttcacagaactt

SEQ ID NO: 166870 - DNA, 601 bp, Human
tcaaagacgcgactgggcttctgtgaagcccaatgacagctagggcatcacagcaacgttttgaggttccagaaaccaagaacagacatccaaagattttgagcaagggaggctcctttctttcttttcccactcccttagccccagcttggctcccctgtgaccacgtacgctggttctaactacaagggctgcgaggctccagtcccatgcctgtgccttagggaacccagtgtcctctggctccctggggcgtcagcatgaattcttgaggaagcactggggaattactcatggattrcaaaaacagcagagtttatcttacaaatttaaggaaaacattttattcatcctggctggcaattccaaaagttggctggtttttaattatttgctaaaaatgagccaaaccctccagagaatctttccattcgggagctttctgggctaaggaggtctaaagcgccacctggtggccaactcggatcgttgctggtctcaaagtcgaggtgttcgttcgttacaggttaggggggcgcccctgtgatgtctgaggtccttccccagcacccctccacgctgtctccagaaaaagcccaaa

SEQ ID NO: 166871 - DNA, 601 bp, Human
gcagtcttcaagctttaataaccccaggaacattatttgaaagtttatttacatttccattttcactgatttaattgtataaattttgaagaaaaatattactttttttattttgaaaatgcctttattcaagtaactgtcttttttaaaaaggaccccattctttccttctttcttttttcattttaatttttaagtaaacaacatcttcaatcaaaaagattgagtcaaaaattaaaattaagtgtgttattcaaaatccacaaaaccaagcaaatgtaccacaaacaatgaccttccraatgatggtttttgcaaatttgtcaaatgtatatttctgaaaatattaaagctcgagaccacatcaaggagtcgtaacactgtctcctgccttcaggccttttgtgtggtccatagttactgtgggcaccttcctgttgcaggggatggaagctggcggacaggtcccctgccccatatagctcacagtctaggaggagaaaaagacagggagcaaataaaaaaaaatcagataacaactcatgaaagaggacagagagtaaccagggctcagggacaagaggcgcctgagggtggggct

SEQ ID NO: 166872 - DNA, 601 bp, Human
tgattgaagattttgaaaaatatttaaaaaccacactgttgaccattgtgaaaatgccgtgaaatttctctaccagctatgaagtgctttcacatattattatcactattattattggccaatgaatctcataacactgcagataaacatattttatctgagcttttcaataaacaagtaaaaatcactgtaagtacaatgactaacatgagttttcagaacctaaaacctggatgagcatgaatttcctccttatcatccagagctaatattcatgagcacaaaaagtggcattgatgarcaccgaagtttgtgggcagatgtagtatttactggaggcagggacaggcacaccttgtgcaacaggagcagaggcagagagggtgcagctcaaatcccctggacatgcagcccccggggcaccagggctagccacagtgcatgctgcacaggcagacagagaaggctctaaatgaatggaagagacccacagagtcacctctactcattaatgtgctgtgcaggcctgcctggggtcagatagaaacacttgatgtgtgcctgtgtctgttcttgcccatcaaatacacatatcagcatt

SEQ ID NO: 166873 - DNA, 601 bp, Human
tcctctctccctgtcctctccctctctctctaccttctctctctctcctacactctccctctctccctctcctctctctctgtcctctccttctctctctaccttctctctctctcccactctctccttctcctctccctttctctctacctgttctccctctgcctctctctatcccattctctttgtctctctccctctatctacgctctctctctctctcccagtctgtctgcctctctccctctctctctccttctctccctctctctcactcggtctactctctgtctccaccccwcattcccctgtagctcctagagcatccaggggcagaggagaggccttccctaaaaacccttgggtcacgctgagcctctgtcttggcttggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagaggga

SEQ ID NO: 166874 - DNA, 601 bp, Human
tctccctgtcctctccctctctctctaccttctctctctctcctacactctccctctctccctctcctctctctctgtcctctccttctctctctaccttctctctctctcccactctctccttctcctctccctttctctctacctgttctccctctgcctctctctatcccattctctttgtctctctccctctatctacgctctctctctctctcccagtctgtctgcctctctccctctctctctccttctctccctctctctcactcggtctactctctgtctccaccccacattyccctgtagctcctagagcatccaggggcagaggagaggccttccctaaaaacccttgggtcacgctgagcctctgtcttggcttggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagagggagccca

SEQ ID NO: 166875 - DNA, 601 bp, Human
ccttctctctctaccttctctctctctcccactctctccttctcctctccctttctctctacctgttctccctctgcctctctctatcccattctctttgtctctctccctctatctacgctctctctctctctcccagtctgtctgcctctctccctctctctctccttctctccctctctctcactcggtctactctctgtctccaccccacattcccctgtagctcctagagcatccaggggcagaggagaggccttccctaaaaacccttgggtcacgctgagcctctgtcttggcgtggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagagggagcccatgaaggtgataagagctgcaaagaggaagagggttcaaggcacagctggaagtgccatgcaccagccctggcaaaatccaggg

SEQ ID NO: 166876 - DNA, 601 bp, Human
tggtccctgaatatgaatgagagacttgctctcagcctgtggccaccctataatgttaaaacagtcagaagattaatacacatccactctgaggttcttgcgcagcacagagggagcccatgaaggtgataagagctgcaaagaggaagagggttcaaggcacagctggaagtgccatgcaccagccctggcaaaatccagggctggcattcgttggtttgtggggcagcagaaacctgctttggccggggttgaatttctcaccttccagttgagtgggccattcagtcctggtcatctyggcactaggcaagttcaagagcatctgagcaagtgaacgccagcctctgtctatttcccacccacagagtgggcgtgactttgcacaagaagaagctgcactgaccagtttattctgtggttcattggtcacctgcattaaataaagtttttaaataaataaaaacataggtggaccaaaagcaaaatacagagtcttaaatttcctatctccttataaaatgaaccataaaatttaacatctggaaagttcaaaccaaagactaggcttattctagataatcttcctccaggagaaaga

SEQ ID NO: 166877 - DNA, 601 bp, Human
cctggagaggcctttgtggatggccaaacggggaccggaggcctaggagcaccagctctgcgggggcagcgccagcaccttcaccctgtgcccctgtgtcttaggattgtgtgtcccacactatcctggactgcaggactttgctccttcccaacattctgtgagaaatcactcccacgaggcatcagagaggaacacaaactttacagcgatgctatagggaagaaaggagaggcagccgtcagacacagaattactaatacagtttagaatagccatctctgcctttctgtcctctccraagtccctctcagctacagtgcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccaacacccagttctctgaggccaagcttctacttagaaacgagcttatcaaagcatcgcttcagcaaaggtggtctctcccatcatgaattctagtaagtt

SEQ ID NO: 166878 - DNA, 601 bp, Human
ctttacagcgatgctatagggaagaaaggagaggcagccgtcagacacagaattactaatacagtttagaatagccatctctgcctttctgtcctctccgaagtccctctcagctacagtgcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccracacccagttctctgaggccaagcttctacttagaaacgagcttatcaaagcatcgcttcagcaaaggtggtctctcccatcatgaattctagtaagttttgctaggggaataaaattgtctttaaatcattacatcagcaaagatgtgggtgggatgcagaaaggagccagtaggaccgtctgtgcctctttcttgatccctggactgcacagtggccccagagcacctgagatctccaaccattccaagtacccagggcccaagccctcctccacctccttgtctcctgcgaactggg

SEQ ID NO: 166879 - DNA, 601 bp, Human
gcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccaacacccagttctctgaggccaagcttctacttagaaacgagcttatcaaagcatcgcttcagcaaaggtggtctctcccatcatgaattctagtaagttttgctaggggaataaaattgkctttaaatcattacatcagcaaagatgtgggtgggatgcagaaaggagccagtaggaccgtctgtgcctctttcttgatccctggactgcacagtggccccagagcacctgagatctccaaccattccaagtacccagggcccaagccctcctccacctccttgtctcctgcgaactggggaacccaaacatggtgtcctctgctcaacgtgtccacaggcatccggatgctggaccagccattcatgacagacatcatcgaggcctcctccatcagtcatatgccacagctgattgaca

SEQ ID NO: 166880 - DNA, 601 bp, Human
cctctgctcaacgtgtccacaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaaggtaagggggccggccccctaggccccggccactcacaagttgggacaaagtgggtggaggggtagatgcaactgggtgaaccactgtcaccctgtgtgtgagyccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccggggggggagggtctcagacagcagtccccacgccaaagctgcccatcacagacagaaaggggcctgcactggcacccccaccacccactcagtcgttggctggcagtagcacacaggattttgggtctcggcgcacacagggcggtag

SEQ ID NO: 166881 - DNA, 601 bp, Human
ccgggagctcacgctgcaggccatggccgatggcgtgaacaaggtaagggggccggccccctaggccccggccactcacaagttgggacaaagtgggtggaggggtagatgcaactgggtgaaccactgtcaccctgtgtgtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccgggyggggagggtctcagacagcagtccccacgccaaagctgcccatcacagacagaaaggggcctgcactggcacccccaccacccactcagtcgttggctggcagtagcacacaggattttgggtctcggcgcacacagggcggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcag

SEQ ID NO: 166882 - DNA, 601 bp, Human
ctgtcaccctgtgtgtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccggggggggagggtctcagacagcagtccccacgccaaagctgcccatcacagacagaaaggggcctgcactggcacccccaccacccactcagtcgttggctggcagtagcacacaggattttgggtctyggcgcacacagggcggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcaggtcagtgctgcatagggaggggaagggggccccttctctgagacgctggggctggagccaccccagaggagacatgaccccaggctcagggaccagaggatttctgggctccagtctatcaggaag

SEQ ID NO: 166883 - DNA, 601 bp, Human
gtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccggggggggagggtctcagacagcagtccccacgccaaagctgcccatcacagacagaaaggggcctgcactggcacccccaccacccactcagtcgttggctggcagtagcacacaggattttgggtctcggcgcacacagggmggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcaggtcagtgctgcatagggaggggaagggggccccttctctgagacgctggggctggagccaccccagaggagacatgaccccaggctcagggaccagaggatttctgggctccagtctatcaggaagtgacttagcctcgc

SEQ ID NO: 166884 - DNA, 601 bp, Human
actgccgcttaagcaaccaccccaaaacttcatagcacagaacacaactcctttactacgcttgggatgctctgggtcaggaatttggaccgggcacactggggatggctcatccgtcctccatgattcctggggcctcagccgatagattcgttacttgagcatccattaccaaactgttgcgtcttcatgagctgttctgatgcatccatctacttgccacgcgtggcacagctcccacccctaggcttacgcagtcttctcaggcctgtcctggctgccaggccagcagttccccccmacccacaccgtgctcccagaggactctctgtaatcagcctggacgtgggactcacaccacaaggtcactgccgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaa

SEQ ID NO: 166885 - DNA, 601 bp, Human
cgcttaagcaaccaccccaaaacttcatagcacagaacacaactcctttactacgcttgggatgctctgggtcaggaatttggaccgggcacactggggatggctcatccgtcctccatgattcctggggcctcagccgatagattcgttacttgagcatccattaccaaactgttgcgtcttcatgagctgttctgatgcatccatctacttgccacgcgtggcacagctcccacccctaggcttacgcagtcttctcaggcctgtcctggctgccaggccagcagttcccccccacccmcaccgtgctcccagaggactctctgtaatcagcctggacgtgggactcacaccacaaggtcactgccgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaaatgca

SEQ ID NO: 166886 - DNA, 601 bp, Human
cgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaaatgcataaactcattacttatacattgataacactaaaataagtgaatgtacagaacgctatgtttaacgcrggcataaaaaagagaatattgaagaaaataagagtgggcaattgaaggctgcttttccatacatttcttgaggtcagaaaacatgtgttttcctgcccagaccatcctcaggaactggcccggggtttgagaacatagtggatgagctgttcagggggcaggtatggaattaatgcagacacgaaatggtacggttgagaggctgaaagtcacatcgaaatctatgactacaatggatgccattggtgcccaccaagatcccctttaccaggcctgggggccaccccagctgctgtgagt

SEQ ID NO: 166887 - DNA, 601 bp, Human
taaatattttataaaatgcatctgctccacatacacatttaagttatgtacagtctgtttatggaaaatgcataaactcattacttatacattgataacactaaaataagtgaatgtacagaacgctatgtttaacgcaggcataaaaaagagaatattgaagaaaataagagtgggcaattgaaggctgcttttccatacatttcttgaggtcagaaaacatgtgttttcctgcccagaccatcctcaggaactggcccggggtttgagaacatagtggatgagctgttcagggggcagrtatggaattaatgcagacacgaaatggtacggttgagaggctgaaagtcacatcgaaatctatgactacaatggatgccattggtgcccaccaagatcccctttaccaggcctgggggccaccccagctgctgtgagtgttggctgctgatggctcacagtgggccctctcacgaagcattgccttgacgatggaatcttctctcccagaaagttatgccccccacacccagggcacagcccacagccgatgactaaggcaggagcctgtttgcctccaacagggaggagtcttcaatgc

SEQ ID NO: 166888 - DNA, 601 bp, Human
gggccctctcacgaagcattgccttgacgatggaatcttctctcccagaaagttatgccccccacacccagggcacagcccacagccgatgactaaggcaggagcctgtttgcctccaacagggaggagtcttcaatgcaatttatggtccagagccccctgtgggccaggccaagggaaagctttacccaagactacatagttttggagttccttcccctctgtatcttacttcacttccttgctcgcaggttgctcctgagagccctccctcaatgagtctggggcagccgaatctctrcctcaggctctgcttctagggaacacctcccacaaacactgcctcaaaatttaccccattaggtttccctttttcctttggctgccaggaagcttagaactaagtgtgtgcctattaccattggttttttagactaggttttcttctaccttttttttttcttttgagatagggtctcactgcatcacccaggctggagtgcagtggcacaatctcagctcactgcagcctcaacctcctgggctcaagtgattctcctgcctcagcctccagagtggctgggactacaggtgcatgata

SEQ ID NO: 166889 - DNA, 601 bp, Human
ttagattatatttagccatgagaaatctaactttggatccttactaaattgttgcttgcttacacacattcctagtcttaccagactaaagcatctcactggacaaaaattggcaagttcacatgtaacttcctcagagtctcagccctaaacaatagtaaacaatatttcaaaccaagtggaacccttcagcgcagtgggtggccaactttggtacacaggctggatctaacccccagacttgctttgcaaagacagtttccttgggacacagccaggcccttccaggtctttgtgacaytctgggcacctccaaccacagctgtcacgggtcccaggggaaggaagcacatagggcaccaaatgaaggggctcatctctcagaatcaggcttttctggatgctggtcaacgtctctgtcttcactagagagccgacactgcacagcagcaggtccgtcctgttgcagggatatttcagcaggtggagagctcttgacagtggagagacctgagttttaacctcagtcctgccccccattggctggggaacttcagactagtcgatgtctccattcctcactttttgcaaaatggtctga

SEQ ID NO: 166890 - DNA, 601 bp, Human
aacaagatcccattaaagtttgcaaggtgttgctctacgtgatcttgaggatccaaatcatctaaccctgagatcctaagaccctaacatatggtttcttaaaacctacaatgaatagaaaagggcagcaggggtgacacatttccagaaaggaacagccctgtatttcctcatcagacaatgggttggacgggtgggctgtgtgatgactgagccacacgccatttgtctctgtgttgaagaaacagaggcctaggtagcccaaataaattggtttctcgtaagaatgcaccaggagggscttggcatagtggctcacgcctgtaatcccaacactttggggggctaaggcgggtggatcacctgaggtcaggagttcaagaccagcctgatcaaaatggtgaaaccccgtctctactaaagatacaaaaaattagccaggtgtggtggtgggcacctgtaatctcagttactcaagaggctgaggcaggagaatcacttgaacccaggaggcagacgttgcagtgagctgagttcatgccattgcactccagtctgggcatcaggagtgaaactctatctcaaaaaaaaaaaaaaaaat

SEQ ID NO: 166891 - DNA, 601 bp, Human
ggcttggcatagtggctcacgcctgtaatcccaacactttggggggctaaggcgggtggatcacctgaggtcaggagttcaagaccagcctgatcaaaatggtgaaaccccgtctctactaaagatacaaaaaattagccaggtgtggtggtgggcacctgtaatctcagttactcaagaggctgaggcaggagaatcacttgaacccaggaggcagacgttgcagtgagctgagttcatgccattgcactccagtctgggcatcaggagtgaaactctatctcaaaaaaaaaaaaaaaaatgcaccaagagggatcagggcaatgagatagattcaggcaagacctcatagtgcctgggaccagacagacatcctgatccaaggtggctgcaggatgccagccccaagaatgtgtggaaagccacaggagggctctgcggtcacggggctaggccacactcaccctgtttgcttctccccggtttcgtggctccggctctccaactcacccttccccttccttgaggcttatgcttagaggtgtttccacttggacaccaccccattggcacccttgcttgttacaatctgtcagcctct

SEQ ID NO: 166892 - DNA, 601 bp, Human
ggtgggcacctgtaatctcagttactcaagaggctgaggcaggagaatcacttgaacccaggaggcagacgttgcagtgagctgagttcatgccattgcactccagtctgggcatcaggagtgaaactctatctcaaaaaaaaaaaaaaaaatgcaccaagagggatcagggcaatgagatagattcaggcaagacctcatagtgcctgggaccagacagacatcctgatccaaggtggctgcaggatgccagccccaagaatgtgtggaaagccacaggagggctctgcggtcacggggytaggccacactcaccctgtttgcttctccccggtttcgtggctccggctctccaactcacccttccccttccttgaggcttatgcttagaggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggttctgttgggaaggtttggaacttgcagggtcagaggccagtcagatggttt

SEQ ID NO: 166893 - DNA, 601 bp, Human
cagccccaagaatgtgtggaaagccacaggagggctctgcggtcacggggctaggccacactcaccctgtttgcttctccccggtttcgtggctccggctctccaactcacccttccccttccttgaggcttatgcttagaggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggtwctgttgggaaggtttggaacttgcagggtcagaggccagtcagatggtttctaacaaaacccctttctttctcctctgaggacatcaaagggtagttgtctatattcacagtcttcttaggcatctgatggagtaattttttctgagctgttgaattctttcaaaggtctgaacagaaatataagactgtatgcccctgtattaatctgttttcatgctgttggtaaagacatacctaaggctgggcaatttacaaaagaaagaggtttattggacttacagttccacatagctggggag

SEQ ID NO: 166894 - DNA, 601 bp, Human
aggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggttctgttgggaaggtttggaacttgcagggtcagaggccagtcagatggtttctaacaaaacccctttctttctcctctgaggacatcaaagggtagttgtctatattcacagtcttcttaggcatctgatggagtaatttyttctgagctgttgaattctttcaaaggtctgaacagaaatataagactgtatgcccctgtattaatctgttttcatgctgttggtaaagacatacctaaggctgggcaatttacaaaagaaagaggtttattggacttacagttccacatagctggggagacctcacaatcatggtggaaggtgaaaggcatgtcttacctggtggcagacaagagaagagagcttctgtagggaaactcccctttttaaaaccatgagatctcatgagatctcataagacttattcactatcaagagaa

SEQ ID NO: 166895 - DNA, 601 bp, Human
tacctaaggctgggcaatttacaaaagaaagaggtttattggacttacagttccacatagctggggagacctcacaatcatggtggaaggtgaaaggcatgtcttacctggtggcagacaagagaagagagcttctgtagggaaactcccctttttaaaaccatgagatctcatgagatctcataagacttattcactatcaagagaacagcatggggaagactcgcccccatgattcagttacctcccactgggtccttcccacaacatgtggaaattcaagatgagatttgggtggggrcacagccaaacggcatcagcacctcttctgttgtgggttcaattgtgtccccaaatattcatatgttggggtcctaatccccaatacctcataatgtgaccttatttggaaatagggtcattgcagatataattaattaagatgatgtcatattggagtaggatgggcccctaatccaatatgattggtgtccttatttaaaagacaaaaaaaaaaaaaaagaacaggaacatctgggcacagataggcatacagggagaacagcatgtgaagatgaaggcagaggggctggggatgcat

SEQ ID NO: 166896 - DNA, 601 bp, Human
tgggtccttcccacaacatgtggaaattcaagatgagatttgggtgggggcacagccaaacggcatcagcacctcttctgttgtgggttcaattgtgtccccaaatattcatatgttggggtcctaatccccaatacctcataatgtgaccttatttggaaatagggtcattgcagatataattaattaagatgatgtcatattggagtaggatgggcccctaatccaatatgattggtgtccttatttaaaagacaaaaaaaaaaaaaaagaacaggaacatctgggcacagataggcayacagggagaacagcatgtgaagatgaaggcagaggggctggggatgcatctacaagcccaggagagccagagatggccaacagcccaccgggagctgggaaaggaatgggatagattccttctccagaacttctaggaatggaattgaatctattatgtctccagaacttctagagatggattctattcctagaagttctggagacggaagtgtcagcagggttggctgacacttccgtctccaggatttctaggcaagaaatttctgttgtttaagccactcagtttgtggtcctttgg

SEQ ID NO: 166897 - DNA, 601 bp, Human
gctggttgttaaacattgaatagcacacctctcgttagaggactcttctgacttcccttaaattatagcacttacatacctatgtgttctccctgcaagtaacagccacccttgccttcatgagtctggaagttccctttgcgaagtggaaaagctggaggaaaaacacctgaaaccccaaggttttatgtttccccaaaatgacaagtttcccaaccagagtcctaagttaccccaagactgtggaggacaacttttctaagtcaaggaaagatctcacactttaaggaattcaccactyttacattaaatacaaggatcccaaaaacacaattatgagatgggaaacagagtcctcgaagtgaacatcatggtgacagcagctaaatgtccattgctacactgttcaggaaatagtgaagacgctttattacaaggttatgccagtctgctgttgaaattcaacccatctgaaacagcaacaggagcctgacatttgagtgacacaatgcggtttacagagaatgtctgccaacaggatcgggtggcaggaaagtgacgtccctaccctgtttcaatgcctggtctccttaagaagcat

SEQ ID NO: 166898 - DNA, 601 bp, Human
gaagtgagggttcattgtgcattagcgaaggttttctcctagtgacttccactgcctggtctactctaaggaaaaatccacttctgaaaggcaatcttcacacaaacaaaggagtcagagaattacctgttacacaaggcacttcttacgtttgtctttcaattttatcatcctgtacatatgttttgtttgaccaacatggtaatgattaaaaggaagagaacaaagaggagatggataagagacttttatcggggcatgcactgtttgccatagatcccaccattcccagttgtctgayggctgcttcacacaaacatcacctacctgactccttagggatttgaagtttgcacctcctacatttgcttagtaaatacttgagagaagcagtgaggagtgggcaagaaggaaatcctttttttcttttgcttagtagtctatgtgttgggtttacagttacagcatttttcacgttgtatatgggaagagggtgacagtcagaggcccctgaattaccagagggttcaataattgacttctgtcttagttttagatctcctagaagcagatcctgaggcaagatttgggatcaagtagt

SEQ ID NO: 166899 - DNA, 601 bp, Human
cgaatactctgtgagcccagatttatgctctgcagccagatgaaggtcgcaactgagcagaactgctgcagcgtggaatctgcagttcagccttggaaacagctggtgccgttaccgtccttcctttcatttctgggataaagagaactaagagaaaagtctggtgggtttcgggtgatccttgtgaccagccgtctcattttgccagggactttcctgtttttagcattgaaaagtcctacatctcaggaaacccctcaatcctgggcaaaccaagacagttggtcacccaccctttggygctattagtagcgttggcccacctgggcccagtgagaaattcacccgaggttagaagttgacatgaatgtaaactcagcagcacctctgacatcagaaagattcatcactacaatggctggatcctttgagcagtgagacagaataacacaggattctgacctccaaggtggttacacgaaaaccagacaataactaaagacaaccacaggcgccatcaaacactgaatcgaggtgaggatttaaatcagaggccagggcaactgcatcatccttagcttggcttttccagagaacctga

SEQ ID NO: 166900 - DNA, 601 bp, Human
gaatgtaaactcagcagcacctctgacatcagaaagattcatcactacaatggctggatcctttgagcagtgagacagaataacacaggattctgacctccaaggtggttacacgaaaaccagacaataactaaagacaaccacaggcgccatcaaacactgaatcgaggtgaggatttaaatcagaggccagggcaactgcatcatccttagcttggcttttccagagaacctgataccctactcccgctgaactaccacagaacccacagggactctgcagagtctggaactgaccagwgaaagttccaaactacaaaggataccatctatcatcactcccactcacaactcattgattaaaatggcttataagacctcacccaaccacaaagaggcctggtcatgggctcagaccgtggacagtttgcaatatttagcaagcagcagcaatgactaccacaatgtgtaccgaaacagttaggtagctcaagaggtaaccagttgacctagtgaggacaaatgtgcaaatgtcgaagatgtttgtgaatagtttgaataaaatttgccaaagatgttcatgaataatttgaataaaatt

SEQ ID NO: 166901 - DNA, 601 bp, Human
ttattttaaaattcatattttaataacagattaaagtaatataatggaaaagtgtctgcaagtctaaatccaacacatcaaagaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccrtcatctctactaaaaaaaataaataaagaaaaataaaaattggctgggcacagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagaca

SEQ ID NO: 166902 - DNA, 601 bp, Human
agaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctactygggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaa

SEQ ID NO: 166903 - DNA, 601 bp, Human
gaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctacttrggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaa

SEQ ID NO: 166904 - DNA, 601 bp, Human
gctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaactatttttaagaaatgacaattctaaattatgacgcatatgagctgaatatagagttctcatgcactgctggtaaacatataaactgttaacaaactttatcaagaacaataatatggcag

SEQ ID NO: 166905 - DNA, 601 bp, Human
acagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaatraggtactatttttacccaccaaattggcaaaactatttttaagaaatgacaattctaaattatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattc

SEQ ID NO: 166906 - DNA, 601 bp, Human
atattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaactatttttaagaaatgacaattctaaattatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattccatgtacattcaagaagaggtgtaaataaattgcggaatggctatttcataaaactaataaaaaattatggtgtagaagagtatttaatcacataaaaaaagtcaattatataaattgtgagaaatacattttaagcaggccaagaaagttgatctatttttattatcccaatttcactttca

SEQ ID NO: 166907 - DNA, 601 bp, Human
attatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattccatgtacattcaagaagaggtgtaaataaattgcggaatggctatttcataaaactaawaaaaaattatggtgtagaagagtatttaatcacataaaaaaagtcaattatataaattgtgagaaatacattttaagcaggccaagaaagttgatctatttttattatcccaatttcactttcaagcccgttcttatactttgcatttatatgtaaaattggcaagaatccacaaaatatcaccagtgattatctattcatgtaagattataaaggacttttatttccttcatcttctatattccaattattctataataaatattattttcatagtaaagaatacaataactttttcca

SEQ ID NO: 166908 - DNA, 601 bp, Human
ctgcctaagaaaataaacatacaaagacatatataagattatgttcattttaaacataaagcacttttttaaaaactagagacagcattccatgtacattcaagaagaggtgtaaataaattgcggaatggctatttcataaaactaataaaaaattatggtgtagaagagtatttaatcacataaaaaaagtcaattatataaattgtgagaaatacattttaagcaggccaagaaagttgatctatttttattatcccaatttcactttcaagcccgttcttatactttgcatttatakgtaaaattggcaagaatccacaaaatatcaccagtgattatctattcatgtaagattataaaggacttttatttccttcatcttctatattccaattattctataataaatattattttcatagtaaagaatacaataactttttccaaggtatgctaatgttgtattaagaaattaaggtgactggaaaataaaaattactataattgtttacaaaaagataagctctcccaggcttgcctcaccaggggtctgcaccctgcacccataccaaccccagaccagcacctgttctggtca

SEQ ID NO: 166909 - DNA, 601 bp, Human
agttagagactgacggatcgaggatggcttccctcctgtgtctggcagctgtcagcaggggcagtgaatttgactggaatacttctctcttatcaatcaggaggctaacctaggcttatcttcatggtgcaacggagttctgggagagatcagagaacataggagttcttgggactgatgtttggaactgatacagaatcactttcccccacattctattggccaaagcaagacataaagccagcttggagtctaggggtaggaaatagaccactcttcttgatggatggggctgcaaagkcatagtgcacagggcataaatacagggaatcatgaataattagggtcacaatcaatctaccacactccccacacaaagaagagaatgtttagcatcgatttccttcattttagcaaacgttgcttcatctcactagcagtctacatatggactgattcaggagaaagttctgcagatggtcaacctcactcacccatttattgtgaaacacatcagttgtactttgctttttttttttttttttttttgagatggggtctcgttctgtcacccgggctggagtgcagtggcacaatctcg

SEQ ID NO: 166910 - DNA, 601 bp, Human
gggctggagtgcagtggcacaatctcggctcactgcacctcccgaatagctgggattacagacatgtatcaccacacccagttaatttttgtatttttagtagagacagggtttcaccatgttggccaggctggtctcgaactcccgaccccaggtgattcacccacctcagcctcccaaagtgctgggattacaggcatgaaccaccgcgcccggccacacttttgctatttcttgataccgagcccaaatctgagtctgtttgagagtgtgatcctccacaccaactgtagggatgatmtatttccctcgctgtcctggtttctgagagcagttccttgttttggttggagttttccagcatagatttaccaagatgctgagaatagttcccagctagtggttgaataaatatttgttcacttgtcgattcaatcaatcacaggctgattaattcccagtgctgttagaagcgattgaaaatgtcacatctgattgtcaggcggcagagagcacttggaggtaatccagtcatctctcttccttctggcttctccactcttaaaccactgattctgtgtcagtttcaagcgtaaggacc

SEQ ID NO: 166911 - DNA, 601 bp, Human
ctcccaaagtgctgggattacaggcatgaaccaccgcgcccggccacacttttgctatttcttgataccgagcccaaatctgagtctgtttgagagtgtgatcctccacaccaactgtagggatgatctatttccctcgctgtcctggtttctgagagcagttccttgttttggttggagttttccagcatagatttaccaagatgctgagaatagttcccagctagtggttgaataaatatttgttcacttgtcgattcaatcaatcacaggctgattaattcccagtgctgttagaagygattgaaaatgtcacatctgattgtcaggcggcagagagcacttggaggtaatccagtcatctctcttccttctggcttctccactcttaaaccactgattctgtgtcagtttcaagcgtaaggaccatggacacctggtgaccacacagggagagactttccctgacaatctcttctgtcttctccctctagagggtaaccaagccaccctgggccaggctgtggagtggctggaggttgcacctgccccttgcctccggcactgcatggctgcactcctatccaccctcccagcccac

SEQ ID NO: 166912 - DNA, 601 bp, Human
ggctgtggagtggctggaggttgcacctgccccttgcctccggcactgcatggctgcactcctatccaccctcccagcccacaggtgaacactaagcagccccaagccccattgccttggggtaagaaagtgggaagcaagaaactaatggtccaatcctgggttgtttaggtagagaggaaaatcctcagaagacaaggaaaaggatttttaagaacctctaagaacatggtttgaggagaagagccatgctaactgtagggacttatgcaaagtttgccatttaaactaattagcatgkggcaataactactgtgcttactactgtgtgtttaaggttttattcactgtgtgttttacttgatcatattagactttcctcctacatttggagttcccttgctcaagtaaaatgtcatatattatgtgtttaaaaggattctagtatccaattgaataaaaaagaatatatacatatgcacacacacgtaagatttttatatatcatggagtaaatgtatgctttatatttataatgtctacatatcatatttaaatttatatattgatatatagctatttaaaataaaaggtatatatc

SEQ ID NO: 166913 - DNA, 601 bp, Human
atccaccctcccagcccacaggtgaacactaagcagccccaagccccattgccttggggtaagaaagtgggaagcaagaaactaatggtccaatcctgggttgtttaggtagagaggaaaatcctcagaagacaaggaaaaggatttttaagaacctctaagaacatggtttgaggagaagagccatgctaactgtagggacttatgcaaagtttgccatttaaactaattagcatgtggcaataactactgtgcttactactgtgtgtttaaggttttattcactgtgtgttttacttgwtcatattagactttcctcctacatttggagttcccttgctcaagtaaaatgtcatatattatgtgtttaaaaggattctagtatccaattgaataaaaaagaatatatacatatgcacacacacgtaagatttttatatatcatggagtaaatgtatgctttatatttataatgtctacatatcatatttaaatttatatattgatatatagctatttaaaataaaaggtatatatcttctataaatgttttgtatagcttatgtagctaagaaaaattatatgtccatatacttgcatt

SEQ ID NO: 166914 - DNA, 601 bp, Human
gtaaccctgtctgaaacaagaacccatctgtttatttatagcaatttaaaaaacaacattcacggatggacttttctggatccataaaccccgtaaaattgcacacacatctgttattttctcagggaaagagttgtgattttcatcatattttaaaatggagccatgatttttagaacaaaaagattaataatcacagatttattgtttgttgctcttttctgagcaaagaaaaaaaaatcttcctttcttggcaactaggtataatggtgaattttccaagcccctgggaaatacatcrtctgtaaagcataataagcttttttggatcttttcctctctggagattttgctcacagatcagccttttcttacacctccaaaccaggatttagtaggtggttcagtagtcatgcatgaattatatcctgactggctgcacccatctccactgaggcttcttgagacaggaggacaggagctcaggacaaaatcattagtaccatccagtgtttcgatcccacgctcccacgtgggatcccaacttggcaagatggccatgcccctgcgtgagcgaggagaagccctttacctggaaggg

SEQ ID NO: 166915 - DNA, 601 bp, Human
ctgtaaagcataataagcttttttggatcttttcctctctggagattttgctcacagatcagccttttcttacacctccaaaccaggatttagtaggtggttcagtagtcatgcatgaattatatcctgactggctgcacccatctccactgaggcttcttgagacaggaggacaggagctcaggacaaaatcattagtaccatccagtgtttcgatcccacgctcccacgtgggatcccaacttggcaagatggccatgcccctgcgtgagcgaggagaagccctttacctggaagggaygcagaccttaaaagcctgtccttcccacgagccctcctgcattcccccttggtcttggggaggatgaagaatgtgccagctcctcccaaacagaagggggctttgacccctcttatcctgtaagctgtatggacagaaagggagaagggcagagcagacagggacaggtgaggtgacacttcactctcacgcctgaaagctccactccctaccccaaagacctctcagtggtgtaaatttgtcctcgacccgtatttatgactctttctacttgggctggctaaaggccttgagtttcct

SEQ ID NO: 166916 - DNA, 601 bp, Human
tgttttaatagcctgcccttctagagagactttagctgagcatgttgattctttcctcttcgggaatgccttctttcccccaagaaggaaaaagaaatgctgatgaagtggcctttggcctttcaagggccagtcccaatgcaacaaaactagggtgggggtattgacatcactttccacttcataatgtttccttttaggtttcaggaaataaatctctctgtagtctctggaatagccacagatatgcttctttgaacaactcatttatcttgtggacactgtaactataactgactakatatccccttttacgtgggctactaggaagctcagataaaatctagggcaaaagagaggcatatggatgctaagtttatccttagtttcatcttaatcttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagct

SEQ ID NO: 166917 - DNA, 601 bp, Human
gctgatgaagtggcctttggcctttcaagggccagtcccaatgcaacaaaactagggtgggggtattgacatcactttccacttcataatgtttccttttaggtttcaggaaataaatctctctgtagtctctggaatagccacagatatgcttctttgaacaactcatttatcttgtggacactgtaactataactgactatatatccccttttacgtgggctactaggaagctcagataaaatctagggcaaaagagaggcatatggatgctaagtttatccttagtttcatcttaatyttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagctaattcaggaggctgaggcaggagaatcgcttgaacctgggaggcggaggttgccatgagccaagatcatgccactgcactccagcctgggcaacagag

SEQ ID NO: 166918 - DNA, 601 bp, Human
tatcttgtggacactgtaactataactgactatatatccccttttacgtgggctactaggaagctcagataaaatctagggcaaaagagaggcatatggatgctaagtttatccttagtttcatcttaatcttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagcygggcatggtggcacgtgcctgtaatcccagctaattcaggaggctgaggcaggagaatcgcttgaacctgggaggcggaggttgccatgagccaagatcatgccactgcactccagcctgggcaacagagtgaggctgtctcaataaataaataaataaataaaaggagtagataatcccctgctccacattgtgcgggggttcaaaatagcgtgatttatccactcattactcattatcttcccttccaggcaaccacagatttgtacggcaactgcactctgaggcattctgggacat

SEQ ID NO: 166919 - DNA, 601 bp, Human
ataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagctaattcaggaggctgaggcaggagaatcgcttgaacctgggaggcggaggttgccatgagccaagatcatgccactgcactccagcctgggcaacagagtgaggctgtctcaataaataaataartaaataaaaggagtagataatcccctgctccacattgtgcgggggttcaaaatagcgtgatttatccactcattactcattatcttcccttccaggcaaccacagatttgtacggcaactgcactctgaggcattctgggacatctgcagctgcccccgaggcagctggtgtgtttgcactggctctggaggctaagtatgttcatagctctgggtccagggccagctctgcagggtggactaacacgtgtctctctgcccacatgccaggtgtccatggagggaaaagttgatgtgaga

SEQ ID NO: 166920 - DNA, 601 bp, Human
tacctgcccacctgctactctactttcttttaatgatacctgaggctggccttatgttcacagaatgaacacatgggcttcagacaccacacacatagtgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttsgttcctagaatagaaaggggcttcaacagattacctagttcaaccctctaccttcacaagaaaaggcataattatcctccctttacagataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtc

SEQ ID NO: 166921 - DNA, 601 bp, Human
agacaccacacacatagtgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttggttcctagaatagaaaggggcttcaacagattacctagttcaaccctctaccttcacaagaaaaggcataattatcctccytttacagataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctg

SEQ ID NO: 166922 - DNA, 601 bp, Human
tgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttggttcctagaatagaaaggggcttcaacagattacctagttcaaccctctaccttcacaagaaaaggcataattatcctccctttacagataagacccyaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgtgcagagccagg

SEQ ID NO: 166923 - DNA, 601 bp, Human
agataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgygcagagccagggaacaggagtgctccaaaagcgagaagggtttccggttgccctttcaacctcagaagtcaggacttgactcacagtcttctggatttttgacaaacaaaatcctatgcctatgcctagatccataggcacacaaatggaagacctaaataaatcaaagtgggggagtgaggctgctggactcctagagattcatggctctgccttgattagtcaccattcttttagcacatacgtccagatatcctacagaaaagaatgcagtcaccattcaggcatgctttgttttga

SEQ ID NO: 166924 - DNA, 601 bp, Human
ttgagcagtatatgagaattacagttgccccacatccttgccaaaatgtggtattattagtcttctatattttagcattcttatggatgtgcagtggagtcatattatagttttaatttgcacttccctcatagctagtgaaattgagcacactgggtaaagttttttaaaaaatacattcccaagcctcacccaagcctcatagaatacaaatccctagggatgggtggcccaggaacctgacttttcaatgcctgttccccgggaatacttaagctgccagcctgtcgctgatctgtgractagggtgtgaggatgatcaataaggcaatagctctgtgaatctatgactctgggtgcagagtgtgggtagctggcttctgcctctgattaggtgttggtattcagtcaagatttaatgtttctgcatgaaacaacgaatccaaataataacagagacaagggtttatttctctgtcatgtgaaagaaaatacagagataaggaacccagggctggtttagggtaccggggtaccattgtgaatcagggaatccagctctttctagctttctgctcctttgctctgccactttcatgtt

SEQ ID NO: 166925 - DNA, 601 bp, Human
gctgccttgatcattaggaggaaaatgttaattgggttcaggggaacttgatgctgtaaatagaagtactatgctctgaaagagaatggtgagggaacagccttgcacacgagaaaaacaatccattctgttagaagtcaggttcctacaaaggataaatgcttgaggtgatggataccccatttaccctgatgtgattatcatgcattgcatacctgtatccaaatatctcatgtaccccataaatacatacacctactgtgtacccacaaaaattaaaaattaaacattaaacaaaaartcagtctgctggtcagccacttcctaagagatgcttgctgacccctggacccaagtttctcagatttcctgatgatcagaatcctggagtgcttgttaaaaacacagataccctaagcccactggagatccatagaatcagaatccccaggggagcccctggaaagctctatttttcaccagcgcccccacccccaccagtgccgtccaggaagttaggaagctctcccctgaacgaggtttgctgcatactgaaaatactaaatgtttggaggaatccatggaatcaaaacctctgagc

SEQ ID NO: 166926 - DNA, 601 bp, Human
tcatttagatcctcatttgtcaacacttctgagattaataaactcagaatccccttccagcaaaacactcagtttttagccataatcaacttaaggaacttttacaccattttacatcatttacaccattttacaccacttacatcattttacaccatatgtccaagacatgttctgaatctcctcaaataagcattgaccttccttggaacttgcttcttttctttttttctttttttttttaattatacttttaagttctagggtacatgtgcacaatgtgcaggtttgttacgtatgyatacatgtgccatgttggtttgctgcacccattaactcatcctttacatgaggtatttctcctaatgctatccctccccatccccccaccccccacacacacacatgacaggccccggtgtgatgttccccttcctgtgtccaagtgtggaacttgcttcttaatagaagaaggtctgcattcaagagcacatggatcatttgaactcttggttctgattcagatcttccaaccaatgaactttgcatatgttgaaattttatcaaatgagttatgttgctcctggtcctttgaattgtt

SEQ ID NO: 166927 - DNA, 601 bp, Human
gttcccagatgaagggacagcaagaccagcactcagaagctccctgtatccccttccagtcactgccccacgagactgaccactaacatgacctccaacagcatagattagtcattcttgtttttatattttaaacagatggaatcatactttatggtctcttttctgcctggcttctttaggccaacatggtatttgtgagatttttccatgttgttcagagtacctggagttcattcattctcactgctgtatagtaccccacattctataagttacacctcaattagtttactccctrtcttttggatggcatgtaggggtttcacagtttggggctaggagcattctagtacacaggtctggtgaatatgtacacatttggtcaggtatatgcctaggaaaagaatttccaggccatagcttaagcttaactttagaagatacagccaaacagttttccagtttagttggaattacttgcacgctcatccacaaagtacatgtgttccagttgctccacatcttcaacacttaacattgtcagtctttttcattttagccattccggtgtgtgtgttagaatagacttttgaaatca

SEQ ID NO: 166928 - DNA, 601 bp, Human
attctatccaaatgggccccaaaataagagatttttttctctttcctcaccagtaaaacggagctaatgtttttcctccgcaggctgctgggagactttagcaacacacaagtctacagcaggcacacagtaggcacttaataaatgtaacattgcctctccttctcattcatgactagatgtgaacacttctagcttacacctgtagaatcaaaagacagtaatctcctagagtttttggtgaaataattgtctgatttttatgcaaattccaaatcagatatcctctcagcctaaaatrtcctccaatggacaagcatgtgccctgggattcccatcctcccatgggccagcagcctgccatagatgggctgcctaccataggtaagcatcctcccacgggccagtgtcctcccgtagatgggcagcccaccataggtcagcatcctcccacaggccagcatcctgccatatacgggcagcccaccataggtcagcatcctcccatgggccagcatcctgccgtagacgagcagccaaccataggtcagcatcctcccacaggccagcgtcctgccgtagacgggcagcccaccatagg

SEQ ID NO: 166929 - DNA, 601 bp, Human
tgggaatgaacaaagagacaagactgggaaccactgtccaaatgggggatttaaggctaaaccctactcatcataactaactttacccaaagtcaacatgaaatgggcgttgacaactgtttcccttgttagagttcagaataatttcttgagaaatttggaagtgcagtgactttctgcagtggtgaaaatgttctgcactgtccaatacaatagcttgtggctattgagtgctagaaagtggatgaccgtgattaagaaacaagagttttcattttatttcattctcattaatttaaayttaaatagcaacatgtggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcggccttgggagggtgctagtaagaactgctgctaagaacttctctcggaa

SEQ ID NO: 166930 - DNA, 601 bp, Human
tgattaagaaacaagagttttcattttatttcattctcattaatttaaatttaaatagcaacatgtggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcrgccttgggagggtgctagtaagaactgctgctaagaacttctctcggaaagtcactgggatagcactttattccactatctcatttaatcacaggaggttggcatccctagtcttaatttaggtgagaaaacaggatcagacaaataaagcaaacggccttaactccaatgtccttatccattccacaaggccctggggcctggtacctcattcccttattgcaaaaggagaaagacttacgatgtctgtgcctttacagacactctgcaagcagggagtgggggctggaatgtccctca

SEQ ID NO: 166931 - DNA, 601 bp, Human
tggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcggccttgggagggtgctagtaagaactgctgctaagaacttctctcggaaagtcactgggatagcrctttattccactatctcatttaatcacaggaggttggcatccctagtcttaatttaggtgagaaaacaggatcagacaaataaagcaaacggccttaactccaatgtccttatccattccacaaggccctggggcctggtacctcattcccttattgcaaaaggagaaagacttacgatgtctgtgcctttacagacactctgcaagcagggagtgggggctggaatgtccctcacaggcagtgcaactggcacgatatctacacttacttgcatataagcaatatttacaattaacaaa

SEQ ID NO: 166932 - DNA, 601 bp, Human
ctacaatcaaaggggaaaatacacctggctgtgaccagctgcaccagctgtgtgtagaatgagcagagccagcccaggccggccccatcagccagctgggagtgacctgtctaacacagctgcccccagcccctctgggcaccctgaggggactgttcactgagctcctttaaggctgtgccaaaatatgtgatccagctctgaagtttaagtgaatttggaaataaatgttaaaacctggtatcaatgccggaagcagcatgggagtgagaggtcagcgtgtgctcggccctgtgccacctgggggactgtggaccagcactcccgagctgcagaggcttcctgcacaagttcatgcccacctgactctgctacagggggaggagaaaacctcaccatggccacctgctgcgtgtcgtcatgtgactgccacaaaagcaggcatcttgggcacttgagaaagagtggctgtcattgttactattgtgattattctatcaaaacaatcacagccttataactttttctttttttttgagacagagtcttgctctgtggcccaggctggagtgcagtggcacgatcttggctcactacaacc

SEQ ID NO: 166933 - DNA, 601 bp, Human
ccctgaggggactgttcactgagctcctttaaggctgtgccaaaatatgtgatccagctctgaagtttaagtgaatttggaaataaatgttaaaacctggtatcaatgccggaagcagcatgggagtgagaggtcagcgtgtgctcggccctgtgccacctgggggactgtggaccagcactcccgagctgcagaggcttcctgcacaagttcatgcccacctgactctgctacagggggaggagaaaacctcaccatggccacctgctgcgtgtcgtcatgtgactgccacaaaagcagrcatcttgggcacttgagaaagagtggctgtcattgttactattgtgattattctatcaaaacaatcacagccttataactttttctttttttttgagacagagtcttgctctgtggcccaggctggagtgcagtggcacgatcttggctcactacaacctccactgcccaggttcaagcaattctcctgcctcagcctcctgagtagctgggactacaggcatccaccaccaaacccggctaatttttgtatttttagtagagctggggtttcaccatgttggccaggctggtgtcgagc

SEQ ID NO: 166934 - DNA, 601 bp, Human
actgcccaggttcaagcaattctcctgcctcagcctcctgagtagctgggactacaggcatccaccaccaaacccggctaatttttgtatttttagtagagctggggtttcaccatgttggccaggctggtgtcgagctcctgacctcaggtgatccgcctgccttggcctcccaaagtgttgggattacaggcatgagccaccacagcttcataactttatcttacagttgaagattcataacacaagaagcattccccagggcctcctgggaagcaacacctatttcttgacacaaggmagtttaaacacttacttgcaatgatacacaataaaataaagatacaagccaccccgacaaccccaagtttgtcttttataagactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcc

SEQ ID NO: 166935 - DNA, 601 bp, Human
gtagagctggggtttcaccatgttggccaggctggtgtcgagctcctgacctcaggtgatccgcctgccttggcctcccaaagtgttgggattacaggcatgagccaccacagcttcataactttatcttacagttgaagattcataacacaagaagcattccccagggcctcctgggaagcaacacctatttcttgacacaaggcagtttaaacacttacttgcaatgatacacaataaaataaagatacaagccaccccgacaaccccaagtttgtcttttataagactggaacactasgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccgacccctcggcctc

SEQ ID NO: 166936 - DNA, 601 bp, Human
ataagactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgwtccgacccctcggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacat

SEQ ID NO: 166937 - DNA, 601 bp, Human
gactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccracccctcggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtc

SEQ ID NO: 166938 - DNA, 601 bp, Human
acactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccgacccctyggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtcactgtaa

SEQ ID NO: 166939 - DNA, 601 bp, Human
ctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtcactgtaagaaaatcagaaaatrcaagtgagcaaatgaagagagaaacaagaaacatctggaaaatactgttcctaggctctcccaatgccacgatgccagccaaaaaaacctgacctgtgaggggagaatggtgttctttctctaccaagttcgctgcctctggaattcacagcatgcttttaatttaatttcatagtaacttaatattctcagaagagtccagccacatgtctcctctctcagcagacccagctcctgtgcaggaagcagttcacatggcagggcaggatcggggcgtttttctagctggcagtctctccg

SEQ ID NO: 166940 - DNA, 601 bp, Human
gacccccaggcacaccccagtgtccaaggcttctaggaaaatgtgtgattcttaacacaagtttgtgtgtttgtccctactcccacctgtctttcggctttccaaggtgcatggaatatgtctttcagtctccctccatctctcccttgcaccctctatcacaaatgcacaccactcactctcaaataagacctttagcctgggcaatcagtggcctgtgttctagtttccccttctcagcctcgctgtcattttccctcccttagtcttagtcgctaaggccttccccatgagcgtgggkctcctgggagaaacagatacgacagccaccatagaagattcacacagacaggaacacaccggcccttgttgttctgccagtgaggctccttcttgggactcaaattccaggctcctctgccatgcccttaatgtcaaagtggtcgccggcctacatctatctttacaataacttcttaagggctttttaaagaaagcaaaagaagtgagggtgactgagcccacagatggaatgaggcccatattctgtatcaccaacgatgacataaatatagtcaatagtcctcagacactgtgcaga

SEQ ID NO: 166941 - DNA, 601 bp, Human
ctggctcaactctagaaggaaagcccgattctgggcctggctgcttgtctgcctagaaaccctgtgatagaatgtgtcatttccctcataccttgaggttctggatgaatatttcagagtcctccagagaggtggccagaaaacctgcaaaacaaagctgcagtttccccaactgcttttcctagagcccgtgagccgggaaaaaactgaatgcccttgaaacagaaggccaagagactctctgcctgttgttgttgttcttatcagattcaaattcaacatacataaacaatttagaccygcactgtccagtacagacgcaaccagccacaagtggttatataataacatattagattagttaaaattgaataaaataaattgaacattcatttcagcactcacatgatctatgtttcaattgctcattagccacatgtagccagtggctaccatactagagattatatatatagaatatttccatcatcgtagagtgtcctattggccaatgctagtctagacatttgtaaatatactatgtatatgagtatacatgtatatacacatatagacacgttatatatatgtgcatatataa

SEQ ID NO: 166942 - DNA, 601 bp, Human
tgagttgtcacgctgaggaatagagaaaccggggtaaaaacctgtcagtcactgggagagagctacccctcaaaggttaaatccctgccacctttgggccgccctgcacgcaggctgtgcaggcttccacggaggtgggaggaagcccagggggaacacggggagattctcgtgcctggggtgggaagcagtggacgtgcaagggagcttcagctgcaggtgaactcagaagggacttaggagactcaggagggacatcacagcatctactacattctccttccacacagaaggttccaarcgtaagtaacttgctcacagccgggcgtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtct

SEQ ID NO: 166943 - DNA, 601 bp, Human
cggggtaaaaacctgtcagtcactgggagagagctacccctcaaaggttaaatccctgccacctttgggccgccctgcacgcaggctgtgcaggcttccacggaggtgggaggaagcccagggggaacacggggagattctcgtgcctggggtgggaagcagtggacgtgcaagggagcttcagctgcaggtgaactcagaagggacttaggagactcaggagggacatcacagcatctactacattctccttccacacagaaggttccaagcgtaagtaacttgctcacagccgggcgtrgtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaaaa

SEQ ID NO: 166944 - DNA, 601 bp, Human
agcagtggacgtgcaagggagcttcagctgcaggtgaactcagaagggacttaggagactcaggagggacatcacagcatctactacattctccttccacacagaaggttccaagcgtaagtaacttgctcacagccgggcgtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaacccyggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaaaaaaaaagagataagtaacttactcaggctcacacagccagtgtgggaactaaacccaggtctgattgatcaaccccaaagcccttgccctttccgccacctgaagctgccctcaaaatcccttgtaaggtgcacccaccactgcttatcctatctcct

SEQ ID NO: 166945 - DNA, 601 bp, Human
gtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaraaaaaaagagataagtaacttactcaggctcacacagccagtgtgggaactaaacccaggtctgattgatcaaccccaaagcccttgccctttccgccacctgaagctgccctcaaaatcccttgtaaggtgcacccaccactgcttatcctatctcctcttcactctgccctcaggaaaataccatccactggcaagttggtgctgacactcacaaccgacgcctgtgaggggaaggaaaattttgtccgctacctggagcatgtccaggctgtcatcacggtcaacgcaaccagaaga

SEQ ID NO: 166946 - DNA, 601 bp, Human
ttgtaaggtgcacccaccactgcttatcctatctcctcttcactctgccctcaggaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacrtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctcc

SEQ ID NO: 166947 - DNA, 601 bp, Human
taagtcataaatcattatcaaaatctcccgacctccagtgcctggaatgtaaccctgattctggacaattcacctccaactcgcaggtaacctgggccataaagctaattgcctccattcagcctgtaatctagatgcctcggcccagggctcactctacccctcaaacctttccagtctctagacccttagtggaattaatcagccctcacattccctaacccaacacttcaacactgaatccctcgggcactccaatcctaactcagactgccccgacctccaatttggaccctctccraaatgccccaccagaaccgagaccccggccagcgttccccgcaggccttagtccccggcccgctccgggcaggtccagggcttctagatctccggccgccttgaccttggagttcagcaggctccgccgccaagcccagtcctgccgctcacctgggtccctttaccggccccgggaggccccagcagcacggcccggatgcctttaggatactcgggttctgccgctggcacgctgggagccatgtccgccgaagtctctcactgccaccagttcgcacgcctcacaggtccagtgctt

SEQ ID NO: 166948 - DNA, 601 bp, Human
agttgatgagggcaagaactttatcagtcttgcccaatgctttatatccccaatgttaggtgctcatgaaatgctgaatgagcaaggtaggtattatccccatttttcaggtaagaacactgaggctcggaagttacatagctagctaaattataaaacccttgtcccagtactatactagtataggttgtccattccataattactgaaattattaacttcaatatgagttaagaaaaaaatctcagggcatagtggcttgtgcctataatccctgcactttgggaggtcaaggcaggakgatcgcctgtgtccaggagttcaataccagcctgggcaacatagcaagaccctgtctctacaaaaaattgtttaaaaattagctgggcatggtagcatgtgcctgtactcccagctacctgggagggtgaggtgggaggattgcttgagctcacaccactgcgctccaacctgggcaacagagtgagaccctgtctcaaaaaaaagaaaaagaaaaagaaaaacaatgaagcatttgagctactgtttatacttgatcactcacagcaaaagtctgcagagtctaagattaaacttccct

SEQ ID NO: 166949 - DNA, 601 bp, Human
tctgtggtcaacctactattttgaaagctgacaaagagaataaatcaagcatttatcctgacttttctataccaaccatatcacggggtaacgaaacagtagatgaggggaagtttctctttatagaaatatttcagctaataaatgaccagggaacaatataattagaataccaccatttcaccatccataacgaattactgaacctagacactgaacagcatgactataaacaccagagacaaggaaataccatgtgcctcctcagggagagcacagcacccaccacctgtgaagtagytgggccaaaaaattgaacctaaattgaattaagtatatactaattaagtataaaccaccaatttacaggaaatagagagggcagaggaagatgttaagtacaccaggggaatacaactgaaaattcccagagagtggtataatactcccaggaaaaataatccaatttctggggctggacatgatggctcacggctataatcccaacactttgggaggccaaggtgggcggatcatgaggtcaggagatcgagaccatcctggctaacacagtgaaaccccgtctctactaaagatacaa

SEQ ID NO: 166950 - DNA, 601 bp, Human
aaacattatttcagtcatgcaacataaagcacataaaatactgagttacgcaggtataacaaagtatagcaggaagaaaacaaacattactgagcaggcactaggcactaaccccaggttagggattttacatgtaagattgcaaacatctgccagtgggagccaagcaggcaatgcaactgtatgaaatgagtcaaatgtaagcaatgggcagtgaagaggaccgtgcaggggacaggaagacacacagaccatccaaagcagcaatgccacacaactgcaagtgactgctgccacactrgaatggaggcatcactgccaggtcttctggtttctcaagagaaactggagctctggatttttaagagaaattgcataaccgaaaacgctctgtggtcaacctactattttgaaagctgacaaagagaataaatcaagcatttatcctgacttttctataccaaccatatcacggggtaacgaaacagtagatgaggggaagtttctctttatagaaatatttcagctaataaatgaccagggaacaatataattagaataccaccatttcaccatccataacgaattactgaacctagac

SEQ ID NO: 166951 - DNA, 601 bp, Human
aaaagggaggcaaggaaataaagttatttaaataaaataacaaacccaggtattatagatgttttaaaacattacattgatgcaaaagcgagtagttttgaaatatttaactactttagttaaaagtgaggagttttaaaaggaaacattatttcagtcatgcaacataaagcacataaaatactgagttacgcaggtataacaaagtatagcaggaagaaaacaaacattactgagcaggcactaggcactaaccccaggttagggattttacatgtaagattgcaaacatctgccagtrggagccaagcaggcaatgcaactgtatgaaatgagtcaaatgtaagcaatgggcagtgaagaggaccgtgcaggggacaggaagacacacagaccatccaaagcagcaatgccacacaactgcaagtgactgctgccacactggaatggaggcatcactgccaggtcttctggtttctcaagagaaactggagctctggatttttaagagaaattgcataaccgaaaacgctctgtggtcaacctactattttgaaagctgacaaagagaataaatcaagcatttatcctgacttttcta

SEQ ID NO: 166952 - DNA, 601 bp, Human
aactcaggggctaagttgcccaagatcacagagctagtaaaagaactggcaacaggccagattaccaagccctagctcttagccatgacactataaggctttaagacaaacaacccaaagagccttagtggctatcctcctggaagggagcacaaggaggatttcaaagtgctggcaatattctgtttcttgataatgggtgtaagctacacaaatctgttcacattgtaaaataaatcaagctgttcactttttctaggtatcttatagcttaagttgttttttttttaatcacagaaayctgtgtttgcatttcagatgtctcttaacttactgaggaaatcattaccaacctcactgggtggacaggaggatgaacaggagaacttcagcaaattgtagttcttgttctatccctgaactaacccaacattcaaagtcactcatctgatgcttcccacctggcaccctgcacttgtatgtatttttccattcatattcatttctgcctcttcatctagattacacagcaacaatgtaaattaatgactactcaagagtcagacagacatgagttcaaatcctacctttgctacttact

SEQ ID NO: 166953 - DNA, 601 bp, Human
ccaggtgattggattctacagctagatgaaagaacacacaccaatagggaagaaaactaattcctggctgggtatggtggctcacgcctgtaatcccagaactttgggaggctaaggcgggtggatcacgaggtcaggagttcaagacttcaagaccagcctggccaagatggtgaaaccccgtctctactaaaaatacaaaaattagccaggcgtggtggtgggtgcttgtaatcccagctactcaggaggctgtggcagagaactgcttgaacccgtgaggtggaggttgcagtgagckgagatcgcgccactgtactccagcctgggtgacagagcaagactcttgtctcaaaaaaaaaaaaaaaaagaaaaagaaaaaaagaaaacgaattccttcatttcctgctggctgcctgggagtcaatgtggtaggctgtaaagagcacgcatgggttttgaagtcagacagatttacacttgattcctagctaaggcactcagtagccgtgtgatcttgggctaagtacttaacttctcagagtgtcagtttcctcatcagtttaatggggataatgactacttcacagggttcttatga

SEQ ID NO: 166954 - DNA, 601 bp, Human
ctcacacctgtaatcccagcactttgggaggccgaggcgggtggatcaccggaagtcaggagttcgagactagcctggccaacatggtgaaaccccatctctactaagaatacaaaaattagctgggcgtgctggcacgtgcctgtaatcccagctacttgggaggctgaggcaggagaattgcttgaacccagaaggtggaagttgcggcgagccgagatccagcccgggcgaagaagcaagactacgtctcaaacaaacaaacaaacccaaaaaaccaaaattctgtactttgcaaaaycagtgaatgtcaggagccctgacaatgaaaaaccaggctggcactgtggccgtacatctagagagtgctttctgccaatctttctcattgctgttgaaattaacctgggtaaacaatttggaggtcaggcttgctcaagtggaaaggctgaccaaaacaccacagagaagagctgttagcacagaacctgttctatttttatcactcccaaactgcaggactcttatgcactgttccaggtgattggattctacagctagatgaaagaacacacaccaatagggaagaaaactaattcct

SEQ ID NO: 166955 - DNA, 601 bp, Human
ccagtagctaaatggcagacacagaagttttcagccaatctgggtgcctacagagaggaagacaaaaaccaagattcaattacattacaggctgtggagtcagactgcctaggtgtgaacctggccctgccacttactggctatgtaaacatgggcaaatgcctacttccttacctgtaatggggataaaagtaccttatattacattctaacatatactgattatagggttatggtaagaattacatgaaataatatatgtaaagcacttaaaacagtacaactagcacacaggaaggartcataaatattaattatcactatttccactcaacacactagtgacacataagtttcagtttccccattataaatgggaagacttgctgggcatggtggctcacgcctataaccccagcactttgggaggctgaggtgggcggatcacgaggtcagaagttcgagaccagcctgaccaacatggggaaaccccgtctctactaaaaatacaaaaattagctgggtgtggtggcgcttgcctggaattgcagctactcaggaggctgaggtaggagaattatttgaatctggtaggcagagg

SEQ ID NO: 166956 - DNA, 601 bp, Human
gcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacgcctgtaatcccagcactttgggaggccaaggagggtggatcacctgaggtcaggagtttgagaccagcctggccaacatggtgaaaccccatctctactaaaaacataaaaattagccaggcatggtggcaggtrcctgtaatcctagctactcgggaggctgaggtacaagaatcgcttgaacccaggaggtggaggttgcagtgagccaagactgcgccactgcactccagcctgggcgacagagcgagactttgtcaaaaaaaaaagaaaaaaaatttcctataatctgccagtttgttaaaacaccctctagcacatggttgttcaacagaattttgtttgatgatggaaagttctgtatcagcgttggctggtaaatacttgaaatatggctagtgcaactgaggaactgatttttacattaattaaatt

SEQ ID NO: 166957 - DNA, 601 bp, Human
atcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacgcctgtaatcccagcactttgggaggccaaggagggtggatcacctgaggtcaggagtttgagaccagcctggccaacatggtgaaaccccatctctactaaaaayataaaaattagccaggcatggtggcaggtgcctgtaatcctagctactcgggaggctgaggtacaagaatcgcttgaacccaggaggtggaggttgcagtgagccaagactgcgccactgcactccagcctgggcgacagagcgagactttgtcaaaaaaaaaagaaaaaaaatttcctataatctgccagtttgttaaaacaccctctagcacatggttgttcaacagaattttgtttgatgatggaaagttctgtatcagcgttggctggtaaatacttgaaatatggctagtgcaac

SEQ ID NO: 166958 - DNA, 601 bp, Human
gataagaaggattacctttgtcacaactgcgaagtaattgctttgttacagaaacagcacacagagccataaagcaggttaaaaaacacttctgtgacttcctaaatcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacrcctgtaatcccagcactttgggaggccaaggagggtggatcacctgaggtcaggagtttgagaccagcctggccaacatggtgaaaccccatctctactaaaaacataaaaattagccaggcatggtggcaggtgcctgtaatcctagctactcgggaggctgaggtacaagaatcgcttgaacccaggaggtggaggttgcagtgagccaagactgcgccactgcactccagcctgggcgacagagcgagactttgtcaaaaaaaaaagaaaaaaaatttcctataatctgccagtttg

SEQ ID NO: 166959 - DNA, 601 bp, Human
agaaaatgcaattatcgtccccagataagaaggattacctttgtcacaactgcgaagtaattgctttgttacagaaacagcacacagagccataaagcaggttaaaaaacacttctgtgacttcctaaatcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttayaaggccaagtgcggtggctcacgcctgtaatcccagcactttgggaggccaaggagggtggatcacctgaggtcaggagtttgagaccagcctggccaacatggtgaaaccccatctctactaaaaacataaaaattagccaggcatggtggcaggtgcctgtaatcctagctactcgggaggctgaggtacaagaatcgcttgaacccaggaggtggaggttgcagtgagccaagactgcgccactgcactccagcctgggcgacagagcgagactttgtcaaaaaaaaaagaaaaaaa

SEQ ID NO: 166960 - DNA, 601 bp, Human
ctcaagcctgtaatcccagcactttgggaggccaaggcaggtggattgcttgaggtcagaagtttgagaccagcatggccaacatggtgaagacctgtctctactaaaactacaaaaattagctgggcgtggtggtacatgcctgtagtccgagttactcgggaggctgagacaggagaattacttgaaccggggaggcagaggttgcagtgagccaagatcgcgccactgcactccagcctgggtgacagagtaagactctgtctcaaaaaaaaaaaagcaataagagccaggcacagtrgctcaagcgtgtaatcctagcactttgggaggccgaggcaggcggatcacttgaggtcagttcaaaaccagccgggccaacatggtgaaactccatctctactaaaaatacaaaaaaattagccagccctggtggcagacacctataatcccagctacttgggaggttgaggtaggagaactgcttgaacccaggaagtggaggttgcagtgagccgagactgcgccactgcactccagcctgggcgacagagttagactcccatctaaaaaaaaaaagtgacaagaatgagatgctgtc

SEQ ID NO: 166961 - DNA, 601 bp, Human
ggtcagagatgggcatcactatatggttatcctagagcctctcgtggtcctctgctcccagggtctagtactgtgctatgcaggaagcaggtactcaggaagctgggcccatagaatcaaaggtctccagtatcacctgattctgctaatacgtgcttagtgcctaagagaccccaggcctagtgatgtctttactgttaaccctactgcttctcgacctacatcaactttgtctactctgtgcccagtggggatacaaagaaacagaagttcctgcattaaaggagcctatggaatagcyggagacatgtaacctggacatttgaaaagaaaatgaatataaggtagagtccactgtatttcatatcgctttccaggataatagtgctaaccctgtgctgtctattcacatgtttgtctcttcttgaaggtatggactacaaacacatggaaaagatgttcaacctcattaggaaatcaaagtaataatgtctgaaataagaaaacattttttccctaatccaaaaatttacatgcattatgatggccatagtatcattttaacagtggctaactggaagaaacataaatgtacaacaat

SEQ ID NO: 166962 - DNA, 601 bp, Human
tgaaaaagatcctgtgtgaggtccggggtgcattccccagcatcttcaaacagccgacatctgtgaccaacctgggcaacagagtgagactctgtctcaaaaacaacaacaatgacaacaacaaaaaaaaacagaaaagaaaaagatccatattaaactgactggttcctgcctcattttcttctaaccatcaacattttggactacgaggcagaaagcaggcttccagggctaaccctgccactcatctgttgggtaaacttggaaaaacaccttcagcagtgacatgctctgtgaggamgggggtccttctctctgtgaggaagtcacactaaccacctacttccaaatggagggaatgaatcttctctctttcaccctttacagcaatcctgctgtttgttcttcagaatctctctgttctctcccacccaacctcagttagaaatctccaccacatcatgtggatcataaacaggctcctagatggtatccttatctgtttctccttgccgtaatttaccttgtacaccaggaccaagctaatgttcttagaatactgtttttgccacaatacccagtggctcaagactatctcatg

SEQ ID NO: 166963 - DNA, 601 bp, Human
ttgggaggggctaggggcatgagatacggaccaggatatttttttaccttctagagagcacagggcacatagcagccaggctgcaacaaatatgactcccacacactgctcttttgccattcacaaataccactttttaaaacaatacaaggctcattccacagaaggtaaatgaaagaaaccccactctccaagttctcaaaatgggattgctctcaagtaccaaccaaaatagctccatgagccactgagcgtggcttggaggtatcatcaggactgggaatctacaatcactgctacygtgagtgtgatactttatttttatttttttgagatagggttttgctttgtcacccaggctggagtccagtggcctaatcatggctcagtgcagcctcgacctccctagctcaagcaggcctcccacctcagactcccaagtagctgggaccaccaccgcaggtgcacactgccacacctggctaactttttttttgctttatagtagagacgaggtcttgctatgttgctcaagctggtctgaaactcctggcctcaagtaatcctcctgtttaggtccctaccaaatgctgggatcaca

SEQ ID NO: 166964 - DNA, 601 bp, Human
cgcccggctaattttttgtatttttagtagagacggggtttcaccatgttggccaggctggtctcgaactcctgacctcgtgatccacccacctcggcctcccaaagtgttaggattacaggtgtgagccaccgcgcccggtctagttttttaattttttgtagagatgaggtctcactatgttgcccaggctggttgtcttgcatactttaaatcacctctagattatgtatacctaatacaatgtaaatgccatgtaaagaattgatatactgaattttaaaatttgtattattttttmttttcttcagctttcctgggttatatttattggtggttttgttctgaatatttttaatccacaaatgcttgaatccgtagatgagggaaccatggatatggaaggccaactggacagaggagtaaaggttcctgtgactgcagtcatgtactgtgaggttgcaccttccattatttgagtgcctggaaggattcctctgatgcattcattcagaaatggcatccactgggagacccagggaaaggagagagcaggctgctgggctcagctgcagcaactttgggaggggctaggggcatg

SEQ ID NO: 166965 - DNA, 601 bp, Human
tgatccacctgcctcagccttccgaagtgctgggattacaggtgtgagccactgcgcctggtctatttattttattttttgagacatggtcttgctctgttgtccaggctggagtgcaatggcaatgaccatagttcactgtaaccacaaactactgggctcaagtgaccctcccgcctcagtctctggagtagctgactacaagcatgcgccaccatgcctggctaattcttttattttatttaattaatttattttattttattattattttttgagacagagtctcattctgttgccyaggctggagtgcagtgtcatggtctcggctcactgcaacctctgcctcccaggttcaagcaattctcctgcctcagcctcctgagtagctgggattacagatgcctgccaccacgcccggctaattttttgtatttttagtagagacggggtttcaccatgttggccaggctggtctcgaactcctgacctcgtgatccacccacctcggcctcccaaagtgttaggattacaggtgtgagccaccgcgcccggtctagttttttaattttttgtagagatgaggtctcactatgttgcc

SEQ ID NO: 166966 - DNA, 601 bp, Human
tgacctgatgaacttgtttcataggacaaaggtaaacccaggaaattcttactgttgcctgcatgctttaaaacaaaccatatagactctttatggcaaatggtgcagtgaccatgtatgaaaccccaggacacagtacagcagcaataactataaaaagaatatttttctggaggactggtcatcaaacttctcttcagtgccacactcttcccactctccaattgtaggcttttaagaaagcttctcctgattagctgatcacttaggtggccatgatgccagaaaaggggctgctctygacagaagacaggtacaatctgggcactgcaaaaagctagcaccactggaagcaaccttgaggccaagcaataaaccacctgaggagacactgaatagatctgacacaggccatgtgatttacttgatagtgttatttttcatgactaagttagtaatattggtagaaataaaaggaagatggaaagaataaaggaaaaagaaaaacagtgaagaaaggggaaggaaagaaaaggaaattttttgtcctgagtttacatacgtcatctttcatgggctcttttggagggttgaactcctc

SEQ ID NO: 166967 - DNA, 601 bp, Human; identical to SEQ ID NO: 166947

SEQ ID NO: 166968 - DNA, 601 bp, Human; identical to SEQ ID NO: 166948

SEQ ID NO: 166969 - DNA, 601 bp, Human; identical to SEQ ID NO: 166949

SEQ ID NO: 166970 - DNA, 601 bp, Human; identical to SEQ ID NO: 166950

SEQ ID NO: 166971 - DNA, 601 bp, Human; identical to SEQ ID NO: 166951

SEQ ID NO: 166972 - DNA, 601 bp, Human; identical to SEQ ID NO: 166952

SEQ ID NO: 166973 - DNA, 601 bp, Human; identical to SEQ ID NO: 166953

SEQ ID NO: 166974 - DNA, 601 bp, Human; identical to SEQ ID NO: 166954

SEQ ID NO: 166975 - DNA, 601 bp, Human; identical to SEQ ID NO: 166955

SEQ ID NO: 166976 - DNA, 601 bp, Human; identical to SEQ ID NO: 166956

SEQ ID NO: 166977 - DNA, 601 bp, Human; identical to SEQ ID NO: 166957

SEQ ID NO: 166978 - DNA, 601 bp, Human; identical to SEQ ID NO: 166958

SEQ ID NO: 166979 - DNA, 601 bp, Human; identical to SEQ ID NO: 166959

SEQ ID NO: 166980 - DNA, 601 bp, Human; identical to SEQ ID NO: 166960

SEQ ID NO: 166981 - DNA, 601 bp, Human; identical to SEQ ID NO: 166961

SEQ ID NO: 166982 - DNA, 601 bp, Human; identical to SEQ ID NO: 166962

SEQ ID NO: 166983 - DNA, 601 bp, Human; identical to SEQ ID NO: 166963

SEQ ID NO: 166984 - DNA, 601 bp, Human; identical to SEQ ID NO: 166964

SEQ ID NO: 166985 - DNA, 601 bp, Human; identical to SEQ ID NO: 166965

SEQ ID NO: 166986 - DNA, 601 bp, Human; identical to SEQ ID NO: 166966

SEQ ID NO: 166987 - DNA, 601 bp, Human
atgtgaagtacatctctaaaaagaaaaaacagaacaggctgtgtggcccaactgatttatcactactcttagaaggaagcccaatttaaaattgaacagaataaggcctgcaaggctcccgtgacttggtccctgcctacctctcttaaacaaataaataaaatgtatactatgtagaaacaataacaaaaaaaaggcagagcaaggtatggggcagttctggtgccagagggtttgttatttaaataaagtggtcggaaatcatgcgtcgctgataaggtgacaacagtcagaagcctgaaaaagttaaggggtaagcaatataaatatttaagtgcttcctcataactttgctcactccactccagctaaatttgccacaatttctgtttcctccatctgaaatgctctccctccttattcttccattcttcctctggttcacttctactcctgtagttcttggtaacaaacggaacatttgtggagtgagggggggggatccatttccttcaaggcgcagtttggaggtcacttcctcagggaagccttcccttctctctttccctttaaagctcccagtatagcatcttccagtact

SEQ ID NO: 166988 - DNA, 601 bp, Human
gtctgtaatcccagctactcaggaggctgaggcaggagaatcacttgagcccaggaggcagaggttgcagtgagctgagattgtgccattgcactccagcctggccgacaagagataaactccgttccagaaaaaaaatccccaaaacaaaaaacccaattgagtcaattctaatagttttgtgtatttttagtctccaaccagcactattttatggagagagaataggaaacaaagaatctagctaggggaagcgtgcaaaaacctttggttaagactaagttgtaaatggaacaacccaaatgtccatcaactgatgaacggataaacaaaatgtatatccatacaacagagtatcattcaaccataaaaaggaatgacgttctgctaggtgcaaatacatgcatgaactttgaaaacattatgctaagtgcaaaaagtcagacacaacaaacatattgtatgattctagttacaggaaatgcccagaatacgcaaatacctggagacagagagtagattagtgtttctctaaggctaggagtagtgggtaataggtagcgtctgctaacgggtgcaagttttattagatagtgtgatg

SEQ ID NO: 166989 - DNA, 601 bp, Human
attctcctgcctcagcttccagagtagctgagattacaggcgtccaacaccatactcagctaattgtttgtatttttagtagagatggggtttcaccatgttggtcaggttggtctcaaactcctgacctcaaatgatccacctgcctcagcctcccaaagggctgggattataggtgtgggccaccacacctggcctcagatactttttggtttacatgcctctaactcactctccttcctttcatagccaatttcttgtaacagttgtctcttcttttgggctccatttcctaatctcycattccaattttaattccatactacatcatactactaaattccatatcacatcacacataatcttgctaagatcacagaagaccttcacgttgctaaattcagtgagtattttttagtcctcactccctcccagaagcattctcctcttttggtctcctttattttattctcttagttttcctcgtctctgcctgcttagctttctttgcaactgttcttatttttcctagtcattaaatattagcaatctttggggctctggtcttttgtcttcttactctacagtctccttaactgat

SEQ ID NO: 166990 - DNA, 601 bp, Human
gtccagccatgttctcagtgcagatgtgataccctaccttgttttaatctgaattgactctcccttagctgagagagccagacaaactccattttggctccttcacttgtagccccttgcagcctcttacccaccccccttcctcaaggacttaacttgtgcaagctgactcccagcacatcaaagaacgcaaataactgataagatattgtggaaagctatagccgcagttcccaggaatttgcccagttgatattaccctaagccccagcatttgtgtctggttgatggtacccaaagyctccgcgtctatcaccttgtgatggatttaaagcccctgcgcccggaactgtttgttttcccgtaaccatttgtctttctaacttttttgcctgttttacttctgtaagattgcttcagctaggctcctcctcccctttctaaaccaaagtataaaagaaaatctagcaccttcttcggggcggagagaattttgagcactagccatctctcggtcgctggctaataaaggactcctgaattcatctcagagtgtggcgtttctctataactcgctcggttacaacgcggagagccaatg

SEQ ID NO: 166991 - DNA, 601 bp, Human
gttggccagggcagtcttgaactcttggcctcaagcaattctcccagcttggcctcccaaagtgctcagattacagatgtgagccaccctgcccagcctatatgctttatttaaagccctaattgtatcaacagtgaggaatggtaaagaaaattatattagatgcagtaaaaagagaaagttactagtaagcaagagatctgggttcacatcctgactcatctacttactagatgtataaactcaggaaagttaaatctgaattaatttccttagcaaaataatgcttactttaaaaagytgttctaagggtttaaatgcaaaagtgactaatagagcgctatgtacttataaatgcatatctgaggttaagaaagagtaagttaggctgggcgcagtggcttatgcctataatcccagcactttgggagaccgaggtgggcggatcacctgagctcaggagttagaggtcagcctgggtaacatggtgaaactctgtctctactaaaaatacaaaaattagccgggtgtggtggcgcatgcctgtaatcccaggtactcaggaggctgagggaggagaatctcttgaacccaggaggca

SEQ ID NO: 166992 - DNA, 601 bp, Human
ccccagcctaccaaagtgctgggaaaacaagccacagtagcgggcttgtttttctttttaaaagagggcttcaattagtatttttcttcacttctggaaaacgttctgccattatctcttgaaacactgcttctctgccattctccttcagtctcttcatttggaatgccttttcaactgatatcaaaatttcccaatctatttccatgtttttttgtttttgagacaggatcttgctctgttgcccaggttgcagtataatggcacaatcatagtcactgaagctttgatctcagctcargtgatcctcccacctcagcctctcaagtagctgggattacaggtgcatgccatgatgcctagctaatttttttgatttttagtagagatgaggtctcgctacgcccactctggtctcgaattcctgagctcaagtgattctcctgccttggcctcccaaagtgctgggattacaggcatgagccactgcatccagcaacccccactcccccaccattttttttttttttttgaaacagagtctcgctctgttgcccaggctggagtgcagtggtgcgatctcggctcaccacaacctctg

SEQ ID NO: 166993 - DNA, 601 bp, Human
attttttgtagagacgtggtttccccccattgcccaggctggtctggaactgctgggctcgagcaatctgcccaccccagcctaccaaagtgctgggaaaacaagccacagtagcgggcttgtttttctttttaaaagagggcttcaattagtatttttcttcacttctggaaaacgttctgccattatctcttgaaacactgcttctctgccattctccttcagtctcttcatttggaatgccttttcaactgatatcaaaatttcccaatctatttccatgtttttttgtttttgagamaggatcttgctctgttgcccaggttgcagtataatggcacaatcatagtcactgaagctttgatctcagctcaagtgatcctcccacctcagcctctcaagtagctgggattacaggtgcatgccatgatgcctagctaatttttttgatttttagtagagatgaggtctcgctacgcccactctggtctcgaattcctgagctcaagtgattctcctgccttggcctcccaaagtgctgggattacaggcatgagccactgcatccagcaacccccactcccccaccattttttttttt

SEQ ID NO: 166994 - DNA, 601 bp, Human
actgtcctgcctcagcctcctgagtagctgggactacagttgcgcaccaccatgcccggctaattaatatttttagtagagacggggttttactatgatggccaggctggtctcgaactcctgacctcgtgatctgcctgcctcggcctcccaaagtgctgagttacaggtgtgagccatcatgcctggcctaattcttctttttttttttttttttgtagttttagtagagaccgggtttcaccatgttggtcaggctggtctcgaactcctggcctcaagtgatttgctcacctcggcmtcccaaagtgctgggattacaggcatgagccaccatgcccggcctatttagcataattcttaaaggcactaggatttttggaatgtaaatgagcattggcttcaacttcaagtcaccagctgcattagctcctaacaagagagtcagcctgtcctttgaagatttgaagccaggaatcaacttctctctagctacgaaagtccgagatggcatcttcttccgaaaaaaggctatttcatctaccttgaaaatccattgttgagtgtagccaccttcatcaatgatcttagctagatcttc

SEQ ID NO: 166995 - DNA, 601 bp, Human
tctcttgttatttctaccccatctacagtgacttccctcactgaagtcttgaacccctcaaagtcacccatgacagttaccatccacttcttccaaacttctgttaatatggatatttttacttcctcccatgaatcacgaatattcttaataacaccgagaatgctggatccttttcagaggttttcagtttactttgcccagatccatcggaggagtcactatctatggcagctatagccttttgaaatatatttcttaaatagtaggacttgaaagttgaaatcactccttgatccaygggctatagaatggatgttgtgttagcaggcatgaaaataacattcaactcctgaacatctcaagctctacagaagctctccatcagagctcttaggtgatcaggtgcactgtcaatgagcagtaatgttttgaaaagaatctttctttttgaggagtaggtctcaaaagtgggcttaaaatgctcagtaaatcatactgttaacagacgtgctactatccaggctttgttgttccatttatagagctcaggcagagtagacttagcataattcttttttgagatggagtctcactctgt

SEQ ID NO: 166996 - DNA, 601 bp, Human
taaagtgtgtaatagcgttacatctacaaaaacaacgtacatactttaatttggttaaggtatggctaaaaatgctaacgatcatctgagccttcagcaagtcataatcttcttgctggtggagggtcttgcctccatgtctgatggctgctgactgatcagggtggtggttgctgaaggctgcagtggctgtggcaattccctaaaataagacaacaatgaagtttgccacatcaattgactctccctttcacgaaagatttatctggtgcaggtgatgctgtttgatagcattctgtcmacagcagaacttctttcaatattggagtccatcctctcagaccctgctgctgctttatcaacgaagtttatgtaatattcaaaatcttttgttgccatttcaacaacgttcacagaatcctcaccagtagtttccatttcaagaaaccactttctttgctcatccataagaagcaattcctcatctgttcaaaatttatcatgagattgcagcaattcagtcacatcttcaggctccactcctaattgtagttctcttgttatttctttttttttttttttttttttttgagacggagtc

SEQ ID NO: 166997 - DNA, 601 bp, Human
gtgggttcagttccagacaaccacaataaagtgactcacttggatttttttgtttctcggtgcatataaaagttgtggttacactataccgtagtctatttaaagtgtgtaatagcgttacatctacaaaaacaacgtacatactttaatttggttaaggtatggctaaaaatgctaacgatcatctgagccttcagcaagtcataatcttcttgctggtggagggtcttgcctccatgtctgatggctgctgactgatcagggtggtggttgctgaaggctgcagtggctgtggcaattmcctaaaataagacaacaatgaagtttgccacatcaattgactctccctttcacgaaagatttatctggtgcaggtgatgctgtttgatagcattctgtccacagcagaacttctttcaatattggagtccatcctctcagaccctgctgctgctttatcaacgaagtttatgtaatattcaaaatcttttgttgccatttcaacaacgttcacagaatcctcaccagtagtttccatttcaagaaaccactttctttgctcatccataagaagcaattcctcatctgttcaaaatttatc

SEQ ID NO: 166998 - DNA, 601 bp, Human
agactgcttgagcccaggggtttgagacctgcctgggcaacacagggaggcctcatccctacaagtaattttaaaactacccgggtgttgtggcatgcacctgtggtcccagctacttgggaggctgaggtgggagaactgcttgagcccaggctgtcgaggctgtgatgagccatgaccgcattactgcactctggcctgggcgacagagtgagaacttgtctcaaaaaaaagacaagaaaaagaaaaagatgctgggaaatgcgaaccaaatgctctgtgaaaggacagtagttccaaytggtaatgcctctccttggaaactgggctattaggaaaggagtaaatccaacaggtgcgggagcagcttcctggttgtcaccaggcacatgggctctggagtttgaaagatctgggtactaataattcctgctcagttactaactgtgtgatattggacaacttcttatcttctatcctcagtgttctcatctgcaaaacaaggagaatatttaccatacactatgactagtgggactgacacatcatagttcaataaacacagctgcatacctctgaggtgcaagtgaaaaaagacagg

SEQ ID NO: 166999 - DNA, 601 bp, Human
aaatgtagtaaaactgtttcttgcattgttgggcagtggtaaaaatatctaacttaaactgtaataaattgcaaggatatgtgttgtaatctctagggcagggatgggcaaactgttttagaaagggccagttaataaagattttaggggctgggtgcagtggctcacgtctgtaatcctagcactatgggaggccaaggcgggcagatcatgaggtcaagagatcaagaccattcctggccaacatggtgaaaccctgtctctactaaaaatacaaaaattagctgggtgtggtggcacrcgcctgtagtcccagctacttgggaggctgaggcaggagaattgctggaacccaagaggcagaggttgcagtgagccaagattgtgccactgcactccagcatgggtgacaaagcgagactccctctcaaaaaaaaaaaaaaaagattttaggctttatgggccacatatgctctttactgcttattcttcatcttttttcacaatccttaaacaatgtaaaaaccattcttagctcatgagtcatacaaaaacaaggtatgggccaaatccctgctttaataataaaaggaggtccaac

SEQ ID NO: 167000 - DNA, 601 bp, Human
ggaagccagaaggcaatgcaatgatcctttaaaagtgccaaaagaaaaataattgcaaacttccaatttcatacccagtgaaagaaattgaaagatgttttcagataaaagaaagctgaaagaactcattactgaaagaactgcactacaaacacatactaagtgggggctctttaggttgaaggaaaatgaactcacacagaagcaaagaactgcagacaagaatcaagagtatcagaaaggggaagtaggggtagatatagatgaaaagtgacttaaaaaacaattacaggctgggcgsagtggcttacgcctgtaatcccagaactttgggaggccaaggtgggtggacagcttgaggtcaggagttcaagaccagcctggccaacatggtgaaaccccatctctactaaaaatacaaaaattagccgggcgtggtggcgggcacctgtaatcccagctactcagtaggctggggcacgagaatcccttgaaccagggagacggatgttgcagtgagccgagatcatgccgctgcccttcagcctgggtgatagagggagactcagtctcagaaaaattaaaaaaaaaatggtagtaa

SEQ ID NO: 167001 - DNA, 601 bp, Human
ttttttccctactgcttttctatcagtattacattgtgaggctattggacttatgtcaccataaacaacaataaaagctggaaatacataaaacaacagggcaagccgggcatggtggctcacacctgtaatcccagcactttgggaggctgaggtgggtggatcacctaaggttaggagttcaagatgagcctggccaacatggtgaaaccccatctctactaagaatacaaaaattagccaagcgtggtggcaggcacctgtaatcccagctactcgggaggctgaggcagtaggatcrcttgaacccgggaggcggaggttgcagtgagccaagatcgtgccattgcactccagcctgggcgacaagagcgagactccatctcaaaaaacaaaaacaaaaacaaaacaaacaaaaaacaaaacaaaacccaacagggcagcaaatcttgagcgaagggaagtaaggtgaccacacttgccttgggctttctcactgagggtatttctttgcaaaccaggtgctgataaaaagagaccaagcagacagcgaaagactaagcagaggaaacagctattggagttcagggctggaggaggc

SEQ ID NO: 167002 - DNA, 601 bp, Human
taatttagcaaactccaaactgttagattctatcctaatttttacaaattatatataatgctacattggacatctttgcagtcttttcccttctctagaatcatttccttaagatgccgaaaattgctaggttcaaaattgttttttgaaaggtatcctaatcaacattgctgtcgacaatgtgtgaggatacttgttcacagcaatcagccacactaagtattatatattatctacagccatttttcctttttaggtaataggctttgtttcttatttggaaagagtgagttcatggtcwtttgagttcagtggttaccaaattctagctcacatgtgacagtatatgaatcaccttttactgggttccacccaaacctaatgaatcaaaatctcttgggattgggccaggcattttttttttttttttttaagacggagtctcactctgtggcccaggctggagtgcagtgatgcaatcttgactcagtgcaacctctttctcctgggttcaagcaattctcctgtctcagcctcccgagtagctgggattacaggtgcatgccaccacacccagctgaatttttatatatttagtaga

SEQ ID NO: 167003 - DNA, 601 bp, Human
tcctggactcaacctatctgcccaccttggcttcccaaagtgctaggattacaggtgtgaaccacaatgtgtggcctacttatagtttttatgccatattatattcccaattattagtggaaacataatttagcaaactccaaactgttagattctatcctaatttttacaaattatatataatgctacattggacatctttgcagtcttttcccttctctagaatcatttccttaagatgccgaaaattgctaggttcaaaattgttttttgaaaggtatcctaatcaacattgctgtcracaatgtgtgaggatacttgttcacagcaatcagccacactaagtattatatattatctacagccatttttcctttttaggtaataggctttgtttcttatttggaaagagtgagttcatggtcatttgagttcagtggttaccaaattctagctcacatgtgacagtatatgaatcaccttttactgggttccacccaaacctaatgaatcaaaatctcttgggattgggccaggcattttttttttttttttttaagacggagtctcactctgtggcccaggctggagtgcagtgatg

SEQ ID NO: 167004 - DNA, 601 bp, Human
ctggctggagtgtggtggcacaatcatggcccactgcgacctttgcctcccaggctcaagtagtcctcctacctcagcctcccatgtagctggaactattggtgcatgccaccatgcctagctaatttttaaaattttttatagagatgggattttatcatgttgccaaggctggtcttgaactcctggactcaacctatctgcccaccttggcttcccaaagtgctaggattacaggtgtgaaccacaatgtgtggcctacttatagtttttatgccatattatattcccaattattagyggaaacataatttagcaaactccaaactgttagattctatcctaatttttacaaattatatataatgctacattggacatctttgcagtcttttcccttctctagaatcatttccttaagatgccgaaaattgctaggttcaaaattgttttttgaaaggtatcctaatcaacattgctgtcgacaatgtgtgaggatacttgttcacagcaatcagccacactaagtattatatattatctacagccatttttcctttttaggtaataggctttgtttcttatttggaaagagtgagtt

SEQ ID NO: 167005 - DNA, 601 bp, Human
cttatcactttgggaggctggagagtcgcttgagcccaggagttcaagaccagtgtgggcaacatagaaaaacctcatctctactgaaaataaaaaattagctgggtgtggttgtacgcgcctgtggtcccagctactcaggaggctgaggcaggaggatcacttgagcctgaggttgaaagtgcagtgaggcatgatcatgccactacactccagcctgggcgacagtgaaaaaccactcacaatcctgccatctaacaaattaaactattttattttttatattcttctcaggctttgkttatagcacacaaaattgttatgaatttgtagttggagaataaatgtctatcttttaagtatttctgagtggctacctggtccttacttacaattttttttcttttcagacggtctcgctctgttgctcaggatggagtacagtggtgcaattatagttcactgtaacctcgaactcctgccattaagtgatcttctgacctcagcctcaagaggagttaggactacaggtgtacaaaaccatgcctggctaatttttatttatttatttatttatttattttttgagacagttttgctt

SEQ ID NO: 167006 - DNA, 601 bp, Human
ggaatgtgtcaccacgcccaggtaattctattttttgtagagacagggtttcatcatgtggcccaggctggtctcaaacttctgggctcaagcaactctcctgccttggcctcccaaaaagtgctgggattaaaggtgtgagccactgtgcctcgctaaaaaaattctttttacaaagattttaacattaggtacttgcagatattttcctgtggatgtggtaaaaataaataaataaagatttttttttttttttgagacggagtctcactctgttgcccaggctggagtgcagtggcgycatctgagctcactggaagctccgcctcctgggttcacgccattctcccgcctcagcctcccgaatagctgggattacaggtgcctgtcaccacgcccagctaattttgtttttgtatttttagtagagacagggtttcaccgtggtagccaggatggtctcgatctcctgacctcgtgatctgccccgccttggcctctcaaagtgctgggattacaggtgtgagccactgcacccgggcaataaaaatattttaacatttggctgggcacagtggctcacacctgtagtcttatcact

SEQ ID NO: 167007 - DNA, 601 bp, Human
tcagcctcctgggctcaagagattctcccatctcagcctcctggaaagctgggactacaggaatgtgtcaccacgcccaggtaattctattttttgtagagacagggtttcatcatgtggcccaggctggtctcaaacttctgggctcaagcaactctcctgccttggcctcccaaaaagtgctgggattaaaggtgtgagccactgtgcctcgctaaaaaaattctttttacaaagattttaacattaggtacttgcagatattttcctgtggatgtggtaaaaataaataaataaagatttttttttttttttgagacggagtctcactctgttgcccaggctggagtgcagtggcgccatctgagctcactggaagctccgcctcctgggttcacgccattctcccgcctcagcctcccgaatagctgggattacaggtgcctgtcaccacgcccagctaattttgtttttgtatttttagtagagacagggtttcaccgtggtagccaggatggtctcgatctcctgacctcgtgatctgccccgccttggcctctcaaagtgctgggattacaggtgtgagccactgcacccgggc

SEQ ID NO: 167008 - DNA, 601 bp, Human
ttgagacggagtttcactcttgttgcccaggctggagtacaatggcgcgatctcggttcactgcaacctccgactcccaggttcaagcgaatcccctgcctcagcctcccgagtagctgggattacaggtgcgtgccaccatgcctggctacttttttgtatttttaatagagatggggtttctccgtgttggtcaggctggtctcgaactcctgacctcaggtgatccacccacctcggcctcccaaagtgctgggattacaggtgtgagctgctgcacccagcccattttctttttttyttttttttttagtatctcatgtaatttattgaatacagaaagtgaaaaacagaatggttgtatgggtacttgaagaagtatggtttctactgaatgagtactgcttttgtacatcctaaagggaccactcgtgtgtataagattacagacatttactgataagaaatgtttcctgagaagaggtgagacagagtccctgccaggtaaggaaagggccccgagggatagaaatccatctgtattaacaaaattcctaagtcagaaaagctaactgacaagaaactttaaccaaaactgcaa

SEQ ID NO: 167009 - DNA, 601 bp, Human
gcagccaatgaaatgtttacaagtctgcctcgcctactggactgagcattaggaggactgaaccctctgtgtaataccagtccctagcatagtgcctaacacatgggcacctagtaagtcttttgttcaagtgtctgttgaaatgaataggagcctctattctgtccttttataattatctcttgtttttgaatcctgattttgcatctgttcctgaaatacttcatttttgctgagttaggtcctttattccagcctgctaagtcatttggagagtgattaaagcaccagtatattagcwttgtaccatttgcctatcgaatctgggaaccacctgaatcctcatcaaagccattaacaaaatatgcagccctggagagcataaacagagccctggccgggcacaggggctcacgcctgtaatcccagcactctgggaggccgaggcaggcggatcacctgaggtcaggagttcaagaccagcctggccaacatggtgaaaccccgtctctactaaaaaatatgaaaattagccgggtgtggtggtgggcacctgtaatcccggctactcaggaggctgaggcaggagaatcgcttgaac

SEQ ID NO: 167010 - DNA, 601 bp, Human
tggtcttgaactcctgacctcgtgatccacctgcctcagcctcccaaagtgctgggattacaggtgtgagccaccacgcccagctgactgccttttttatatctcaaatctggtctgaaagaatcttctagatattctgaggggacatcccttaggaatgaacacttttaatacaacaaagcgaacatttttgtttctgatactacttcttcatttccttgggaatatttaattttaataaaagctctagggctgctgctgtccaatatggtggctactagccttgtgtgggtatttaaaygtaaactgaaattcagttcttcaactgcacctgccacattgcaagtgctcaacagccacatgtggcttctgtatcaggcagtacagataggacatatccatcaccacagaaagtactgttggataacatggctgcagaccttttttctgaggaatttcatctattcctaattcccacaaaagactttttttttttttttgagacatggtctcgctctgttacccagctggagtacagtggcgcaatcatggctcagtgcagctttgatctcctgggctcaagcgatcctcccacctcagc

SEQ ID NO: 167011 - DNA, 601 bp, Human
tcccccatgctgagttcctggctgtgtttggttgcataatatccacaggcaacaatcgcaacagaaagcctgatgcctggaattagacacctgcactctgacttgcaatatgacctcaggatgttacttcccatctccaggccacgtttcctccggatggaaacagacaaacctgaccccaatctgcctctctgagatgtggtgaaaaatgagtaccttctccacagtgatgattttccccacacggatatccagccgggatgggatgacctcctctggttctgaattcttggcagggcctttggccattggctctgggaatgagaagaaccccatgaggtagaattcttccctgtggcaggtcagctgctgatcccaccacgttaagacactgagattaggtaagatttagtgtagaatccccagagtctaaacactgagttgtaacttctttaatactgggttggcaacctttcagacatgacatacctgattttcatctgttctctccctcaattattagactagcggggagggagcagtagtagctttgcctcctttaggtatttccattcatgcattccacatagaatttactgag

SEQ ID NO: 167012 - DNA, 601 bp, Human; identical to SEQ ID NO: 30038

SEQ ID NO: 167013 - DNA, 601 bp, Human; identical to SEQ ID NO: 30039

SEQ ID NO: 167014 - DNA, 601 bp, Human; identical to SEQ ID NO: 30040

SEQ ID NO: 167015 - DNA, 601 bp, Human; identical to SEQ ID NO: 30041

SEQ ID NO: 167016 - DNA, 601 bp, Human
taatgactgaatacccatgttcctggtagagaccttcaagaactctgtgctcgcgtgttcagggaggcaaaaaggtggcaaaacaaagggtggaggctgccttctcacccagccctccacgtaaggcaggaggttacctgagcagcccaggggagaccccatttccgtggccccagaagccaaggatggaggcaaactggaaggtggggtgatgttgaggcaaggccacggaagggggcagggaaccttgtaagcacccatgggtctaaatgaagggacctactggggtgcagaaggctcsactggacaggtctacaaggaatgagagcacagcagagtgcgctgaagtcggcagctggaggggaccgtggtgtcgagggccatggaagggaagctgtggggactgtggggatggagcttcaggctctgcccgcctcttacctgcttcttggtatccttggtaagtggtggcagactggctttgctggcccgacggcggttgtgggtcgcagctcctgccttctgcagcttgctccggtctgagtggaaaagtcccacccgtttggtgcatcccacgttgtaccttcagggacaggggaac

SEQ ID NO: 167017 - DNA, 601 bp, Human; identical to SEQ ID NO: 30042

SEQ ID NO: 167018 - DNA, 601 bp, Human; identical to SEQ ID NO: 30043

SEQ ID NO: 167019 - DNA, 601 bp, Human; identical to SEQ ID NO: 30044

SEQ ID NO: 167020 - DNA, 601 bp, Human; identical to SEQ ID NO: 30045

SEQ ID NO: 167021 - DNA, 601 bp, Human; identical to SEQ ID NO: 30046

SEQ ID NO: 167022 - DNA, 601 bp, Human; identical to SEQ ID NO: 30047

SEQ ID NO: 167023 - DNA, 601 bp, Human; identical to SEQ ID NO: 30048

SEQ ID NO: 167024 - DNA, 601 bp, Human; identical to SEQ ID NO: 30049

SEQ ID NO: 167025 - DNA, 601 bp, Human; identical to SEQ ID NO: 30050

SEQ ID NO: 167026 - DNA, 601 bp, Human
tattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtacygattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcg

SEQ ID NO: 167027 - DNA, 601 bp, Human
gcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaatttygattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttat

SEQ ID NO: 167028 - DNA, 601 bp, Human
attttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctytctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttg

SEQ ID NO: 167029 - DNA, 601 bp, Human
taagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgartgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcacc

SEQ ID NO: 167030 - DNA, 601 bp, Human
tttctttgtgttacaaacaacccagttatactcttttggttattttgaaatgtataataaattattgttgaatagtcaccctgttgtgctatcaaatacaaggtcttattcattttatctaattatatttttgtacacattaaccatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaaygtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttcta

SEQ ID NO: 167031 - DNA, 601 bp, Human
attctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaayaatactgagtctttcaattcatgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtattta

SEQ ID NO: 167032 - DNA, 601 bp, Human
ttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaataatactgagtctttcaattcatgaacatggaatagctttccaktttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagataatggaatgtgcaaacaagtata

SEQ ID NO: 167033 - DNA, 601 bp, Human
atgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagatmatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataattttt

SEQ ID NO: 167034 - DNA, 601 bp, Human
tttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccrgtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaat

SEQ ID NO: 167035 - DNA, 601 bp, Human
caacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatrttagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttata

SEQ ID NO: 167036 - DNA, 601 bp, Human
tacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcttgtgattacagatacatagatagcagtg

SEQ ID NO: 167037 - DNA, 601 bp, Human
gcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcktgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaa

SEQ ID NO: 167038 - DNA, 601 bp, Human
tatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcakagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttca

SEQ ID NO: 167039 - DNA, 601 bp, Human
gttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaagtgtttatgtgccaagagttgaagaacagcttggcccttccaagaattgaggaagctggtttggtagaagtattgagggacccagtaaggtgtaaggctggagaaayagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctgga

SEQ ID NO: 167040 - DNA, 601 bp, Human
aatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcayagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaac

SEQ ID NO: 167041 - DNA, 601 bp, Human
ccattggtgacttttggcagatgatcttccaaagaaaagtcaaagttattgttatgctgacagaactgaaacatggagaccaggtttgtacttttgaggattttcttttaagcctttctgtcataaaacgtcattctctagtcttggattgcttgcttcatcgccatacccacgtctttttttatccctccatcacataattctgtctgctcagtcttacccctttcaccctggtgttggcctccatcagctgtgtctggattctgacagtctctcctgtttgtcccctccagtcttgcaygctgctcacagattagccaggatgcagcaatgtcagcgtcacagcaaataacagctacattttcacgctgttttcctcattttctcaagataaaagccaagatctttttgtgatatccagcaccctggacaatcaccccctcatgtgtctttcatcttcctcccatttttatgttttccatcctctccactctggacaagcaggtttcatgcccaagcctaaacacgccatttgcattgtcatcactgagtctaaacttattgatattccatgtaactaaatgtgtgctgtcttccagtt

SEQ ID NO: 167042 - DNA, 601 bp, Human
aaaatatataaagctgcttatggtgttggtcaacaagatgacagagacaaagctccaaaagatgcagcctccttcctcaagaaccactgaagggacagtgggacctgagttattgaaagggtcatgaataacattgactcatgccagccataaatattgaagaggtcatgataagcatgtggaaaagaggagcaaacctcaaagacctacactaaggaaaacagctgttccgggggtgtcccagtcacctcgattgtgctcagcttcccttttcttacacaaggaaacaccacatatttaytaaatgggtcgccagcacttaaatagattctggatttttataagtaggtttcaattttagaacacaataattttcatttaatagaaaagaggcacagacagagaaagaaagggagaaagagggagactgatcctttgcatatttcaaataggaaacaaattgttgaattgtcttcttttatctaggaaatctgtgctcagtactggggagaaggaaagcaaacatatggagatattgaagttgacctgaaagacacagacaaatcttcaacttatacccttcgtgtctttgaactgagac

SEQ ID NO: 167043 - DNA, 601 bp, Human
tttacatgaaaaagaatattgaagtaaatgagaaacgaaaaatagtaaagtaaaatgagaaatgtttatctagtgaaaaacttttggaatttttgaaaaagtctaattgttattattggaattgcatatactagaatcaagccttaagaaatatatgaattttcagcatttatgtggaaagaaagctgaggaagggaagtttacactgtaaaactatatatgtttcttagaatatgatttatgtacaataactaaagtgtcctgctgataacatattgtttaaattgaatctttatgatartgctttatacttctcattgtttggtaaactatttgattgccctctttttagtgaataattctactaggtattacttttctactgatgcagaagtgaaaacatttgtgaaacgtggtagagaggcagaagagtgaagaagagcatgtgttctagtaatttacaaaatattaggtctaatatttctgattacatcagctttctcttctccaaatcttggtttccttatctatcatactggcattctgatattggtttcaacaacttcagatgtaaataaaaatgcattaaaatccataaaat

SEQ ID NO: 167044 - DNA, 601 bp, Human
tttgtgctttgttaaatctcttagaaagtgcggaaacagaagaggtagtggatatttttcaagtggtaaaagctctacgcaaagctaggccaggcatggtttccacattcgtaagtatccttcaccattgcttttaacatgctcggaattttttttttctttttgacggtttccttttttcttttctcctctcctttcctctcgtttgttcttttttcccctttccttttctcttctctattttctttcctattcttttagcttttctacttttacatgataattcacattaaattattataagtctaaataagagcctaaagtttactagcactttgttgtgacagttcatgaagagcctttccctaaatgctcatgaatttcttaattttctttccttcactcctgtatcgatttgtgttgtgtaacaaaccacccccaaatttgggagcctaaacaaataacatttattatggttcagtagtctaatgatatgctggaatgttctgctggtgccctcaggctcaggcaatagagaccaggctgactcatgtgtctgccttcagctgatgtgtgccctacagtttggctggtctaaagt

SEQ ID NO: 167045 - DNA, 601 bp, Human
aaaaaaaatgaaaaccagccaggcgtggtggctcacgcctgtaatcccagcactttgggaggctgaggcgggtggatcacctgaggtcaggagatcaagaccagcctgaccaacatggtgaaaccctgtctctactaaaaatacaaaaaattaggtgggtgtggtggcacgtgcttgtagttccagctacttgggaggctaaggcagaagaatctcttgaatccaggaggcggaggctgcagtgagctgagatcatgccatcgcactccagcttgggcaacaagagtgaaactccgtctcaaaaaaaaaaaaaaaagaaaaaagaaaaaaaaaagaaaatcctagtcgttcacagccagaacactatcgtccctggataaattggcaacaggccagggagcttcccaatggcttgtatgtctttcccacaaattcaatttgtgaccaaaaacaggtgtttcagaaaaaagacaattaagcataggctgacggatgtaagcagagggaagaggagcatttggcaaaacagggttggagggttggaaggagcagcggggttgagaggtggaagtcagaacattggatttctgccccgggggtg

SEQ ID NO: 167046 - DNA, 601 bp, Human
ggctccacttctctacctgcttgtccttgctcagcaagcgcaggctgaggtcaatgacatccccctcgaactgttaaggatcacacagggccatgatgaagggtccccacacagggccatgaggaagggtccccaggtcaggcactcatcctgcaggacagcctcatcatctcgtccttctcccagacccgcactccacacctgcctcccttgcctcatccctctgaggagctctggctccctcccccaacctctcaatgggacctgggttccttttcccaggcatccagtcctttgcctrtctgttgtctgactcccggtagggtgtgagctctcggggacccgtgctgtactgtttcgtttcattgcactgcattccatttccatttagtgaaccctgactgtcctaccagccctgaaccgggagtggaggataccgaggcagctcctgttcctgaggagcccacggtttaggactggagatggacacgcagtgcagccccttagattacagagcacagcagcatggccagggctcttgtagagatgccggcacagagcagcacagtggagaggctccccctgccttcggggattgggg

SEQ ID NO: 167047 - DNA, 601 bp, Human
acatcccagccccgtcagggactgttccatccccagcacacgcctcacgctaccttccattacacctctttgctgtcttcttctgtcttcagtggccttcccctacctctgtactgaaagggtacccatttttcaaggcccagcatagatgtcatctctttcataaggtcatccccaaacccaccagctggaattaattccctttgcttcacttattccatagcaactttgtgcatctattaaagcacttatctggaagaccaaatgttgtgtctccctaactaaactataacctgcttgmgggcagggatcagatctcattcattttggccagggtagacacatggaaagagggctggaccaagagccataagcctctagaacttcctgtttttataatcttgggcatgttgctctctagggctcacttttttcatctgaataatgggaacagttctacctcacagggcttagaaagaaataaaggagctgaaaatcctctggcatgtgtatgaggtgctaaataaacataggctattatgatccctgtaggtaggaggcagtaactgggaaggccccaattttagaaacctttacttaa

SEQ ID NO: 167048 - DNA, 601 bp, Human
cctcagtaagtttcctcatctctgccaagctgactcaaacttcacagctgatgtcttctaccgctctacctgctcttcctgcatttattcccacccttggtccttcactgatgatttctgatgtcgcctctcctctatgcagaccccttggagggtttcccactgtcttgggaattcagtttacattgtattcaacgttcttcatggtgtgtccccaaaccccctctcccacctcacctgttcttcccatgactaagtgacatcccagccccgtcagggactgttccatccccagcacacscctcacgctaccttccattacacctctttgctgtcttcttctgtcttcagtggccttcccctacctctgtactgaaagggtacccatttttcaaggcccagcatagatgtcatctctttcataaggtcatccccaaacccaccagctggaattaattccctttgcttcacttattccatagcaactttgtgcatctattaaagcacttatctggaagaccaaatgttgtgtctccctaactaaactataacctgcttgcgggcagggatcagatctcattcattttggccagggtagaca

SEQ ID NO: 167049 - DNA, 601 bp, Human
ggaaaatgtgcccaaagttgaattgttaaattaaaaaaaaaaaaaagctggagaatggtatgtattacataatctcacttacggtatgtattgtagaatcacacacacacagaggcatacatatttgattaagcatagaacacttttgtaaaactacacaagaaaatgttaaaggtgaatggaatctgaaagaatagaactgctgttgaatggaacttagagattgggaggctttactttttactttacacttttctctttctttttttttgaccctttccttcattccataaatactcartgcagtgcattcgttccttttataacgaaaaatactctagttaacttaaaattatatgatgaaggtagatgttattcacgatcaaacttaattgtaacagtttttctgtttaagcaaagatgatttggtttataacttgaaaattctaaataagtaaatgaatagcaagatttcctgccctgattggtggtagttggggcggatgctgagtgcagggaattgaggaggctctgggtggcccgggagcggggtctagaaacccttgagcctgtctctctggcagcactgacagaagagaaa

SEQ ID NO: 167050 - DNA, 601 bp, Human
gcagcctcagacacagcctgataggaggctggtgcaggaggcgtcgttgctgagatgtattttattgagggtttgggccagtgtggcgagaagctgcaggttcatggttgagaccacacagcccccttctctcagccagggccagcagtggcctgagctacacagtgaggcttcccagccaataccctcctgtcctgcagcaccacagggcacttcagcccccaccaaccctaggcccagtgttgggtctcccggggcctgggtgtggcacaagctcaagagagaaggccccatcattaaygcttttctccccactgctcagaaggccctgagagagagagagagagagatacgagacagagacagggaaaacagtcgactggccctcctggatcccatggcagggtctctccacctggctgatgggtgagcattctcagccattcggggacagggaagcgggtagtggttagaggcgttagaacccatccagggctctgggtcctgatgtgacccaggaggcccccttgggataaggctgggggagaaggtagaaagagagggaagatgggaagcggatggtcccctaagtcagaagcca

SEQ ID NO: 167051 - DNA, 601 bp, Human
tggggggaagaggggagggatagcattaggagatatacctaatgtaaatgacaagttaatgggtgcagcacaccaacatggcacatgtatacatatgtaacaaacctgcatgttgtgcacacataccatagaacttaacgtataataataaaaaaaagaaaccattacaaaaaaaaaaaagaaaaactacctgttgggtagtatgcttattacctgggtaataaaataatgcgtacatcaaaccaaacctctgtggtgtgcaatttacctacatagcaaatctgtatgtgtacccctgaayctaaaataaaggttaaaaattatctttttaaagttaagaacaaacaaacaaaaggccatgggcacagacgtccactttgcagggtcctagaactgtctggaaactctgtctgaccctgagggaaaggtgccctcctcagaggcagcctcagacacagcctgataggaggctggtgcaggaggcgtcgttgctgagatgtattttattgagggtttgggccagtgtggcgagaagctgcaggttcatggttgagaccacacagcccccttctctcagccagggccagcagtggcctgagct

SEQ ID NO: 167052 - DNA, 601 bp, Human
ctcctagagcaccagggggtgttcctgccaaaaccacattgcccctgcttccacactcacctgctgacccagcttagcattggcagctactgctgaagtgagggtgccaacctgccatggcacctgtgattcactggggctctaggctgactaattgcatgtgaattatgaaaatttcccacccaaggcaggctggctcctcctggtccttcagacttggtgtgaatgccactccctctgaggccttccccgagcctgagcctgctttagcgccacagccctgggtatgtcccctctccgygtgagactcagttacgtgatgtagtcaagtctgtcttttcctgcctgagtctcggggctgtttcagtccagctctcttcacaactctggaccttaggcctggcatggtgcccagcacattgcaggaactctgtacctctttgtagaatgagtgtaaatgaatacatttattcctgtgtaacactgggcaacatgcagaattaggaggcttctctgatcaatcttccccagaggacagtctgatcagctcacttttctgttttcaaattttcaaaggcctcctacagcctagagaatcaaa

SEQ ID NO: 167053 - DNA, 601 bp, Human
agttcccacactcctagagcaccagggggtgttcctgccaaaaccacattgcccctgcttccacactcacctgctgacccagcttagcattggcagctactgctgaagtgagggtgccaacctgccatggcacctgtgattcactggggctctaggctgactaattgcatgtgaattatgaaaatttcccacccaaggcaggctggctcctcctggtccttcagacttggtgtgaatgccactccctctgaggccttccccgagcctgagcctgctttagcgccacagccctgggtatgtsccctctccgtgtgagactcagttacgtgatgtagtcaagtctgtcttttcctgcctgagtctcggggctgtttcagtccagctctcttcacaactctggaccttaggcctggcatggtgcccagcacattgcaggaactctgtacctctttgtagaatgagtgtaaatgaatacatttattcctgtgtaacactgggcaacatgcagaattaggaggcttctctgatcaatcttccccagaggacagtctgatcagctcacttttctgttttcaaattttcaaaggcctcctacagccta

SEQ ID NO: 167054 - DNA, 601 bp, Human
aagaggaaatttagaaacaacaagaccatttcccaaactggagctacactcaccctttctcaaaacatgcaatttggaattaatagaggtgatgacccacacccagctatttcagagctcggctgagaaaacttgtcacccacattctggcgtcagtctcatccaagatggctttgccagagggtccctctttcacccactgcagggggcaactgtgagtgggcagggctcccgctgcacagcttcctccctccccgggcacgccagggacctcaccatggcacacaccactctgctgacrtagacggggcttccccgcagagcacagtctgtggctgggtcagtctggaagtgcaggctcttgtctagcagcttcaggcagatgtctatgattttgtcttcaaacttcggggggagaggcagagagggaaggcacccatgcttgtcacgtgggagtatgtaaaaagtaatgacttccccccaaccctagtggaatataaactcacttggaaggtaactgtgtcaaacagaacagccatgaattccctcccattcaggtgtggggtttcaaaactctagggtcacaattcacctggtgcat

SEQ ID NO: 167055 - DNA, 601 bp, Human
ctgtggcgttccactgcttcaggatggccacgctgcccgtccactccgcagggttggcgccgtctgtgtaattctcactccagtttccattgagcaccccattatcatcattgctgttgatctgaagagaagccatatagagaagtgttagaaacatccatttcctcaacatgccatgtgtgggctgccttggaagacccatgggcctgagaaacagaggagagacttttgacagcattttactgtggacttccagacctgctggggagggctaaggatgggggttgactcttctgacttytgctccactgtgaattagtttattattatgttcctatctaccccttacccatgtcctcccatcccctgcaaagctggagcttacctctgagagctttaaaaaacacttcagaaaagaggaaatttagaaacaacaagaccatttcccaaactggagctacactcaccctttctcaaaacatgcaatttggaattaatagaggtgatgacccacacccagctatttcagagctcggctgagaaaacttgtcacccacattctggcgtcagtctcatccaagatggctttgccagagggtcc

SEQ ID NO: 167056 - DNA, 601 bp, Human
ttcctaattactcagcctctcatctcatttctgtcttgaacctagacagttcccagccaagctcttaggaatatgctggtaagttgcctaagcttagacgaagcaagggtgtcaggcgtcctgggacgtgtgactgtcacttcggaaccatggtctgacataagcccagacatgtgcagtctgaggtccgtgatgagacactttatttttttatttattttttgagatggagtctcactcttgtcacccagactggagtgcagtggcgtgatcttggctcattgcaacctctgcccccccrggttcaagcaattctcctgcctcagcctcccgagtagctgggattacaggtgcctgccaccgtgccctgctaatttttgtatttttagtagagacggggtttcaccatcttggccaggctggtcttgaactcctgaccttgggatccacccacctcgggctcccaaagtgctgggattacaggtgtgagccaccgtgcccggccgagacatttcagagaggaaaagggcttccttccaaatgtcccttggtgggaactgtgtgggactgggatgggaatggttcagaaggctcatacatg

SEQ ID NO: 167057 - DNA, 601 bp, Human
tccatgtgtgactcatttccaagtatcactcccctcatgatttcctcctcatctcctcctcttgtcacccacaaaccaacttccatttgccatcttttccacatatgtattttttagtttttcctctactaatgtagtatccattccttatctgaaaagctgacctcacattttcttccttcccctaaccctctggccagagtcaggctatcaggccctcaacaactccaaattcaaggtcatttcccttgggttgccatcttgctctggccccatggcccacaccacagccctgactcaygtttcccttccatgtacacatcttcattgagcccattctctgtgctcagaaaggacactaatcagtttgtagtttcctaattactcagcctctcatctcatttctgtcttgaacctagacagttcccagccaagctcttaggaatatgctggtaagttgcctaagcttagacgaagcaagggtgtcaggcgtcctgggacgtgtgactgtcacttcggaaccatggtctgacataagcccagacatgtgcagtctgaggtccgtgatgagacactttatttttttatttattttttgaga

SEQ ID NO: 167058 - DNA, 601 bp, Human
tactatcttatgtcaatggaaatcaatggaaaataagaaaggtttgtgtttagtccagggcactgcacaaaagagtttgaactgggatctaagaaaaggctggggtatgcaccagggccttggctgcagttccttctttgagacttaagggtaaaaacaatgagaacaagagttattgtattgaaatgaagatgagatacgttttaaaggcccctacataattgagttagaaaaatcttagataatatctagctcaggggttttcaaaaaagtattaagcagagggccctatatgcaaacyaatcataagtgaggatttgatgtataaaagacatgcaagttgggttgctttagtttaagagggcccagtcccagtcccaaccaggcagcctcccatcgcccacaccctttcctacctccccttccccttacagcccctgggaccttggaccttattttacagaagagggatgatgctgtacacctgcttacggtcacacattagtacctcccaaccctcagcccaagtcattgctgtcccctaccccacttccaaccccaggcagttatggacaagaatagaccaggcatattcccagga

SEQ ID NO: 167059 - DNA, 601 bp, Human
aaaaagtgggagagaggggaactgaagtttcagggatagctagaaacaacttttttatttatttttattttttgagacagagtcttgctctgtcacccaggctggagtggcctgatttcagctcactgcaagctccacttcccaggttcatgccattttcctgcctcagcctcctgattagctgggactacaggaacccaccaccacgcccagctaattttttgtatttttagtacagatggggtttcaccatgttagtcaagttggtctcgatctcctgacctggtgattcccctgcctyggcctcccaaagtgctgggattacaggcatgagccactgcacctggccgaaacaacttttgaataagacccagccaaagccctggagcccaagaggcagagattaaaacagtaccagactaattataatagctaacatttagataaaacttatgggccagacatctttctatctactctccatgtattagtcaacaaccttacgagggaacattccgtactatcttatgtcaatggaaatcaatggaaaataagaaaggtttgtgtttagtccagggcactgcacaaaagagtttgaact

SEQ ID NO: 167060 - DNA, 601 bp, Human
tcaccctcttcttattctgcactttgacacagagcctctccaggccagggtggggacaggcctctggatgcgaccagaaaagggaggggagaagcccaaagggagccttgagctcgcgtggcaggtttgaacagggctgaagaactagggcaggtggtgggtagagctgacaagtgggttgtaggtggaggtgacacaggacagctgcagaggtgaggctgaagtttgaaaagctgtcactgaaggaccctgagacagcagtgaggcaagagagcagcattgcaggggcgcatttatgctraaagtacagtcaggagggtggatgacactcacagtgacaagaaaacgtgccaaagaagagggcagggagggagagcagggagcaagcctccccctgcccttcacccagatggatgagttcatgagtggccacctgaagtgtcaatagtggtgtcaactcctgctaaacatgactcgatgggcactttcccaccctaacacaggtaactggtcctgaagcactttgaagttctccattaaccagagtatgaggcttgtaatgaattgtttatgagtctgtcttcctgagggcagggattgt

SEQ ID NO: 167061 - DNA, 601 bp, Human
atattctaaggggtaaagtgactgagtcaaaaatatggttatttctaagggttcttcacacacactactgtcatttcttaaaagtttataatttttagtttaaacatttaattgtgtacagattttagctcaccctcttcttattctgcactttgacacagagcctctccaggccagggtggggacaggcctctggatgcgaccagaaaagggaggggagaagcccaaagggagccttgagctcgcgtggcaggtttgaacagggctgaagaactagggcaggtggtgggtagagctgacragtgggttgtaggtggaggtgacacaggacagctgcagaggtgaggctgaagtttgaaaagctgtcactgaaggaccctgagacagcagtgaggcaagagagcagcattgcaggggcgcatttatgctaaaagtacagtcaggagggtggatgacactcacagtgacaagaaaacgtgccaaagaagagggcagggagggagagcagggagcaagcctccccctgcccttcacccagatggatgagttcatgagtggccacctgaagtgtcaatagtggtgtcaactcctgctaaacatg

SEQ ID NO: 167062 - DNA, 601 bp, Human
tgtgataaatacctttgtagatcaatatcccccctcccctgggacatattctaaggggtaaagtgactgagtcaaaaatatggttatttctaagggttcttcacacacactactgtcatttcttaaaagtttataatttttagtttaaacatttaattgtgtacagattttagctcaccctcttcttattctgcactttgacacagagcctctccaggccagggtggggacaggcctctggatgcgaccagaaaagggaggggagaagcccaaagggagccttgagctcgcgtggcaggtytgaacagggctgaagaactagggcaggtggtgggtagagctgacaagtgggttgtaggtggaggtgacacaggacagctgcagaggtgaggctgaagtttgaaaagctgtcactgaaggaccctgagacagcagtgaggcaagagagcagcattgcaggggcgcatttatgctaaaagtacagtcaggagggtggatgacactcacagtgacaagaaaacgtgccaaagaagagggcagggagggagagcagggagcaagcctccccctgcccttcacccagatggatgagttcatgagt

SEQ ID NO: 167063 - DNA, 601 bp, Human
agcggggcctgcctttcttctggagagcctcaccgttgctcatctcctgaggtgtggcgtccagcacctgccagcctccatatgcagggggcagatccttccgggccatccagcactcattccagacatggaagttcctgtgtcaaacagagccaagggagacgttgtactgcttggtctttctagaacaaggcaagggagggatgagcaaatgaactgttggatagaaagacagacttagcacacacagggcttaaaacctctgtggatagccaggcacgatggctcatgccagtaatcytagtactttgggagtctgaggtgagaggattgcttgagctcaggagttcaagattaacctgggcaaaaaaggaagatctcgtctcaaaaaaaaaaaaaaattaactaggcatcatggcacatgcctatagtcccacctacttgggaggctgaggtggaggatcacttgagcctgggagatcaaggcttgaccttgatcataccactgtgctccagcctgggcagcaaagccagaccttgtctcaaaaaagtaattaattagtgacaggtcttcctcttgtggacctctctttgcctccca

SEQ ID NO: 167064 - DNA, 601 bp, Human
ttcagccaccctgccttgcacctgctcagatcctccccagccagatcccagctctggccctcaccctgcctctggccctcatggactggatatttttgcctggctccctggtaattgaacctagtggctggcgcttctcaatgtccaggcattcatctatagctgactaacacagcctcccctgtgaccctgctgccagggctgtcacctcagagtcagcctctggccgtgccgttcccacagggaggagtggtgggagtgaacatctgggctcacttcagcctgtcctccaaagactcastgaaacacagtgaattaaataataccctaaataaaataaatgaatggcagagtgtttactaaattccctgccatcttcagtgggaggctgattttagggggaagcaggggtgaagtattcatattctgtttgggctccacggtccatgtcagcgccttgtggcgggagctcgctggcctgcaggatgtggggtgggggtgtcatgaagaagtgaggctgtgaggccaccccaactggggcctcaaaactgaacagctgaggagacagtggggctgggtcctgcctcgcagatgctctctg

SEQ ID NO: 167065 - DNA, 601 bp, Human
tccaggatttccaggatagcctaaaaaataaaccacctgtatttgaatgcttgcctcaggatccatttctggggcagcccagccaagatgaggccggaggccccagggagtgggtggtgatggcactgctgggctgtgttcaacacttgccccctactgcaaatccccttcccaggtggggaattctggagcctccctgcgtctgtccccgaggcccacgtagacgaaccacagacacccactcaccagcactcccagcaactgctcagccctccccaccgcccttcagccaccctgcctkgcacctgctcagatcctccccagccagatcccagctctggccctcaccctgcctctggccctcatggactggatatttttgcctggctccctggtaattgaacctagtggctggcgcttctcaatgtccaggcattcatctatagctgactaacacagcctcccctgtgaccctgctgccagggctgtcacctcagagtcagcctctggccgtgccgttcccacagggaggagtggtgggagtgaacatctgggctcacttcagcctgtcctccaaagactcagtgaaacacagtgaatt

SEQ ID NO: 167066 - DNA, 601 bp, Human
tcttcttccatacacagataaagaaaaggaggctaatggaagtcatgtcacctgcccaagtcacacaactagtaaggagcagatcccaggtgggaagcaaacctgcccaactctaaaacccgtgcctgtgaccgctcaactctatcctgatctcctcaagggaaagatgaaggcccacaaatgcagagaaataaacctcataaagacagcagggcatggtgtgatgtcctgttccagagccagattattggtcaggcatagactaattcctggaaactaagggaaaggagaagcacagtamataagtaaatacatatgagaggaggtctaggcgtgcagagttcccagggtggccccagcttccctgctctatcctgggggtccctgtgggccgcatgtgcaggaatacttgcccacgcctcataattccagaagctgcttttgttgagtacttactatccccagggaccagctctaccccttcaatgcatttgccacaacttcctgaggcagaggccacttttatccccttgctctggggttcattctaaggccagttccagacaaaagagaatctggagacatttgcttcagtaagagt

SEQ ID NO: 167067 - DNA, 601 bp, Human
cccacaagccatttgcaggactcctgcctacattaatcgtgatgcttggataagataaggtgatgatcttgttcaccaggattttctcaggactgcttttctcttcacccagggcactgatgcggatcagcttgtctgttgacaggtactggctgtactgggaataggagattttgcaggggtaggtctttgctaaagaaagaacacaaggatggggtgagagtagctgagaaaatcagccgtacctgggttggacctgggtctctcttccacagagaagagaaagtcaacaagtaccaartcccagggaagcaggtggcagctttttagatgaggaaatgagctgaaaagagccaaaatggctgcccaaggccattctgctaggaaatgggagagctgaggctccaacgaaggtctcagagactccaaatctcaggctttttctgcaaaaccagctacttttgttgtggtaggaaaggaggaggaagagaaaggagggagagaggagatacaacgaaggaaggaagagagggagggagggaaggagggagggagggaaggaaggaaggaaggaagggggaaggagaagagggaaggaggg

SEQ ID NO: 167068 - DNA, 601 bp, Human
catatgatactgtgatggtggatacatgtcattatacatttgtgaaaacccaacgaactacacaatacaaagagtacactgtaatgtaaatcatggatttttaatgattgatcaatattggttcatcagttgtaacaaatatactacatagatacaatcagggaaactgtgattggggggagggggtatatgggaactctctgaactactaaattttctgtaaacctaaaactcctctacaaataaagagcattaatttaaaaaatacattctagcttttgtatagttatatatatatatwtttttttctaccattcttaaaaccaaactaaaccaaaccaaaatgacaggtgatggctggaaagaagggttccctaagtaccatgaagagagttctataatttgatttttaatgtgaggatcactgaactaaaaataatagttttctttcacattagctctacaaaataaaataaaaatatacaaatattctacattttgcctagagaaaaacagaaagacattaaagaacaagtgaaaaatgatgacatatataaggtattaatagaagtgcttcttaccaccaagaagaactgtgaaa

SEQ ID NO: 167069 - DNA, 601 bp, Human
gctttttctctcactcccttgagacactaactgccatgtaagaaacttttcttgaggatgaaagaccgtgtggaaaggcagcccacccaggtatgtgatgagaccatctcggatcatccagttcccatccagagtccagaaaagccacacaagtgactcaggccagaccagttgttattttaaaccattaaactttttggggatttgttactcagcaatcaatagctgatacagctacatagtttgggtcttaaaaaatgttgtgaactagtaacagtctagcttctcctcccagtcctagaatgtttggggtgtgtagcaattctgctgtttttttcttcatttttcttggtgttttggtactttattaaagtctgaagtgcaatgaaagttttaaaatgaaaaatacattcttgaccagtggttgctggagactcagaggcaggggaagaagaatgaataggtggagcacaggaaatttttagaagagtacagctactccatatgatactgtgatggtggatacatgtcattatacatttgtgaaaacccaacgaactacacaatacaaagagtacactgtaatgtaaatcatggattt

SEQ ID NO: 167070 - DNA, 601 bp, Human
tagagatcagcttacagagcacagacaggacatgcaaaagcaaagagagggaatagctagcccaggccataaactgatgttgaagattgtatacaaagatagctatgatgtattccttccatctctctacatgtgcccccatgcaatgtgactctgctactccttccaggaagaggtggagtctctttccctgcccttgattctggactgcactgtgacttggtctaactaataggatgtggtggaagtaaggttttgcaatatctgagcctaggcctcaagagaccttgaagctttttcyctcactcccttgagacactaactgccatgtaagaaacttttcttgaggatgaaagaccgtgtggaaaggcagcccacccaggtatgtgatgagaccatctcggatcatccagttcccatccagagtccagaaaagccacacaagtgactcaggccagaccagttgttattttaaaccattaaactttttggggatttgttactcagcaatcaatagctgatacagctacatagtttgggtcttaaaaaatgttgtgaactagtaacagtctagcttctcctcccagtcctagaatgtttg

SEQ ID NO: 167071 - DNA, 601 bp, Human
tgcataatactgcataaaatgcattatttgcataataaagcattgaaattaagtcactgtagtttccaaaggttgcctctgaccctcagcaaagtagttacaggcagaaaaaaattactggctctctaagaatagaacataaacttccaaggctggttgaaggaagatgtaagggttgagctaagaaaaaggcatgcatgtagatgatttagataaagaactagaagggggagtatagagagtaaaggagtagcagagtatttcaggaaggaacaagagatcagcattgtcaaaccaggtagagaggtctaggtaggtggaccagggaataacttcagcaaggctgaagtctggttatagttaggagggctctgggagatatgcaactagagatagcaaatatatgcaactctcttgaaagagctgaatgcaaaagaaaagaagaaaagtggaaagtaactagaggggaaccttaagcatggttataagtgatggtaagagcccaagaaagaaaaaaatgaagatgcatgtgtgagaggaatgaatctagatgtaccagtccagaggcggcaagaagaaagggtcatggggacagggagat

SEQ ID NO: 167072 - DNA, 601 bp, Human
ctgttgagttcaaacataaccatggtcaaattattcagatgttagaaattcagcaagcttcttggtacctaagattaagaaatcaagcatcagcagaaattggctatttttttgaaaagtgaataaagtgattcaaatctgccacaactttctgcataatcatcttaggttatttttgtacattggtattaaaaaaagaaaaactgaacatttcaatcacttgttctatctattcattagaaacaccagtgttaattatttaaagtaagaatgactctttttaagtgaacaatatagtttyggtaccataaagcccaaggctcacttagaggagaagcaccagctcaggcttttatctgtacagtattccagtgtttcatcagctctaagaaattaggggcttccccatccaatattcgttgagaatcagttctgagctctagactaaatgttgacaatagagaagctaacagaataatgaagggagacagataagtcagttggtaataacttcacaatgtattaaatgctcctacagaagtgatactgggagtaactcgaccctggagaagaggcaccaaatataggaggagtcagcaaa

SEQ ID NO: 167073 - DNA, 601 bp, Human
aagaaaacaatataaactacatagggacattgcagaggttaaatgtcattttggtgataacaacagataacatttattgagcctataccgtgtaccattatactaagttatttatccattattcaaataaaccattaagaagtggtattcatcaagcttatttgcaattgatctatcaaaattccaattttgagagcttttactgcttgcattatctttttttcttatctttgtctttctgaattatcttttatacttttctttttcctatatctaaacccgcagttctaaatcctacctmcaccccagatttttttctgagataactgaaaaattcttacttttctctcagagtttctcaaacttccattctatcagcaatttttttcctattgagatttaagccccaagtaacagttactgaaaccttatatctacttattttaaattttcagttaaatgtaattatagagatcttaactaattattaatagataaaatgttttactgaggtcataagcagaatcttaacaagatacgtaaatatataaaatatatagttgtgttttctttgcctaaaataagagtagaatagttttaa

SEQ ID NO: 167074 - DNA, 601 bp, Human
tgagtgaccttattttagcctatggtgaattaagccattgattaaattaatgtccgtggcttgcatggaaacgaccaagtatttcctgtagttggtgctcattaacattagacctgctcacacacaactttgatatgacctacatgaagacgaatgcaaaaaagtaggtcagatccaaagcatttcaggttaaggtgaaaaccttgcaatatgtggatagattctgaattcatcacaaatgatttacttttctcactcaaagccagtgttgttaatgacagtgaaccatttcctttaaaastattaggtttgtcctcatttatgtagaatacttattttgataagtatttgagcttagaaaaattctcagtagttcccatttccttccaacttgcaagtggatgcaatgataatggcaaaatttatctgcatttttataactgctcaattcctgatagtgaatatttgagccctttaaaacacgtattttaccatagttctgggatgtatccaaacggtatttaatcaatgctgaaagaacaaggacaccctttgttgacatacagggtcactggagatagagttactaaatgtaacactc

SEQ ID NO: 167075 - DNA, 601 bp, Human
acttcccagagcaagattgtgtacatagtcggtactcagttaacgatgttgtgctgatctcagtgaccaaaagcaaagtcccttttttaaatatttgacgcagggctacccctgattctaggaaaggggaagaatcccctctgcttttttttctcttctctggacacacaatatgcaacctgttacattaattacagcttgagttaattcgtggagaatcaaatcaccatgttaaacagctatgaaataagttccaaatattagtaagcaacccatttgaaaactgggcactacctatatraaaaaacattcatctactttctgtttagttacagaatacagtgataatattcatagaaaaaaatagtatgaaaggcataatcctacagccaaaataaaactaatcttaatgtccacacacaaatttctttgggcaaattttaaccccaggatgatttctcctaggtagctttccttgggcctgtctcaaatgtgtgttttggtaacacagactgattttactacctctttaaaacacaaatatgttggaaacgaaaaattgtgggctgcattttaacaccaaatagaactcacattagga

SEQ ID NO: 167076 - DNA, 601 bp, Human
agactcttagaaggtcttgttatatcttttcttaagaaacccccccaagctccaagcagctccccatgtagaagcaaatcggatcatatcaccattcctattcctacagtcattcaatatatactgttgaatcatacctcatgccaggcaacaaactagctgctggggacacatgactatgagtgaaccaaacaaaagcccctgccctgtgtgcattaattcgagggtgtagcagggaggggaaagaggacaaacaataaacaagacaaaaaggcataatatatagagtgatggctggtcrtaagcactaaggagagaaagacggtggggaaggagagcccatctatgtaggaaaggacagtctcttcaacacggtggccaggcaagtcctccctgagaaggtaaaacatgacatttgagccaggacttcagagaggtgacagagtaaaccacattcatatatctgggaaaagagcaatccaggacaaaggaatagcaagtgcaaaggccaggagtcagatttgtgcctgtcacgttgcaaggaatccatattattagagccaggtgagtgaaagcagaaagcaataggaaaggacatcag

SEQ ID NO: 167077 - DNA, 601 bp, Human
agcgattctcctgcctcagcctccccagtagctgggattacaggagtgcactactgcacccagctaatttttgtatttttagtagagacagggcttcaccaggttggcctggctggtctcgaactcctgacctcagtagtccacccgccttggcctcccaaagtgctagaattacaggcatgaggcaccgcacccgtacgcagcaattttttatacagagtaaaaaaaaaaaaaaaacactgaatcataccttactggtacaactctcgcacctgcagactccaagtactttacataggaygcagcaatatagtatcttccatagtttttcatgactttattacggcatttttgcattaatattcctaataacaaaaaaaagtttagtttcaagcaaattccttttcttcttgctcagaaactgaaatatatcacagcaaaaatatcatattttattatttcaatccacagaattaaataggaagtctctcctccaagtccacccatagcctatgggaaagcagcaggggaggctgatcttactttcaagtagatctatctctcacctcattagggaggccaaataagcccccaaagaagg

SEQ ID NO: 167078 - DNA, 601 bp, Human
tctgttgcccaaactggagtgcagtggtgcgatctcaactcactgcaacctccacctccctggttcaagcgattctcctgcctcagcctccccagtagctgggattacaggagtgcactactgcacccagctaatttttgtatttttagtagagacagggcttcaccaggttggcctggctggtctcgaactcctgacctcagtagtccacccgccttggcctcccaaagtgctagaattacaggcatgaggcaccgcacccgtacgcagcaattttttatacagagtaaaaaaaaaaaamaaacactgaatcataccttactggtacaactctcgcacctgcagactccaagtactttacataggacgcagcaatatagtatcttccatagtttttcatgactttattacggcatttttgcattaatattcctaataacaaaaaaaagtttagtttcaagcaaattccttttcttcttgctcagaaactgaaatatatcacagcaaaaatatcatattttattatttcaatccacagaattaaataggaagtctctcctccaagtccacccatagcctatgggaaagcagcaggggaggc

SEQ ID NO: 167079 - DNA, 601 bp, Human
aagagagaaagcacgaattttagagatattaggcagtaattattattttgagatggagtctcgatctgttgcccaaactggagtgcagtggtgcgatctcaactcactgcaacctccacctccctggttcaagcgattctcctgcctcagcctccccagtagctgggattacaggagtgcactactgcacccagctaatttttgtatttttagtagagacagggcttcaccaggttggcctggctggtctcgaactcctgacctcagtagtccacccgccttggcctcccaaagtgctagrattacaggcatgaggcaccgcacccgtacgcagcaattttttatacagagtaaaaaaaaaaaaaaaacactgaatcataccttactggtacaactctcgcacctgcagactccaagtactttacataggacgcagcaatatagtatcttccatagtttttcatgactttattacggcatttttgcattaatattcctaataacaaaaaaaagtttagtttcaagcaaattccttttcttcttgctcagaaactgaaatatatcacagcaaaaatatcatattttattatttcaatccaca

SEQ ID NO: 167080 - DNA, 601 bp, Human
aagcaacatgtttgtgtcaaaaatcaggtgcaatgttactgcatttaaacaatgtaatcataagagagaaagcacgaattttagagatattaggcagtaattattattttgagatggagtctcgatctgttgcccaaactggagtgcagtggtgcgatctcaactcactgcaacctccacctccctggttcaagcgattctcctgcctcagcctccccagtagctgggattacaggagtgcactactgcacccagctaatttttgtatttttagtagagacagggcttcaccaggttggcstggctggtctcgaactcctgacctcagtagtccacccgccttggcctcccaaagtgctagaattacaggcatgaggcaccgcacccgtacgcagcaattttttatacagagtaaaaaaaaaaaaaaaacactgaatcataccttactggtacaactctcgcacctgcagactccaagtactttacataggacgcagcaatatagtatcttccatagtttttcatgactttattacggcatttttgcattaatattcctaataacaaaaaaaagtttagtttcaagcaaattccttttctt

SEQ ID NO: 167081 - DNA, 601 bp, Human
atagcctttggggtaaaaatggtttttggttacatgcatgaactgtatagtgatgaagtctgagatttcaatgaaccagccacccgagcaatgtacactgtacccaatatgtaattttttatccctcaccccgcccccccaaccactttagattattttactccattaccttcatagtgtctgtgagaaccaccttttctgggataaaggaaactatcatttcattcttgatgttaatgcatatgacatatggtacctctaatgacgttacaggtaacacacagcttcccacattaaacarttcaatgagagactctaagcaacatgtttgtgtcaaaaatcaggtgcaatgttactgcatttaaacaatgtaatcataagagagaaagcacgaattttagagatattaggcagtaattattattttgagatggagtctcgatctgttgcccaaactggagtgcagtggtgcgatctcaactcactgcaacctccacctccctggttcaagcgattctcctgcctcagcctccccagtagctgggattacaggagtgcactactgcacccagctaatttttgtatttttagtagagacagg

SEQ ID NO: 167082 - DNA, 601 bp, Human
tgtaaaagatcatacaagaagacaattcttataaatctaaacctaaagccattttgtggtacaattctctaaattgtaatatttgcattttattagtagtattatatttgaacagtatttttgttataatttttgatgaggaattgtttgcaaaaacaggctgtacagaataaatagtgttttatgtgtgaaatcactcaaaatggattagatgaggtgctcaaagattctaaaatacattaattttagctgacaagacattacaaatccttataagattctggttgttagctccttccaratgaaaaatatgggaagaattcagttctaaatgaaaatgagatgaatcattttattcttataggaacattttatcacaaaaataatgcagtgcctttaaaactgcaatacctataatccacactgaagcaaccctaatgcactggtaatttacaaacttttaaagtagagtgtgaaggtattttaaaagtcatcttctaaaaacctccttcattccctaactgttctcttatcctaatattatagaacaaagctggttaaattgtagattcattaaaatttttttcttatttcaatagcc

SEQ ID NO: 167083 - DNA, 601 bp, Human
tttatttctgtagcattagttgtaatgtctcctctttcagttatgattttacttcatttattttttataattttaacttttattttagattcagagggtacatgtgcagatttgctacatgggtatattgtgtgatgctgaggtttggggtacaaatgatcctgtcacccaggtagtgagcacagtatccaataggtagtttttcagcccttattgccctcctcctctagtagccgccagcatctattgctgccatctttgggtccatgtgtacccaatgtttagctcccacttataagtragaatatgtggtatttggttttctgtttctgcattaattcacttgggcctccagctgcattcacattgcagcaaaggatatgatttcattcttttttatggctgctctgccttttgtctctccttatatatatatatatatgtctctccttatatatatatataatatatataaaaatatatatatatttttatatatatctcccatccacacggtcagcactaacatcccagaagaacagcttgcattaaaaagtttccctgatgaaaactttgaaacactgttctgaagactctctgg

SEQ ID NO: 167084 - DNA, 601 bp, Human
ctgtgcccttttattagtcatcatgtactggtgatttttttaaacaacacttacctatcattcccacaccaccagtgtaagccaagccctcaacacttcacacctagactactgcaactacctctaaactggtctacctgcctttaggcattttgttttatttttttaaagactttattttttagagtaatttcaggttcacagcaaaattaagagaaggttaagtatttcctttataacccctgccccaaaacatgtatagcttcctccattaacatcttgggtggtacactgtaacagytgataaaaatacactgacacatcataattgcccaagacctagtttacactggggttcattcttggaattgtactgtcttcaattttttggatgagtttgagaaggactggtatcaattctgctttagatgtttggtagaattcaccagtgaagccagctggtcttgggcttttctgtgttgagaggctcttgattaccatttcaatctctccaccagtgacaggtttgttacctatttctttatgattcagtcttggtagactgtgtgtttctaacaatttattcatttcttctaggtta

SEQ ID NO: 167085 - DNA, 601 bp, Human
ttgggcatttatgacaacctgagagcaccaagcgcctgagacagaaggggcagaaagaaggcagaaggaaaccaaagacaaatttctgcatctatttcagaatgcttcccaggtctcccatctcttccttttcacttctaaaccacagaagttgactcccagcatccaaaattcagaaatgaacctaacatcatcatgatccagtcttattttgcatcaggtaatccttcgcaggctagtctatgaactcaccccatatgtattacactgtttctacaagatcacatgattccaatatacyttaagtgaactctgagaacccaatttggaaataaacctgtatgctgacagtcgtgttctcagcatctctcataaataccaatattctgcaaagtcatccactttcaaaactcccatgatttcaaaacttccatcatccttatatatttcttcctccctgtgcccttttattagtcatcatgtactggtgatttttttaaacaacacttacctatcattcccacaccaccagtgtaagccaagccctcaacacttcacacctagactactgcaactacctctaaactggtctacctgcctt

SEQ ID NO: 167086 - DNA, 601 bp, Human
gcagcagtccatgggctcctgtatgctacctctgaggaagcaggacattctcttttccactagtcccacattgggcatttatgacaacctgagagcaccaagcgcctgagacagaaggggcagaaagaaggcagaaggaaaccaaagacaaatttctgcatctatttcagaatgcttcccaggtctcccatctcttccttttcacttctaaaccacagaagttgactcccagcatccaaaattcagaaatgaacctaacatcatcatgatccagtcttattttgcatcaggtaatccttcrcaggctagtctatgaactcaccccatatgtattacactgtttctacaagatcacatgattccaatataccttaagtgaactctgagaacccaatttggaaataaacctgtatgctgacagtcgtgttctcagcatctctcataaataccaatattctgcaaagtcatccactttcaaaactcccatgatttcaaaacttccatcatccttatatatttcttcctccctgtgcccttttattagtcatcatgtactggtgatttttttaaacaacacttacctatcattcccacaccacca

SEQ ID NO: 167087 - DNA, 601 bp, Human
aatgacacacagctttagcagcatgaaaaggatggtaaggcattgttgccaatggggagtgtttgccccatttaaaactcaatctagataactgtcttcaaaagaaacaaaaattcagactcttataaagtttgatttgtggtctttggggtttttttgagaaaggtctggctctgtcacccaggctggagtgcagtagcgccatctcagctcactgtaacctccacctcctgggctcaagtgatcctcccacctcagcctcctgagtagctgggcccataggtgcacgccaccactcccrgctcattttttaaaaattttttatagataggggtttttccatgttgcccaagctggtctcaaactcatgaacttaagcgatcttcccacctcagcctcccaaagtgctgggataatagacgtgagccaccgcgcccagcctgattcatgttttaaaacgctgtgtgaacaaaacacgtttttaaaccaaaagcagcagtccatgggctcctgtatgctacctctgaggaagcaggacattctcttttccactagtcccacattgggcatttatgacaacctgagagcaccaagcgcctga

SEQ ID NO: 167088 - DNA, 601 bp, Human
cccagattgtggcaacaaaaaggaaccagccagtcaggacccagaattctccccatggatatttaaaccaaaatgggcaaccatcgccatcagggaccaaaatggatttagatcacacagctgcactccaaggattcctgccagctagcggtgcaagctagtttcagtcatttcattaattctaaataaatggctcccacactgtccatgactatagttttggtccccatttatctctattaagagacctaattgtcacaggggaaggagtgtgccatgtcacaactctggtgcctagggrccctggcagagaatacagctgttagttgcatgttgtcagacattttttgaaacaaaagtccctttcaacaaggtatgaggaacagtttactctctccttaactgtaacgaaatggcttaagcctggtgatgatggcaaatgacacacagctttagcagcatgaaaaggatggtaaggcattgttgccaatggggagtgtttgccccatttaaaactcaatctagataactgtcttcaaaagaaacaaaaattcagactcttataaagtttgatttgtggtctttggggtttttttgagaa

SEQ ID NO: 167089 - DNA, 601 bp, Human
ttgggaagtgatagggaggtgaaatatcaatatacatgtacccagtattctgccagtctaatctccccagattgtggcaacaaaaaggaaccagccagtcaggacccagaattctccccatggatatttaaaccaaaatgggcaaccatcgccatcagggaccaaaatggatttagatcacacagctgcactccaaggattcctgccagctagcggtgcaagctagtttcagtcatttcattaattctaaataaatggctcccacactgtccatgactatagttttggtccccatttatcwctattaagagacctaattgtcacaggggaaggagtgtgccatgtcacaactctggtgcctaggggccctggcagagaatacagctgttagttgcatgttgtcagacattttttgaaacaaaagtccctttcaacaaggtatgaggaacagtttactctctccttaactgtaacgaaatggcttaagcctggtgatgatggcaaatgacacacagctttagcagcatgaaaaggatggtaaggcattgttgccaatggggagtgtttgccccatttaaaactcaatctagataactgtctt

SEQ ID NO: 167090 - DNA, 601 bp, Human
agtctttctctgtaagatccagcctgaaaacaataaaagttattgttacatttgtgaaacttagaagtaaacctctaaatgaagtctccacatttacttttaaaaagccaaataaaaacaaatttttaattactagacaatattacctctctacttttctagaggcatttttgcaaaccacttgaaagccacatcattctatccttgttttgctaatcagacaagtaaatatgtttttctgtgatctaatgcaatttaatattgtgaagtatgtgttagtatgcaaaaacagtaaagaccrtgagatttggccaccagtaatttctctactaaccaagaactacaaaaagaaatgtaagaatattcagtagttttatgtaaagactcctttaaataactttatttatcatgcctatttaactacaggaagctctggcagattaaaaaatgcataaataaatgccaagtcgctgcctgatcccaccccaacaaactagttgcaacagtctagggactactctgcatttcaaagtcaggatggttcacatctagtctgaactgaggaccacagagagatgactgtagaacagcctaactgccc

SEQ ID NO: 167091 - DNA, 601 bp, Human
tttcatagtctttctctgtaagatccagcctgaaaacaataaaagttattgttacatttgtgaaacttagaagtaaacctctaaatgaagtctccacatttacttttaaaaagccaaataaaaacaaatttttaattactagacaatattacctctctacttttctagaggcatttttgcaaaccacttgaaagccacatcattctatccttgttttgctaatcagacaagtaaatatgtttttctgtgatctaatgcaatttaatattgtgaagtatgtgttagtatgcaaaaacagtamagaccgtgagatttggccaccagtaatttctctactaaccaagaactacaaaaagaaatgtaagaatattcagtagttttatgtaaagactcctttaaataactttatttatcatgcctatttaactacaggaagctctggcagattaaaaaatgcataaataaatgccaagtcgctgcctgatcccaccccaacaaactagttgcaacagtctagggactactctgcatttcaaagtcaggatggttcacatctagtctgaactgaggaccacagagagatgactgtagaacagcctaa

SEQ ID NO: 167092 - DNA, 601 bp, Human
gtatttcatagtctttctctgtaagatccagcctgaaaacaataaaagttattgttacatttgtgaaacttagaagtaaacctctaaatgaagtctccacatttacttttaaaaagccaaataaaaacaaatttttaattactagacaatattacctctctacttttctagaggcatttttgcaaaccacttgaaagccacatcattctatccttgttttgctaatcagacaagtaaatatgtttttctgtgatctaatgcaatttaatattgtgaagtatgtgttagtatgcaaaaacaktaaagaccgtgagatttggccaccagtaatttctctactaaccaagaactacaaaaagaaatgtaagaatattcagtagttttatgtaaagactcctttaaataactttatttatcatgcctatttaactacaggaagctctggcagattaaaaaatgcataaataaatgccaagtcgctgcctgatcccaccccaacaaactagttgcaacagtctagggactactctgcatttcaaagtcaggatggttcacatctagtctgaactgaggaccacagagagatgactgtagaacagcc

SEQ ID NO: 167093 - DNA, 601 bp, Human
agtatttcatagtctttctctgtaagatccagcctgaaaacaataaaagttattgttacatttgtgaaacttagaagtaaacctctaaatgaagtctccacatttacttttaaaaagccaaataaaaacaaatttttaattactagacaatattacctctctacttttctagaggcatttttgcaaaccacttgaaagccacatcattctatccttgttttgctaatcagacaagtaaatatgtttttctgtgatctaatgcaatttaatattgtgaagtatgtgttagtatgcaaaaacwgtaaagaccgtgagatttggccaccagtaatttctctactaaccaagaactacaaaaagaaatgtaagaatattcagtagttttatgtaaagactcctttaaataactttatttatcatgcctatttaactacaggaagctctggcagattaaaaaatgcataaataaatgccaagtcgctgcctgatcccaccccaacaaactagttgcaacagtctagggactactctgcatttcaaagtcaggatggttcacatctagtctgaactgaggaccacagagagatgactgtagaacagc

SEQ ID NO: 167094 - DNA, 601 bp, Human
aaaccaatgctgccaacttacccattaatagatttgaaaagtatttcatagtctttctctgtaagatccagcctgaaaacaataaaagttattgttacatttgtgaaacttagaagtaaacctctaaatgaagtctccacatttacttttaaaaagccaaataaaaacaaatttttaattactagacaatattacctctctacttttctagaggcatttttgcaaaccacttgaaagccacatcattctatccttgttttgctaatcagacaagtaaatatgtttttctgtgatctaatgyaatttaatattgtgaagtatgtgttagtatgcaaaaacagtaaagaccgtgagatttggccaccagtaatttctctactaaccaagaactacaaaaagaaatgtaagaatattcagtagttttatgtaaagactcctttaaataactttatttatcatgcctatttaactacaggaagctctggcagattaaaaaatgcataaataaatgccaagtcgctgcctgatcccaccccaacaaactagttgcaacagtctagggactactctgcatttcaaagtcaggatggttcacatctag

SEQ ID NO: 167095 - DNA, 601 bp, Human
cgccattcaaggtagcttcaaaacatttaagacaagcattaaaagaacaaagattaagtcacacatttaaaaaaattatgtgtgtctactatgtaacaattatacatttcctaacctgcctcttcctcttttgaaggacttttgcatctcccaagaaaataaatcctataaaagaactcagaacactaatactataccactctaagacagttacatagaaacatgtataatatttatatgatttcttttacaaaagcagacatatgtagaccactcatataccgtatgaaaccaatgctgycaacttacccattaatagatttgaaaagtatttcatagtctttctctgtaagatccagcctgaaaacaataaaagttattgttacatttgtgaaacttagaagtaaacctctaaatgaagtctccacatttacttttaaaaagccaaataaaaacaaatttttaattactagacaatattacctctctacttttctagaggcatttttgcaaaccacttgaaagccacatcattctatccttgttttgctaatcagacaagtaaatatgtttttctgtgatctaatgcaatttaatattg

SEQ ID NO: 167096 - DNA, 601 bp, Human
taataaagtatgagcacacttgtttcctcacaggccccatagagtataagcaaattttctgatctctgccaacatggtaattaaatgtttttgattgctgtaattagccttctttcctaaaattaagagtaatggtgaatattttttcccaatttacctgaaaaaaaaaatcaacatcctcagactttggacttataaaccccatatgcaagcagtatgccacgccattcaaggtagcttcaaaacatttaagacaagcattaaaagaacaaagattaagtcacacatttaaaaaaattatgtgtgtctactatgtaacaattatacatttcctaacctgcctcttcctcttttgaaggacttttgcatctcccaagaaaataaatcctataaaagaactcagaacactaatactataccactctaagacagttacatagaaacatgtataatatttatatgatttcttttacaaaagcagacatatgtagaccactcatataccgtatgaaaccaatgctgccaacttacccattaatagatttgaaaagtatttcatagtctttctctgtaagatccagcctgaaaacaataaaagtta

SEQ ID NO: 167097 - DNA, 601 bp, Human
atagatttgagtctaagtcttcatgcaaggtgggaatatatttataaaataaaattcctcctcaagttcccaggtcaaagggtatacgtgtttctaatttcaataggtattgcaatattaccccaaaaaagactacctgatttacattccctctaataaagtatgagcacacttgtttcctcacaggccccatagagtataagcaaattttctgatctctgccaacatggtaattaaatgtttttgattgctgtaattagccttctttcctaaaattaagagtaatggtgaatattttttyccaatttacctgaaaaaaaaaatcaacatcctcagactttggacttataaaccccatatgcaagcagtatgccacgccattcaaggtagcttcaaaacatttaagacaagcattaaaagaacaaagattaagtcacacatttaaaaaaattatgtgtgtctactatgtaacaattatacatttcctaacctgcctcttcctcttttgaaggacttttgcatctcccaagaaaataaatcctataaaagaactcagaacactaatactataccactctaagacagttacatagaaacatgt

SEQ ID NO: 167098 - DNA, 601 bp, Human
tacttccaccctattcccaatcagaaacaactgccattaaaatctgctgtgttgatttggtagaaatatgcatatctcttcacccccacctttaacaaaaagcaaacggggtgtatgctatacacaccatcacgtgccttgcctttttcacataacactatcacattgttcataggacaatggtgatctaagtcagcatctacagatagccgcattttttaattcctgcatagtattctattgaatgtacatagtctgttttatttaaccaattctcacctgatggattacggggtgactrtcagacaatactactaatacaatgcatagatttgagtctaagtcttcatgcaaggtgggaatatatttataaaataaaattcctcctcaagttcccaggtcaaagggtatacgtgtttctaatttcaataggtattgcaatattaccccaaaaaagactacctgatttacattccctctaataaagtatgagcacacttgtttcctcacaggccccatagagtataagcaaattttctgatctctgccaacatggtaattaaatgtttttgattgctgtaattagccttctttcctaaaa

SEQ ID NO: 167099 - DNA, 601 bp, Human
tatttaatgaaatagagtgtgggaaaattaaaagtaaataagtaggggaggggcaagagtacacagagctagacatcaaagacagacaaaattccaggtatagccaggtttaaatgaaggtgatctgtgatgccaaatcaattgcaggtccataattatgggtaggttttagctcacaaataatttaactataaagaacaagctggtcataaaaatatatttaagctagaattaaatttctacaagaatttaattcttatcaccccgagtctcttcagaaatacgcacagtattagaacayttttttcaagaaacataattacgattctagaaaaagcctaggaaaagaaggcagtcaaaaatatttgatattattttacacacttataaaggtgaaatatagaaaaatattttaccatgtttttatatcaacttttaaaattaaactttaaatttaaaatttatagcaaggtcttgaaagaaccaaggatattcaaaagaggtaagaaaaatggtattaatcatattaaaattttgaaaatatttaaatacgagcttgagatatgtgaaatatcacttgtgtgattgttgttattcaaga

SEQ ID NO: 167100 - DNA, 601 bp, Human
aaaacttcttcaaaaaatttatttaatgaaatagagtgtgggaaaattaaaagtaaataagtaggggaggggcaagagtacacagagctagacatcaaagacagacaaaattccaggtatagccaggtttaaatgaaggtgatctgtgatgccaaatcaattgcaggtccataattatgggtaggttttagctcacaaataatttaactataaagaacaagctggtcataaaaatatatttaagctagaattaaatttctacaagaatttaattcttatcaccccgagtctcttcagaaayacgcacagtattagaacatttttttcaagaaacataattacgattctagaaaaagcctaggaaaagaaggcagtcaaaaatatttgatattattttacacacttataaaggtgaaatatagaaaaatattttaccatgtttttatatcaacttttaaaattaaactttaaatttaaaatttatagcaaggtcttgaaagaaccaaggatattcaaaagaggtaagaaaaatggtattaatcatattaaaattttgaaaatatttaaatacgagcttgagatatgtgaaatatcacttgtg

SEQ ID NO: 167101 - DNA, 601 bp, Human
aagggtctctggaagcccaggattagatgaagcacatggaaaataggcgggagcagccaagaacaggcacctcaaaattaaaggtatgatgaggctaagggtaattttgaagggagcattaccatctgcttaaaaaatgaaccactcgcacaaaaacttacagaaacccatctggaataataagcaataactgatatttacctgtatggacaagttataaaatattttggccactttagcataatctgagcgtctgaggtcaacacttcctccagggaaaaggattctgaaacaacgttayataaatcaaatagggtgtattttgccacccccgacccatacacacacagaaaacaatctttttattttaaaacaatttttcttattacatatgcaataagatccttgaagaaaattagaaaagtaaagaaaaaagaaaatataaaatatttacaatcccattcagaaactacagcagttaacaacactttagtgcatattttccaaaaacttcttcaaaaaatttatttaatgaaatagagtgtgggaaaattaaaagtaaataagtaggggaggggcaagagtacacagagctagacat

SEQ ID NO: 167102 - DNA, 601 bp, Human
aggctggagtgcagtggcacaatctcgactcattgcaactccaagtagctgggactacaggcacatgccaccatgcccagctttttttttttttctttttttgtattttcagtagagatggggtttcaccatgttggccaggctggtcttgaacttctgacctcaggtgatccgccccggcctcccaaagtgctgggattacaggcatgagccaccacacctggcctcaattataatttctaatagctgaatttggttattttcaaatctgattgtttcatgcctatattttcaagcattyttctttctttaaaacttaaaatatattatactttatctcataatactaatatctaacatttgtgcaggtctgcttccacatctgttatctctgcaagttctcattcacagtgcttgcttgtgcattagtagtattttggctgtgaagcactcattttccttcaaacttcatatgttgaaattccttgaagcctgggatgaatgtctggtcctctcaaaaaaactatttacatttgcttcagcctcacacatgagagcattaccagtctaaggcaaccttgaacaaaattacttacttaag

SEQ ID NO: 167103 - DNA, 601 bp, Human
ccagattccaacctttcttctgacacatttggcatttacatttacatgtctgggtatgttggattctgaatgtttccttcacatctatcttctattctagttcattaatttctcctcaactgtgtctaaccttctgattaacatgtctactgagggttttatttcaattataatttcttcttttttttttgaaacagagtaagtcttactctgtcgtccaggctggagtgcagtggcacaatctcgactcattgcaactccaagtagctgggactacaggcacatgccaccatgcccagctttttttttttttctttttttgtattttcagtagagatggggtttcaccatgttggccaggctggtcttgaacttctgacctcaggtgatccgccccggcctcccaaagtgctgggattacaggcatgagccaccacacctggcctcaattataatttctaatagctgaatttggttattttcaaatctgattgtttcatgcctatattttcaagcatttttctttctttaaaacttaaaatatattatactttatctcataatactaatatctaacatttgtgcaggtctgcttccacat

SEQ ID NO: 167104 - DNA, 601 bp, Human
ccattccttctagagttctggttaggtaagttagaaatcactttaccctccagattccaacctttcttctgacacatttggcatttacatttacatgtctgggtatgttggattctgaatgtttccttcacatctatcttctattctagttcattaatttctcctcaactgtgtctaaccttctgattaacatgtctactgagggttttatttcaattataatttcttcttttttttttgaaacagagtaagtcttactctgtcgtccaggctggagtgcagtggcacaatctcgactcaytgcaactccaagtagctgggactacaggcacatgccaccatgcccagctttttttttttttctttttttgtattttcagtagagatggggtttcaccatgttggccaggctggtcttgaacttctgacctcaggtgatccgccccggcctcccaaagtgctgggattacaggcatgagccaccacacctggcctcaattataatttctaatagctgaatttggttattttcaaatctgattgtttcatgcctatattttcaagcatttttctttctttaaaacttaaaatatattatact

SEQ ID NO: 167105 - DNA, 601 bp, Human
taggtcttttatccacctgaaaattttttttttaatatggaaaaaagagtctgtctctgtcctactttttcccattccttctagagttctggttaggtaagttagaaatcactttaccctccagattccaacctttcttctgacacatttggcatttacatttacatgtctgggtatgttggattctgaatgtttccttcacatctatcttctattctagttcattaatttctcctcaactgtgtctaaccttctgattaacatgtctactgagggttttatttcaattataatttcttcttttttttttgaaacagagtaagtcttactctgtcgtccaggctggagtgcagtggcacaatctcgactcattgcaactccaagtagctgggactacaggcacatgccaccatgcccagctttttttttttttctttttttgtattttcagtagagatggggtttcaccatgttggccaggctggtcttgaacttctgacctcaggtgatccgccccggcctcccaaagtgctgggattacaggcatgagccaccacacctggcctcaattataatttctaatagctgaatttggttattt

SEQ ID NO: 167106 - DNA, 601 bp, Human
ttgattgaattcatcaatcttttcctttatggtttgtttatattttgtcttcaaaactccttccctcaaacaagatcataaagacattctcctttattttttctaaaaccttattgtagtgtgcctttctccttaggtcttttatccacctgaaaattttttttttaatatggaaaaaagagtctgtctctgtcctactttttcccattccttctagagttctggttaggtaagttagaaatcactttaccctccagattccaacctttcttctgacacatttggcatttacatttacatrtctgggtatgttggattctgaatgtttccttcacatctatcttctattctagttcattaatttctcctcaactgtgtctaaccttctgattaacatgtctactgagggttttatttcaattataatttcttcttttttttttgaaacagagtaagtcttactctgtcgtccaggctggagtgcagtggcacaatctcgactcattgcaactccaagtagctgggactacaggcacatgccaccatgcccagctttttttttttttctttttttgtattttcagtagagatggggtttcac

SEQ ID NO: 167107 - DNA, 601 bp, Human
ttaaccaatgaataaaactgccaggtaacaaaactggaaaatgtttgattttactaagaaatgccaaaatgttttccaatcgtaagtgcatgacagcacctgctgtgcgacatcctgggtaacactagttatcagcaggcttcttaatttcgccaatctgatgggtataaatggttttttactttggtttccatttgcattccctgatcagaaattacactgagcaacttatctcaccaagccataagtggacaggacaatcaagtttttttggatggtatccattcaaatctcatatcctttttttttttttttttttttttgaggcagagtctcgctctgtcacccaggctggagtgcagtgtgcaatctcagctcactgaaacctccgcccactaggttcaagcaattctcctgcctcagcctcccaagtagctgggattacaggcgtgcgccaccacgcctggctaatttttatatttttagtagagacggggtttcgccatgttggccaggctggtctcaaactcctgacctcaagaaatctgcctgccttggtctctgaaagtgctgggattacaggcgtgagccaccatgccca

SEQ ID NO: 167108 - DNA, 601 bp, Human
gctgaaatgaagaaatatttccagtataaattggactgaactgataaatcaatgctttctcctcttcagattcagatttaaaatgatggttgtttttccgagctgcaagaaaaaaagttaatttttaaaaagatcagatgacaaaatcttcaagagactattttataatatttcttcctgcaatcagcattattaagtgggaaaatatcaacaagaagagaaatgcgactgctcttcctatagaacagccatctttttttttctttacttctctaacaaacttactttccaaaaaaaaaaraagaagaagaagaaggaaccaaggaagggagggaggcaaatgcttgacaaaatttccccaaataaagcagtgcccgatttatggcacagtcgcgcatggccacagcagctgtgctgtactccccctgcagcatatcccatgctatgctcactccgcaactcattcaaatacctacctatcaaatacacaagacttgataacacagcctggggatggaaatataaacagaacaggtcctaacactcaaaaagctcagcctcgtaaccacacagaatcatatgataaaaatgtttttatggt

SEQ ID NO: 167109 - DNA, 601 bp, Human
cttcatggtgttttaatttgcgctgtacccatttgttgtcctccagctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttcccatgcttgtcaaaaatcagaggcaactaacactgyggcttcctgaggtaggcaatgatgtgttctctgtgttcagaaaatttcacaatgtctaccctggaatggatctcttttcccccaatttgctctttcaatctagaaatgtgtggccaggcacagtggctcacacctgtaatcccagcattttgggaggctgaggcgggcagatcacctgaggtcgggagttcgagaccagcctgaccaatatggaaaaaccctgtctctactaaaaatacaaaattagttgggcatggtggcacatgcctgtaatcccagctactcgggtgctgaggtaga

SEQ ID NO: 167110 - DNA, 601 bp, Human
ttttttttgagacagagtctcactctgttgcccaggctggagtgcagtggtgcaatctcagctcactgcaacctctgccttctgggttcaagtgattcttctgcctcagcctcccgagtagctgggactacaggcacgtgccaccacgcccggctaatttttgtatttttagtagagacagggtttcaccatgttggccaggctggtctcaaactcctgacctcaactgatccactcgcctcggccttgcaagtgttgggattataggcgtaagccaatgtgtccagccagaatatccatktctagtaacacatgctgcaaggagtcaatgacctttagaaagttaagaaccacaaggcaaatatatagtgattttgtgtcttggtactgaagcttttgcttaacttactaattctactattagtgaattaataaccatatctaaatattacaacaaagctgaagaaaagaagggtgttcacttgttgaggggcgttggaacataaaattaaactgagaaaacctacaaaatgtacattagttcgatataaaatatgtaaaaattaactgattcacttagcaacatctctgaagaggggta

SEQ ID NO: 167111 - DNA, 601 bp, Human
gcgccattgcactccagcgtgggcaacaagagcaaaactccatctcaaaaattaaaaaaaaaaaaaaaaagaaagaaaagaaaaaaaaaggctacaatcaatagtccataaataaatataaaccaatctaaagcctacagagaatgtgatcttttaaagcagaaacacatccatataacaactaaaatggcaattacagctaagctatggtttgatatttactattgtcagatagagtgtaaaatttcattcttcagtgtagaagaaattcccaggaaatctaattttctgcttcctcatkcagaatcccaagacaatatcctgttttcaatttttattcaaaaggagcaagggaatattacttctatctgaatagttaagtggttgttctcctcctttaagctctgacattttcaaaccagaagcttctatgtactgttataaagtgatctggaggtggaactctatatagaatcactgcctccaggtctagagttgagtatacagtatactgcctattgcataaaaaagggtggtgagaagcaggatatgaacatatatatgtatttgcttatgttttcaaaaggaagtgctggaagga

SEQ ID NO: 167112 - DNA, 601 bp, Human
gtctacaatcaaccgggtatggtggctcacgcctgtaatcccagcactttgggaggctgcggtgggaggatcacatgaggtcgggagttcgagactagcctggccaacgtggtgaaaccccatctctactaaaaatacaaaaatcagctgggaatggtggcacacgtctataatcccagctacttgggaagctaaggcagaagaatcgcttgaatccgggaggtggaggttgcaatgagccaagattgcgccattgcactccagcgtgggcaacaagagcaaaactccatctcaaaaattaaaaaaaaaaaaaaaaagaaagaaaagaaaaaaaaaggctacaatcaatagtccataaataaatataaaccaatctaaagcctacagagaatgtgatcttttaaagcagaaacacatccatataacaactaaaatggcaattacagctaagctatggtttgatatttactattgtcagatagagtgtaaaatttcattcttcagtgtagaagaaattcccaggaaatctaattttctgcttcctcatgcagaatcccaagacaatatcctgttttcaatttttattcaaaaggagcaaggg

SEQ ID NO: 167113 - DNA, 601 bp, Human
tttcacaattctgcaatacaaatattattcctagtttacagaagaagaaacttctagttcaagagagtaacttactctccaaaaggtcatatagatggatctcagatttgaacaaaagatgatttagccacgaagttctaagtggtaagaactaaagcaaacaaataggatcagcccctcactgagataaggaagaaaaaattcccttctgacaaatttctttctatacccaaaatggacctttaagtcaggtgtacaaccagtacaacagtactatccagctatgttaagggtctgtctrtctatctatctatctatctatctatctatctatctatctatctatatgtttttgttttatttttatttttttattttttttgagacggagtttcgctcttgttgcccaggctggaatgcaatggcaccatcttggctcaccgcaacctctgcctctcaggttcaagtgattttcctgcctcagcctcccaagtagctgggattataggcggccgccaacatgcccaggtaatgttttgtatttttagtagagatggggtttcaccatgttggccaggctagtcttgaacttttgacctca

SEQ ID NO: 167114 - DNA, 601 bp, Human
atcagcaatcttgtattctggctaaagggtaatagatcaaaatttatgattaaatagacaaatataaaacagactgcaaagcaaagcaaggaatatgtcccttcttgcttgattttctttagcagaattacagaatacctttaaaacttggatattgtaattgaaaagcatcttcactctatcctagacagtttacgttacttgcctcatgggacctatttccagaaatgtaatcacttgttctattgttccttgtgccatctctaaatgttctagaatatcagagctggaaagaagtaagtgtgtgtgtgtgtgtgtgtgtgtgtgtgtgtgtcagagctggaaagaagtgtgtgtgtgtgtgtgtgtgtgtgtgtgtgtgtgtgttgcccaggttgctcttgaactcctgggctcaactgatcctccagcctcagctgggattataggcacagccactgtactcagctctggaaaaagttttagcagccactagtttaagccccttgtaataaagaagagggaactcaagtttagagttcaggtatttgctttcaaggtcaaagcattaatggcagagccaagactagaacccactcag

SEQ ID NO: 167115 - DNA, 601 bp, Human
ttacctactttgcttagctattataagtgtcaaatgggtaaaagatgggagagttcattaattcttacatgttacatacatgtaaggtactgttatatagcctaaaaggtattagtaaaaagcaaaagatgtaattcctattcagaatgtcccctgactcccaatctgctttagggaagtaataaactcataatgaggatatagtgagatcttaccttctagtattataactactgtatcccatatgattcgaaatgttgtaaaagccacaagtaatgaaaatacgtatgtacagatgggrtcagcaatcttgtattctggctaaagggtaatagatcaaaatttatgattaaatagacaaatataaaacagactgcaaagcaaagcaaggaatatgtcccttcttgcttgattttctttagcagaattacagaatacctttaaaacttggatattgtaattgaaaagcatcttcactctatcctagacagtttacgttacttgcctcatgggacctatttccagaaatgtaatcacttgttctattgttccttgtgccatctctaaatgttctagaatatcagagctggaaagaagtaag

SEQ ID NO: 167116 - DNA, 601 bp, Human
agccaaattcttgctggagaaatgaagtcagaaatgcaagattgatcagacaacaatcccagagtcttgaaccagtttatagaaaactagaactgaaggatttcctcttagaccccaaacgttatacctcttataccccaacataccgtgtgacagctttattctctcagagacacaactctccccaacccccaactctccctgcctcaaataaataaagaaggaaaaaaagcacactcgagttactctttctgcaggctctgagtagacaaaatagcccacatcagttgatgtgatggaraatgaagagaaaaagcagaaatggaagttcacaaaccttttctgtgatctccttcagtgatgggtacagcacatccttggagagtaggttctgcataatactctgcatgatggggaggatgttcccttccccatccccttcgtccatgcctagcccctccatggccttggtcagctcttcttccgacatgctggagttctagataggacaagtaagaggtgagcaggtatactaccttcttgggatgctcaccactctctcaggtgacaaagataaactatctaaacttgcctgtaacaa

SEQ ID NO: 167117 - DNA, 601 bp, Human
tgagtgggggcctggtaaccatcaaaggagaaaatgggctccacaaaggtgggggtggtccattgcttcccccacctcgaaccctaatgactgaatacaaggctagcatggtggggccaaggaaccatcagaccaagcaactaggcatccatccaaaatgagtcattagtggggtggtggggagttgaagtgagggacccctttgcctttgaggcagaatggggaagctagaacacatgagttcctaccagaccctccagctctttctcagcttctcactgccacagcaagcctcgccctrgttgttttggagttttttttccctgacatggggaggggttggaagtgggtggggcgattctgaggggggacttggagagagcgggtgagaaagtcgggagcaggttgctatggtaaccgcctcctcagtcaggggaactgttgccagggttactgttagagggggaaaacagaagaaaaagatggtggggggaaggaggtatgacttgtcactctaggctccagcctggctcctagcttcccgtctaccctgactgcctcccctaggtcttccttttctccctccagccctagccacctc

SEQ ID NO: 167118 - DNA, 601 bp, Human
gctattatcacatatacaacagaacataaaaacaatctaaaaatagtaaaattttaagtggcaaaaattgggaagaattctagacaataaaaatggaagaatacctgaatgaggggagaactcgaagtgtaatctaactggtaaatagtaatactaatctttgttaagcattttttaaaaactggtaaaatttaaaactacaagttctatcattttcttatccactttgagagactactgcttggggagtgggatctatggattagagtaatccctcacagctggaggctttagggaagaattggtgtttaagatggccctgaaaggtgagtgggatttctaaggcaagatccaaaggagggcatgccaggcagaggaacactgtcacagagtatctagtgtgtttggaaatgcaatcagtcctgcttggcttgactaggatgtagggtgtttagaaatggctgggaaggtaaggtaagactgtgttgtagagagcctgggtattggataggtgaggtgagtgaactcagggcccttcagatatactattctgactgctgtgtggctggcagggagaacgtataaaggaggacgtgttaca

SEQ ID NO: 167119 - DNA, 601 bp, Human; identical to SEQ ID NO: 167117

SEQ ID NO: 167120 - DNA, 601 bp, Human; identical to SEQ ID NO: 167118

SEQ ID NO: 167121 - DNA, 601 bp, Human; identical to SEQ ID NO: 31587

SEQ ID NO: 167122 - DNA, 601 bp, Human; identical to SEQ ID NO: 31588

SEQ ID NO: 167123 - DNA, 601 bp, Human; identical to SEQ ID NO: 31589

SEQ ID NO: 167124 - DNA, 601 bp, Human; identical to SEQ ID NO: 31590

SEQ ID NO: 167125 - DNA, 601 bp, Human; identical to SEQ ID NO: 31591

SEQ ID NO: 167126 - DNA, 601 bp, Human
atcataatccttccctccagttagcagcccaagtcctagaagacaagggtgttggcttcgggctggtagactctgagaaggatgcagctgtggccaagaaactaggtaagagaggggagggcaggggaggggaaggtggcattgagacaaggggaggcttagggcggaggacctgtcaggcagtccttgggatccgaggggcttgggaatctctcagatttatgtctattctaaaagagggggtgagaaaatatgaggttgggagggttatggctcggagactctgcctctctattccttrtgaagttccatgctcaaatcccagaaagaggtgggggaggccttctttatacttaccttaaaacatggctaggtgctggagggaaggggagtcggggaatacaggcggggctggccagacctctgcaaactccgcttccaacccctcccatccagagccatggttgttagagcagtcagccactagggggcagcacaggcttgagacgggattctggacatgcatgggggaggggtggtcagtaataatgaagtcatctggtcagtaatagcaattaaagagcttgactgggaaccagct

SEQ ID NO: 167127 - DNA, 601 bp, Human
ctttcaggtcctagaggaccctgtggaattgattgaaggtgaacgagagctgcaggcgtttgagaatattgaggatgagatcaaactcattggctacttcaagagcaaagactcagagcgtgggtaaccctcagactccactgtgcccctctctggatccccatctcacctgtcctcccacctccccacatcacccagtgtctcagcctctacctctgcacttcccacctcttcctccagccgtggtcagcaccatcaacagctctgacctccctgtactctgggggttcccagacaagcmcctccagtattccaccttcccctcactctcgaagaactagaaggggtgggtctcaaaatgaaccctgcctgcaaagaattggggacgatagtgggggatgattcccgggcagaccctggtttccccagagactgactctgcattccaccccccagattacaaagccttcgaggatgcagctgaggagtttcatccctacatccccttcttcgccaccttcgacagcaaggttctcctccccgcagctgtattggttctgcctcatgtcctgaagctgtcctccagtttcctctcccagaa

SEQ ID NO: 167128 - DNA, 601 bp, Human
aaatgaaccctgcctgcaaagaattggggacgatagtgggggatgattcccgggcagaccctggtttccccagagactgactctgcattccaccccccagattacaaagccttcgaggatgcagctgaggagtttcatccctacatccccttcttcgccaccttcgacagcaaggttctcctccccgcagctgtattggttctgcctcatgtcctgaagctgtcctccagtttcctctcccagaatcgatggctgacctggtcccttcctacgtgctggcactccctacctgccccccccyccggctcctcccactccatagatttagagctgaagaggggctttagatgatctaacacccctctcatgttaaacccaaccccaggcaagttaagacacttgtcaggtgtcacagtggcagtgacaaggatcccggctttctgactcccttcctaatatttgttcccccattatactgcttctcgacatgaccctgtgtctcctgctccactcccctcctaccccctctcccaaaggtggcaaagaagctgaccctgaagctgaatgagattgatttctacgaggccttcatggaagagcc

SEQ ID NO: 167129 - DNA, 601 bp, Human
ggcagatcatctgaggtcaggagtttgagaccagcccgatcaacaaggtgaaacaatgttgtactaaaaatacaaaattagccaggtgtggtggcgcatggctgtaatcccagctactcaggaggctgaggcaggagaatcgcttgaacccgggaggcggaggttgcagtgagccgagatcgcgccattgcactctaccctgggggacagagtgaaactctgtctcaaaaacaaaaaaaaacaaaccccaaaaaacgaaagaatatatctggtcctgaagctggatttccacaaaattgargttcaatgaacatctaggatctgttctgggctcctcaacttcagggagtatagtaaggtcttctccaaaaccctgttctccttcttaccccctgacaggaggatgatatggatggaatccacattgtggccttcgcagaggaagctgatcctggtgagggaggaataccgggttggactggagggaaggcagggggaggtgggtgtgtttattggagcatgggcctcactaggaggctttcctgggagtttgcaaacagcctagggctagacatgtgaagcttggggagcagggaggtag

SEQ ID NO: 167130 - DNA, 601 bp, Human
cacgaacacacacagctggcctgccagagatcactaacttagacccactgcttctcaaaggtgtctatatgcccagtcctgtcccaggaattacagaggggctcagtgagtgagtcaaacccctgccctgagtggctcctggatggggaatccctgatctgggtgctctgaagcccacaggtcttgcccaggtgcaacttatgccctatgagagcttggaaataggaaatttttaaaagaggacaaaaggggaactaacatttaccatatgcccttagacaccaggcatgacagtaggtgytcacatacatacatacgccactgtgtttgtaaggtgctgagagaagatgggacactgaatcaaatagaatacataagtgaaaggggacgctcccccaccccaattacaacactgcagggagtcctcgaaagtcaggaactgctctttgttggagacttatttaataattaacaaaattcttctgaggtccactgagccccagaaaagcaatgcagcccctgggcctgaagtctgtccacaagtacatccaagtagcaacctttgccacctgttgtgccccagacattctaggtcagttcc

SEQ ID NO: 167131 - DNA, 601 bp, Human
aacaataaaacaatttttatttgaaaacaaagcatagcaatgggcctggtgcccgaactctgaaagcaagagagtacagacctaaaaaagaaaacaaacaaacaaacaaacaaaaaaaccatagcattatatattctgggatccagaatgtttcactcaaattcagcaagacaaagctggaatggggctagaataggtcagtgtgaagtttccctgatgtaacttcaacacctgtcaactaaacaggttgacatgttcaggaaagatatgtcttttcctagatgtcttacccattctgagrtctagttcttcttttgcacagtctccgcaggctggcaaattcaggcttcaaactcttggcctggttctacttccctttctgtagactttggttaccaagaaagggagattcccatgcacgagaccccttgccttttactctgagtgatccacgcaattatcctctttcttcaattgggaccaagttggccatctgtaggatgccaccagaagataacatcctagtcagtactgaggtccccatctctccttctgcaggattttaatcattatttttgtaagagttctggaagtctgccta

SEQ ID NO: 167132 - DNA, 601 bp, Human
ggtgggaccacaggatataaaggatggaaaagtgcctcacccactgcttggcatgtggttgatgcccaataaacttgaggcagtgggtgaatgataaatgattactagctataatcaagcaaaccagttcataatacccactatttggctgtttctctcccaagacccttttagtgtgccttagtcattttttaaccccctactaacttcctattttggcaaattccccatctaatgagttgtgggagatagtgctcttctccaactacagaagctgaaaacatcaaatattcacctcagmctggccaagggacctaggcttagccaatgagatggccctggactgacaatgactagggaactagtggaccaaaaggcagaacaaggaaaacctttctgacccaaacagaactggcagccagacccagcgtctgggcaacactgataacgataccagcagcggcaccctatgtaaggaattggcagttttgggggtgcaacagtgcatcagggtccttgccagaccagttctaggttttgattttggtcttggttccagctgcagaaacttcttttgttcctatttgtgagctctccaaaa

SEQ ID NO: 167133 - DNA, 601 bp, Human
gattgcttgagcttaggagttcaagaccagcatggggaacatgatgaaaccctgtctttacaaaaaatacaaaaattagccaggtgcagtggtgtgcacctgtagtcccagctacttgggaggctgaggcaggagaatcacttgagcctgggaagtggaggtggcagtgagccgagactgtaccattgcactccagctccagcctgggtgacaggagtgaaaccctatctttaaaaaaataataaaaaataaatgcatctgttgatcctttcccttaccaacaggaaaactgctgcagagygagagtcttctaaatggattaagaagcctatctcaatccctctggagagtcctcttcaattcacaatgaagatgttgaagagcagggacagacatcaacactcctctccccaccttccccactggcagaggcattcaggtcactactagtgtctctctttctcttttccccttctcttaatctctcactgcccttctctccatgtcatattctctttttctccttccctctcttccttcttacctactaaactccatatgtaccaaaatcagtcaaagctctactatctagctctcttta

SEQ ID NO: 167134 - DNA, 601 bp, Human
tggctcactacaaccgccacctcccgggttcaagcaattctcctccctcagcctcctgagtagctgggattacaggcgaccaccaccatgcctggctaatttttgtatttttagtagagtcggggtttctccatgttggccaggctggtctcaatctcctgacctcagatgatccgcccgcctgggcctcccaaagtgctgggattacaggcgtgagccaccatgcccagccctgaccagcttttctgaaaacaagtctcttgttcttatacagatattcctcgcagaatggtagggatarcaaggagtgggggtcactagtgtgtgtctatacttagtctaaaatcatcaggaattaaagtaaatttctgttctctaggttttcctctctccatgaaagattttcctttatgaaagaagaaataattatctctctaggaccacacagtgggtttgaagcaatataatttgttacagactcttacaatctttgatattggtaattttaaattctttcttacgattaaattactttaacccccacaaaaagccatattcagggagttagaaatcgctaaatgacctgcagaggcctaccctt

SEQ ID NO: 167135 - DNA, 601 bp, Human
cacatgagttctcggaccatgtcccgggtgatgagctggatggtctctggcttgcgatccaagcccaaagcagtgagagttttttgaagggtatgcttatctcggagcagcacaatggggctgtcgctctggccctgggctggggactatgagttcagaaagaatagcttagaagcttgtcacccccacttcctgctggtcagtcctaacttcaaggatagagcagcgtgatgccctgtatctgagcatggctggatgtgtaccgaccagcttttcttttcttttttttttttttttttttgagacagagtcttgctctgtcacccaggctggagtgcagtggcacgatcttggctcactacaaccgccacctcccgggttcaagcaattctcctccctcagcctcctgagtagctgggattacaggcgaccaccaccatgcctggctaatttttgtatttttagtagagtcggggtttctccatgttggccaggctggtctcaatctcctgacctcagatgatccgcccgcctgggcctcccaaagtgctgggattacaggcgtgagccaccatgcccagccctgaccagcttttctgaa

SEQ ID NO: 167136 - DNA, 601 bp, Human
cttagagaggactcactaagcacctcctctctaccagtcccttagctcacacagccagctagaagtaaggaaggacaatgaagctgagaataaaggacagtggcaataatagatacaacaatgggagaaacaagagaggccaggatggagaagaaagaaagaactatcaaacaaaaaggggaaaacgaataggaaagaagtggggattggactgacagaatgaaaccaggtgggtttacccatctccctacaaagatccttagcaaaaggatgaggactggacatagaagggcaggggacrgtgtactcacatgagttctcggaccatgtcccgggtgatgagctggatggtctctggcttgcgatccaagcccaaagcagtgagagttttttgaagggtatgcttatctcggagcagcacaatggggctgtcgctctggccctgggctggggactatgagttcagaaagaatagcttagaagcttgtcacccccacttcctgctggtcagtcctaacttcaaggatagagcagcgtgatgccctgtatctgagcatggctggatgtgtaccgaccagcttttcttttctttttttttttt

SEQ ID NO: 167137 - DNA, 601 bp, Human
cgaatctaagacagcagtttatactgctttcagcatccctgaaaaataaccagccacttgtcctccaatgtgttttcaggactagatggctccaagaaggaacccttcctcccttcctctggctccaggagtggctgcagggctctagccacatctggccacttgatgccacggctgaccagacatgctcagtaaggggccgcagtccgacacagctcccggggtgtgtgctagatgtgcctctccagcttgtgacacaggtaggattttctgggaattagggcttttagtgggtggagcyagggcagggagaacggttgtagagggtgaagcactaacacaagagttaaaccactgagcacagtgttggctcatggcacatggttgagctaggcctaagtcccacaggatgggctcaagcctgggggcagctctagtcaggaagtggggttgagctaatcccaaaggaacccagggagcccctgtgaatttcttcctatggccttagagtctgggaggaagccagggggctaattaggcatctggtcagtttccctttgcttcagattcttaatgcagccgaaaggaagtgactcatctg

SEQ ID NO: 167138 - DNA, 601 bp, Human
ttctgggtgaggcaggtacatgccaatttgacaggtacatgccaataagacacagacatctgagacaggaagtgaaacctcatctaataaaactaatgtgtgtgtgttgggggagggtggtccaggagatggacagaatgagtgagtagatttgcagcttagccaagaccttgtgtttcacaaagcagcgtggccctaaacagcctaggatctggagtgaccagcagtgatccgaatctaagacagcagtttatactgctttcagcatccctgaaaaataaccagccacttgtcctccaaygtgttttcaggactagatggctccaagaaggaacccttcctcccttcctctggctccaggagtggctgcagggctctagccacatctggccacttgatgccacggctgaccagacatgctcagtaaggggccgcagtccgacacagctcccggggtgtgtgctagatgtgcctctccagcttgtgacacaggtaggattttctgggaattagggcttttagtgggtggagctagggcagggagaacggttgtagagggtgaagcactaacacaagagttaaaccactgagcacagtgttg

SEQ ID NO: 167139 - DNA, 601 bp, Human
ttcttactgcctgtatcacagccaattgggcagctctgtttcctttatgagctccttcaggacacaaactctgtcttaaccacactggtagcctagtctctggcatagcgcttggtacagagtgagaattcaaaacaaagctgttgaattaaattttaaaaacagattattcctcaaggatgacataaaaacggcaaggggacgccagacaaggttgatatagatgctagttagaaacctaagcttccctgcccatccagcctagagagaagctttgaactgtaaatattaattaaaatcygtgatcaacaatagccagagacatgtctatagacctctcctttctagctatccaacgcattcaacaaaccaatcgctaattataatgattacaagcaaatgacatatattaaagatgggggagggagtagttaggggggtgggaagaaagctgcttctgggtgaggcaggtacatgccaatttgacaggtacatgccaataagacacagacatctgagacaggaagtgaaacctcatctaataaaactaatgtgtgtgtgttgggggagggtggtccaggagatggacagaatgagtgag

SEQ ID NO: 167140 - DNA, 601 bp, Human
gaaaattaaaggaggcatacatagagaagatttacctgagagacagaaatcagaggtgcagggattggggaatcagcacttttcatttggtaaggaagtgaaccacatgcaaatgagttacaacagaattcaaatgagcctctggtctttaggctctcagccaaaggaaaagctttgggtactccaaaagcatccaattgcctcgaccaccatacgtggccagaactgaactaacaggatgaaaataaaagtaacactgcacatttaatttaccaatcctcagcccacaaagcctctcccrtctactaccttatttcatcctgccaatgattccacaaagtagttttaccaccctcaagttacaaatgaagaaagtgaggctcagggagggcaagtgacttgcccatggtcacacagcgaacaggtggcagagccagtcctcactgtgatcactgcaactaccacagcaggtgcagctctcccccgccccacccctgcccacacccccaccagtccctggccttgtccagtgcgggaataaggggagggcggagggatggcagtgaatgctcagagggaagggagagacgaagagcccacc

SEQ ID NO: 167141 - DNA, 601 bp, Human
ataagcttctaaaaattctgtgattctggccgggctcacgcctgtaatcccagcactttgggaggctgaggccgggggatcacttgaggtcaggagtttgagaccagcctggccaacatggtgaaaccccatctcttctaaatacaaaaattagccgggtgtggatgtgcatgcctgtaatcccagctacttgggaagctgaagcaggagaatcgcttgaacccgggaggtggaggttacagtgagccgagattatgccactgcactccagagcctgggcgacagagtgagactccctctaaaaaaaaaaaaaagttctgtgattctatgtatcacttcgtaaagttttgagataataagtagatgacaataatgaccatttctcatctcttccctctttgctaggctacatggacctaaagatacatggaaatagcttagagagggagatgccaaaaccacatctttacctaattctttcctccctcctcttcctctccagttcctcctgcctttgaatggatttctgccgctccacttccatcatctgatccaaccgcttctcttctgtgtccagttctttttggatctgctgcttctc

SEQ ID NO: 167142 - DNA, 601 bp, Human
gcagccagactgtgaagtgcctcctaggatttgggaaataagcttctaaaaattctgtgattctggccgggctcacgcctgtaatcccagcactttgggaggctgaggccgggggatcacttgaggtcaggagtttgagaccagcctggccaacatggtgaaaccccatctcttctaaatacaaaaattagccgggtgtggatgtgcatgcctgtaatcccagctacttgggaagctgaagcaggagaatcgcttgaacccgggaggtggaggttacagtgagccgagattatgccactgyactccagagcctgggcgacagagtgagactccctctaaaaaaaaaaaaaagttctgtgattctatgtatcacttcgtaaagttttgagataataagtagatgacaataatgaccatttctcatctcttccctctttgctaggctacatggacctaaagatacatggaaatagcttagagagggagatgccaaaaccacatctttacctaattctttcctccctcctcttcctctccagttcctcctgcctttgaatggatttctgccgctccacttccatcatctgatccaaccgcttct

SEQ ID NO: 167143 - DNA, 601 bp, Human
aagagaaaacaaaaaaaaattaagaacttgtcacaaggcctggcatgttgggggcctgggaaaaagcacagagtagatggcaggtaggggtgagaaacgagattgattgcagccagactgtgaagtgcctcctaggatttgggaaataagcttctaaaaattctgtgattctggccgggctcacgcctgtaatcccagcactttgggaggctgaggccgggggatcacttgaggtcaggagtttgagaccagcctggccaacatggtgaaaccccatctcttctaaatacaaaaattagcygggtgtggatgtgcatgcctgtaatcccagctacttgggaagctgaagcaggagaatcgcttgaacccgggaggtggaggttacagtgagccgagattatgccactgcactccagagcctgggcgacagagtgagactccctctaaaaaaaaaaaaaagttctgtgattctatgtatcacttcgtaaagttttgagataataagtagatgacaataatgaccatttctcatctcttccctctttgctaggctacatggacctaaagatacatggaaatagcttagagagggagatgccaa

SEQ ID NO: 167144 - DNA, 601 bp, Human
gagaagggagccactaagcctgcctagtgacatgagggaggtgacagcaaagctatatataaagggaaggagacagcattttccaggaggaaaaggaaagaaaagggtattcaaaaaagagaaaacaaaaaaaaattaagaacttgtcacaaggcctggcatgttgggggcctgggaaaaagcacagagtagatggcaggtaggggtgagaaacgagattgattgcagccagactgtgaagtgcctcctaggatttgggaaataagcttctaaaaattctgtgattctggccgggctcacrcctgtaatcccagcactttgggaggctgaggccgggggatcacttgaggtcaggagtttgagaccagcctggccaacatggtgaaaccccatctcttctaaatacaaaaattagccgggtgtggatgtgcatgcctgtaatcccagctacttgggaagctgaagcaggagaatcgcttgaacccgggaggtggaggttacagtgagccgagattatgccactgcactccagagcctgggcgacagagtgagactccctctaaaaaaaaaaaaaagttctgtgattctatgtatcacttcg

SEQ ID NO: 167145 - DNA, 601 bp, Human
aagttgacggtgatgatgttgtgaaatgagcatgtgcctggcagaaaatcagtcaacaccctgaaaccccagagtcttgaagggttttgatgctgcagctggtgaaacgtggcattgtctgtctggcctgttacctttagatcttcctcttggagctgttccatatattccagcatctgctccttctcctgctcccgctgctcagcaagcagcgatcgctcctcctggttcttttccatctgttccacaatttgccgccttcctcttggagagaacagtgccacagtgtcttagaaacccmgggtccacatctcccagagtccaacctccacctaaacaacccccaagatgggtggtgtcaccgaaacaatttgacaagtgccccctaaacatgaatatgcttcatgagcccagaccaaagtccctcccccaggaaggacctcaagggttggcctcctttctcctgagctcctggttccagggctcactcttcctgagattctccttctttatttgtttgtccaagaggggtaccccacttgataaaacaccttctaccttccagtatataaagagtttctgaaatcctaccacctcccaa

SEQ ID NO: 167146 - DNA, 601 bp, Human
gctccttttcccccttctccctttcttcctttccttcctaactgcttctcactgattttaggcctgctatttgtatcccagacatcatttaatctcactggccctcaaagctaaagatgctgttgatttctgatgtatgacatacatacaatcatgtatttatttacttctttccctatttatttactttttggattgttgtttttgttggctcatttcaattccaagacaccaaaggactttccctgtttcttttgaagcccttccaaagcaaccccagataaattcccttcactctttycccctttgttagcaaggtgggaaacgctgcccttcgtaccaccatgagatgatacagtaggtctaaagctgggaaggcacaggtttccttgctaaagttgcccaataatacttcctggagactcagggagtgcctgttagaaggacattaaaaggataatgacacaacatcaacataatggtgctgactcatggactcctagaacttcctcagtgagcccactaattcccactccccacatctagttggattttcctgccctcacttctcacccactaccttgcatatttgccccataac

SEQ ID NO: 167147 - DNA, 601 bp, Human
tataattttgtatcccttcaattcgaattttgcttggcttgtttccttttgaaaaattctaatgttgtagagtctgaaccagagcaaaaagagagtcattcccagttagaccaggagaacagccccagggaccaggtctgactggtggaaaacagagcagagagggaaaccaatgggagctgtgactgttgactgcttttggggagggagcagaacagtgagagatgtgaacatttagcttccacttatgtgttgaaattatcattgagccaaaagggaaaacaaaagtaaaaggataaakagctaccaaggaagaaagatggattgatgtaggtgcagtccatccaaacacaaatctctaatacctttcctgtggaatgggcaagagcagtgttttgttaattgctaatgtcctccatggcatccagcacagagccctgcatttctgtgcttaatatatatttgtcaaatgaacggcaaacagctcccttaaagtcctgctccagtgactcacaacccttagtgtctgaagttcttttctctatctttcctaaaccactcctcttgcagtttcatccccaatttgcaggggcacatgggt

SEQ ID NO: 167148 - DNA, 601 bp, Human
attttagaatcacctgggagcttttgaaacagactcatgcatgggcctaatcccagaccatttaaatcacaatctaggaagtgaagcctggtcatcgtatttttcaaaagctccaagacatttctaaaaaccacttggtagaggaagacagctatctctgcttagtcaacaggctgagaagtatggacatccctctgtccagaaacaaaagtccacatataggccatagaggaggctgtgcttttgaggcagagaaagttggatttgggctgtggcagagatgcttctgagtaaagacacmaaacatggtggtcacatggccctggagacactaggcctagatactaacctacaacaataggtgaagttgaacttctccaaaaaggctggtctagctttaataactggctagtgcatatgcttcaggcaaatgatgcaaaggaaagataaatgggtcggcagcaaaagtaggacttaaatttcatttcattaatatttattagtgcctgttaacagcaacacagatgtccaagggcatagaggccagggaggagagaggagacatctggaaggcagtctgtagcccaagggcagaatcttg

SEQ ID NO: 167149 - DNA, 601 bp, Human
aaggaaggagctcagcctgatatcgctcagttctcttcctgatccacctctccaaatttcccttagaaacctcttccacaaaaatacctgatggaccctgacatcagggagaaaatcactaatggcaacaggaaaggctcagaaaacactcaaatgaaatgcattcgcatctcagaaaaaaatgcatttataggccttcttaagctaacatctaattttgttctcaacataatttaaaaaatgaaatgtaaaatcatcttaggcaggaatttctcacctgctctcctcccctagagtcacygataccccaacaaaaggtacctacaacactgcttcatttcctcatttccctctagctttcttccaagatccaccatacatgcggcatcctccccactcccagaaactctttccatcatgcaaacatctcctaaaattctgtgccttctacagagacttcccagtttacccgaagaatactgttggcttcctcagccctctgtatttagacaccaaatcctgacttcccagacacatctctgatagcagggggactctcctctttgccttgccattgttttcctatatttagaacagtttt

SEQ ID NO: 167150 - DNA, 601 bp, Human
tccggttctgcacttccttctgctggttctcgcgcacctggcgccggagctcattggcatgctgtaagcgccctgtggcctttttctcctcctccagccgctccttctcaatctgttctctctgagccctgggggagggaaacaggaatggaatgaactcagctgagctggcccaggccaggaaaggtggtgggggagcctcctgggtgggctccttcagtagacatgcctcagagaccacagccctctgggctccagccccattttgtaactcaaggatcagcccccaaaagctgctgcrcatgcatgcccccttctcctacccagccaggactagctccagggtcgcatgactgtatgtcatgggcatgcttagaagggcccccagcttggtttgatgctctgctttcactgttttgaaattcttaataatttttgaacaagggagtccacactctcttgctctgtcacccaggctggaatgcagtggtgctatcatagctcaccgcagcctcaaccacctgggctcaagtgattctcccacctcagcctcccgagtagctgggaccacaagagagtgccaccacacccagctaatttt

SEQ ID NO: 167151 - DNA, 601 bp, Human
tggaccagacaggaggtgggaggaagcaggctctgggtggggtttacagaacctgggggcctgcaccccccaaccctgctctcacaatccacccccgaaacacacattcatgccaaggctccagcatcctgccaaggagctcccagagagccagcaagaccccatcccaggactttctgctggagcccccttcagagggatgagccctgggtggggagaagagcctctccctgagcatctctgccatggcccttcacccccaaatccccatgctttccagcctgtggtgccatctctttgsgggagggaagaggatttgggaaaggaggagattccagcgcacctcagctcttcaagctttttcctcttgatctcatcgatgcgctcacggcgtttctgggcctcctctttgaggcgccggccctcctcaaaggtggcaatccggttctgcacttccttctgctggttctcgcgcacctggcgccggagctcattggcatgctgtaagcgccctgtggcctttttctcctcctccagccgctccttctcaatctgttctctctgagccctgggggagggaaacaggaatggaatgaactca

SEQ ID NO: 167152 - DNA, 601 bp, Human
aggctcccctcagttcacagaggtagctggcaggatgttagctttgcgctcagcttcaatgcagtacttctcgggaaggccagtggctctgccggggaaacgcaggcaggtataaggaaaggtattggaccagacaggaggtgggaggaagcaggctctgggtggggtttacagaacctgggggcctgcaccccccaaccctgctctcacaatccacccccgaaacacacattcatgccaaggctccagcatcctgccaaggagctcccagagagccagcaagaccccatcccaggacttwctgctggagcccccttcagagggatgagccctgggtggggagaagagcctctccctgagcatctctgccatggcccttcacccccaaatccccatgctttccagcctgtggtgccatctctttgcgggagggaagaggatttgggaaaggaggagattccagcgcacctcagctcttcaagctttttcctcttgatctcatcgatgcgctcacggcgtttctgggcctcctctttgaggcgccggccctcctcaaaggtggcaatccggttctgcacttccttctgctggttctcgcgca

SEQ ID NO: 167153 - DNA, 601 bp, Human
ttccccccatcctattttactccaccttcagtaccctgtagcagccacattcccacaagaaagccaagctgttccttaaagtcaagtagatttaatctgtaactatgaaatgtctaggttagcagcaattatggatgcccagagactgggcagaatctgtcccccgaaggcatcctgagggccacgaaggctcccctcagttcacagaggtagctggcaggatgttagctttgcgctcagcttcaatgcagtacttctcgggaaggccagtggctctgccggggaaacgcaggcaggtatraggaaaggtattggaccagacaggaggtgggaggaagcaggctctgggtggggtttacagaacctgggggcctgcaccccccaaccctgctctcacaatccacccccgaaacacacattcatgccaaggctccagcatcctgccaaggagctcccagagagccagcaagaccccatcccaggactttctgctggagcccccttcagagggatgagccctgggtggggagaagagcctctccctgagcatctctgccatggcccttcacccccaaatccccatgctttccagcctgtggtg

SEQ ID NO: 167154 - DNA, 601 bp, Human
ctctttcctatttcactgtgaatatctctctattatattgcttaccaaactgtacatgctattacttggatatatgtttatcttctgtattagaataaaagctccttgaaaacagaagccatttcttatttatttttgaattccctaaaaagaaaacagtgtctggtacacagtaagcattcaataaatgtttgctgagtaagttctccggataatgttgtcaaaggcctgagctctgtatgaatgaaatttcctgtctttcagttcctttcatgattcccaaaccttcccacatcctctktcctttattctcagttatgacagaccctctgtaccttaatcttatagtcatctcctccagagacgaacagtggctgctgcttatggaagtcaatgcctcgcactggacctggtggagaaggcaggcaatgtatgttagacagagctatcctttctaatctctaaggtgattcctattcaggatttttcagttctatcatttccacattctttaatcatagaggaatccatgtcaaacaaggcttaaaataccccaggatattataaatacttatactcctttaacttcctcctagaaata

SEQ ID NO: 167155 - DNA, 601 bp, Human
aaactcctgagcgccacaaacaggtactccatgatctggcccctctcatcttctgccccttctctcaccatttctccaggttttctccatacaaaaccaataacagctgccctgtatctagctgtgtcatgctttttgtctttgcacctatactgctctttcctatttcactgtgaatatctctctattatattgcttaccaaactgtacatgctattacttggatatatgtttatcttctgtattagaataaaagctccttgaaaacagaagccatttcttatttatttttgaattcccwaaaaagaaaacagtgtctggtacacagtaagcattcaataaatgtttgctgagtaagttctccggataatgttgtcaaaggcctgagctctgtatgaatgaaatttcctgtctttcagttcctttcatgattcccaaaccttcccacatcctctttcctttattctcagttatgacagaccctctgtaccttaatcttatagtcatctcctccagagacgaacagtggctgctgcttatggaagtcaatgcctcgcactggacctggtggagaaggcaggcaatgtatgttagacagagc

SEQ ID NO: 167156 - DNA, 601 bp, Human
gtatcactcctgtatttaagttcctcaaatggctcctagttatctgcatgataacatctaaactcctgagcgccacaaacaggtactccatgatctggcccctctcatcttctgccccttctctcaccatttctccaggttttctccatacaaaaccaataacagctgccctgtatctagctgtgtcatgctttttgtctttgcacctatactgctctttcctatttcactgtgaatatctctctattatattgcttaccaaactgtacatgctattacttggatatatgtttatcttctstattagaataaaagctccttgaaaacagaagccatttcttatttatttttgaattccctaaaaagaaaacagtgtctggtacacagtaagcattcaataaatgtttgctgagtaagttctccggataatgttgtcaaaggcctgagctctgtatgaatgaaatttcctgtctttcagttcctttcatgattcccaaaccttcccacatcctctttcctttattctcagttatgacagaccctctgtaccttaatcttatagtcatctcctccagagacgaacagtggctgctgcttatgg

SEQ ID NO: 167157 - DNA, 601 bp, Human
atcataaatataaaatagcttatcttcctcattcagaaaatcccctaaaatgtacaaaaataagagaccagatgcatttttcttcttatttaatttttttaaatttctttttaatatttgtttataatcaatctgggccagcttgttactatttctaatttttaacttttcttcagtaaattataaaaatttcatttcctataacaagtccagacaatccaaaagtatgatcttccaaacaagaatgctgagttccttaaaggcagggttcttgtccatcatgctcaacactatacccttaccacctaacacagtgcctgacattaggtaagtgctcagtaagcattatgtatggaaataagaataacatgaaaagttaaggtattccaatacctttgcctctatctattcaatcagctacatataaatacacatgtacacagtagagtttcacataaaaattagaccataccataaacactattctttaactgacttttttccccttatagagttcagtgttttaaactttcatatttctagtttcaaaatgtcttgactcctttaatggcctaagtcaagctccaaaactgtaaatcct

SEQ ID NO: 167158 - DNA, 601 bp, Human
aagacaatttagcctttttggagtctataagattgttgagaaaaggaagtatttcttatttacacttccttcttactacacttgctaagctttgtgttaaacactgaaaatagatggtatttctattttcaatagagatagtatctctaccttcagtatttagcacaaagcttagcaagtataaggcacacacatatttagtgagctggtaaaatgaaagaaaataaggtctttcgtaactttccaggtagatggcaacttgttctaggcaagggtcttcaggaagtcctttatggcaatracaaataattcctacttaataagttatcttattgagtggttatcattctcaaatgtttaagctgtaattttctcattctctcctatcctagaattttttaattaaaaaaagaaataatatatactcaaccagtaaattgtttatttcatcatattctttctaacttaattaaagagacttaatttactggcaatcaaagaatagtgtaagttaatgctaatacacagaactataaggagatcctgtcagggtgcaactggattcagaggttgggagtctgtaatctgcacctcactatct

SEQ ID NO: 167159 - DNA, 601 bp, Human
tttcacctataagacttaagaatggaagccagttagaggcacaatacattctcagaggcagatagtgaaacatacatttacatttacttctatatgtgtgtgtgtgtgtgtatttatatacagttaatcatgtaaattaagatcctgtgaaagactcttctacctttaactctaggatgggaatattattttattgtctgacttctttctgtccagtttcaaaaaattcccaggtctcagcaagcaaagcagaaagtaacatgtaaagacaatttagcctttttggagtctataagattggtgagaaaaggaagtatttcttatttacacttccttcttactacacttgctaagctttgtgttaaacactgaaaatagatggtatttctattttcaatagagatagtatctctaccttcagtatttagcacaaagcttagcaagtataaggcacacacatatttagtgagctggtaaaatgaaagaaaataaggtctttcgtaactttccaggtagatggcaacttgttctaggcaagggtcttcaggaagtcctttatggcaatgacaaataattcctacttaataagttatcttattga

SEQ ID NO: 167160 - DNA, 601 bp, Human
tcaggttagctgtctccttttctctaccactctaacagcttttctcaacttcggcactttcacctataagacttaagaatggaagccagttagaggcacaatacattctcagaggcagatagtgaaacatacatttacatttacttctatatgtgtgtgtgtgtgtgtatttatatacagttaatcatgtaaattaagatcctgtgaaagactcttctacctttaactctaggatgggaatattattttattgtctgacttctttctgtccagtttcaaaaaattcccaggtctcagcaascaaagcagaaagtaacatgtaaagacaatttagcctttttggagtctataagattgttgagaaaaggaagtatttcttatttacacttccttcttactacacttgctaagctttgtgttaaacactgaaaatagatggtatttctattttcaatagagatagtatctctaccttcagtatttagcacaaagcttagcaagtataaggcacacacatatttagtgagctggtaaaatgaaagaaaataaggtctttcgtaactttccaggtagatggcaacttgttctaggcaagggtctt

SEQ ID NO: 167161 - DNA, 601 bp, Human
gaaagatattccagacaaaggctttaaacattaaacaaatctgttctatcaggttcttgtaatcatttttctctaaagaactgcattgcttaacggctcagctacattagcaaaggggctgctgcttttgctatcaggttagctgtctccttttctctaccactctaacagcttttctcaacttcggcactttcacctataagacttaagaatggaagccagttagaggcacaatacattctcagaggcagatagtgaaacatacatttacatttacttctatatgtgtgtgtgtgtgtgtatttatatacagttaatcatgtaaattaagatcctgtgaaagactcttctacctttaactctaggatgggaatattattttattgtctgacttctttctgtccagtttcaaaaaattcccaggtctcagcaagcaaagcagaaagtaacatgtaaagacaatttagcctttttggagtctataagattgttgagaaaaggaagtatttcttatttacacttccttcttactacacttgctaagctttgtgttaaacactgaaaatagatggtatttctattttcaatagagatagtatct

SEQ ID NO: 167162 - DNA, 601 bp, Human
atccagggatattcctgaaagatattccagacaaaggctttaaacattaaacaaatctgttctatcaggttcttgtaatcatttttctctaaagaactgcattgcttaacggctcagctacattagcaaaggggctgctgcttttgctatcaggttagctgtctccttttctctaccactctaacagcttttctcaacttcggcactttcacctataagacttaagaatggaagccagttagaggcacaatacattctcagaggcagatagtgaaacatacatttacatttacttctatatgtgtgtgtgtgtgtgtatttatatacagttaatcatgtaaattaagatcctgtgaaagactcttctacctttaactctaggatgggaatattattttattgtctgacttctttctgtccagtttcaaaaaattcccaggtctcagcaagcaaagcagaaagtaacatgtaaagacaatttagcctttttggagtctataagattgttgagaaaaggaagtatttcttatttacacttccttcttactacacttgctaagctttgtgttaaacactgaaaatagatggtatttctattttc

SEQ ID NO: 167163 - DNA, 601 bp, Human
ttttatgggaaaataattgaaaaccagctaaaagttcttgttctaaaaggctatatgacttctcttcctggtaagaaattattggaagtccagattcatatatgggattgcctctacatttattattttgcacttaaaagcatcctacaaatacaatcagtaattaatcagccgacatagtccatttgagaagggagaagattgttctaagagaagctcattatgaaaaactaggaaaaatgaagactcttttcgagccctctgcctcctgctttaccaaacacaggttctagattgccarttccacactcggatggtctgatcatcggaggcactcagaatccagggatattcctgaaagatattccagacaaaggctttaaacattaaacaaatctgttctatcaggttcttgtaatcatttttctctaaagaactgcattgcttaacggctcagctacattagcaaaggggctgctgcttttgctatcaggttagctgtctccttttctctaccactctaacagcttttctcaacttcggcactttcacctataagacttaagaatggaagccagttagaggcacaatacattctcag

SEQ ID NO: 167164 - DNA, 601 bp, Human
acaggcatgagccatggcgccgggccaaggccatcactttaaatggtccctaactcttcatggaaagttctatgtaaagctccagctccaaacacaaaataagacaaaggtctagaccttgactcaggttttatgggaaaataattgaaaaccagctaaaagttcttgttctaaaaggctatatgacttctcttcctggtaagaaattattggaagtccagattcatatatgggattgcctctacatttattattttgcacttaaaagcatcctacaaatacaatcagtaattaatcagcygacatagtccatttgagaagggagaagattgttctaagagaagctcattatgaaaaactaggaaaaatgaagactcttttcgagccctctgcctcctgctttaccaaacacaggttctagattgccagttccacactcggatggtctgatcatcggaggcactcagaatccagggatattcctgaaagatattccagacaaaggctttaaacattaaacaaatctgttctatcaggttcttgtaatcatttttctctaaagaactgcattgcttaacggctcagctacattagcaaaggg

SEQ ID NO: 167165 - DNA, 601 bp, Human
attgcaaggttattacatagtaatccatgcacttcacacattcaagagcaagtataaaccccatggggtcacactccctctcttctctgatctagggcccttaattttgatgtaaaaatgttctctgtctgcaaaaggtaaagaaaagtatttcatgccttgagcatttcatgaccaccaagaatccaaccacctgactgcccccaaactgcattggctagactgcagggaacatgcaaggctggcatcaggtggcacaaacattacttttacagtggagcccttctcaacccggcgttckggaaaagaattaagttttaatgcccgaaaggcatcagtttaggtatgtaacaaattctctatgaactagaatagcattagctatataccattcttagaagaactacgaaaacagccactgaaagtactttctatagcacttaattctctcacagaatccaggttgacaaaggatattctgaataattgccggccaggggcagtggctcgtgcttgtaatcccagcactttgggaggctgaggcagctggatcacttgaggtcaggagttcgagactagcctggccaaaatagtgaaaccc

SEQ ID NO: 167166 - DNA, 601 bp, Human
atgagaaaaaaagaattgagactaaaatcctatattttgaagtattttgggggaatagtggaagatgaaattacctagcacttgtaaatattttttaaaaagacagttatgtgtaatggaaaataaaaactctcattgaaaataaaacctaaaggctgggcgcagtggctcacgcctgtaatcctagcactttgggaggctgagacaggtgaaccaccgcaggtcaggagtttgaggtctgcctggctaacatggcaaaaccccgtctctactaaacatacaaaaattagtcgggcatgayggcgcatgcctgtaatcccagctgctagggaggctgaggcaggggaattgcttgaacccggggggcggggctggggggggcgcagcgcggaggttgcagtgagccaagattgcaccactttactccagcctgggcgaaagaacgaaactccgtctcaaattaaaaaaaaaggaggctgggcacggtggctcacacctgtaatcccagcactttgggaggccaaggcaggtggaacaactgaggtcaggagtttgagaccagcctggctcaaatggtgaaaccctgtctctactaaaaata

SEQ ID NO: 167167 - DNA, 601 bp, Human
actgagataactcactatcttcggactaggctcaagaaattttaaaggaaagccatttgaggttggcgtggtggttcacgcctataatcctagcactttgggaggctaaggcaggtggatcgcttgagcccaagagttaaagatcagcctgagcaacatggcaaaaccccgtctctccaaaaaatataaaaattagctaggtgcagtggcgcgagcctgtagtcccagctacttgggaggctgagagatagggggatggcttgagcccaggaagtcgaggctgcagtgagccatgatggcrccactgcactccagcctgggtgacattgagaccctatctcaaaaaagaaaagccatttgaagaagccacagtgcagtgtttctcaacttgaagcctttcgacagctgatgggggaagttccaaatgggttacagaaactaggcctattaagtacaaaacagctgtttggtagaagataacgtaaaaccataagccatgtaaaaagtgtactcatgcctactacttgactcttggacgaagaacaagataattaaaactgtcatgtcattttaagttcctgcttaaaaggctgattataga

SEQ ID NO: 167168 - DNA, 601 bp, Human
cttcagttaatgcccactttccattcttcagtgttcttgaaatgtggccccaaatggtaaacattcaatttctactctcaacttcataaaatttatagcagcttttccccgatcatttcagaaatttttttcttttttttaaagaatagtcaagtgcagtagtgagaatggggaaaagagtggaacaaggagttcaatctgtaactgactgtgaacaatcaactgagataactcactatcttcggactaggctcaagaaattttaaaggaaagccatttgaggttggcgtggtggttcacrcctataatcctagcactttgggaggctaaggcaggtggatcgcttgagcccaagagttaaagatcagcctgagcaacatggcaaaaccccgtctctccaaaaaatataaaaattagctaggtgcagtggcgcgagcctgtagtcccagctacttgggaggctgagagatagggggatggcttgagcccaggaagtcgaggctgcagtgagccatgatggcgccactgcactccagcctgggtgacattgagaccctatctcaaaaaagaaaagccatttgaagaagccacagtgcagtgt

SEQ ID NO: 167169 - DNA, 601 bp, Human
aaatatttgttgaaggaatgaataaatgaacaacatactgtgactttcccaagatgacagcccatattcagcccctggctataaagataagtacctctagtacatgcttcaccactgcatctgtagttccaaatagatcaaccccagttattcctctcacatccgattccaccgcaccaggggacaggttttttttcctcagacctttgaagggataaggagtgggatgaaagatgtaaacataatattatctaaaacagcacagtatcagaaacacagaaattacagtgaaaaagaaaaraaaaagaaatggaaaagactgaagaaagaaaagagactcaagaattcctatttctaaaaatgttcaaaatattgaagtacattcaccgtcttctcttctgctcccttaacacttaaacagatccattactggaatttctttctagaggagggtaacccaaatttctggcacactttaacctcttcttccacaaatcttacctcaagaggtgtctgcttcagttaatgcccactttccattcttcagtgttcttgaaatgtggccccaaatggtaaacattcaatttctactctcaacttc

SEQ ID NO: 167170 - DNA, 601 bp, Human
atttatcttcttcattcttattctttcgtaagtatacaatagagtttcccagcacatgatatgtgatatcatcgctctgacagctaatagaatgtgtgctgatatatttcatgtttttaaaagttgttttaatctaaaatgtggtaaaaaattgacagatataacccacataaacaaaaactctttggggtcctcaataaattttaagagtataaagagatcttcagaccaaaaagtttaagaactgctgattttaagatactgtataccctatttatacagttatatggtatattgtgayagaatcctggataaggcagttttgaattagcagtattattgagatgtatcatgatgcagcgaaaagcacctgggttttggagtcagatcgaaattcaaatcttatttcttacatttatttactagatatatgtagattttggtagaccacttaatttctctaaatctcttttttttttttgtctgctaaatagggataataatatctacttcagtgggtagctatgaagattagataattttttagaacaaaaactagtttctttcccttatgcttttctgttttcccacctgcacaaaa

SEQ ID NO: 167171 - DNA, 601 bp, Human
attctcatgtgaatttccaaatacatatttctaacccctaaactcagcctcatttgcatttaggatattctgctttgttttttacttgcctatttttatcttatttctacaaataattattaatatctccagacaaattttattttttattttttattgtttttagacggagtctcgctctgtcacccaggctggagtgcagtggcacgatctcagctcactgcaacctctgcctcccgggttcaagtaattctctgcctcagcctcccaagtagctgggattacaggcacccaccaccayacccggctaatttttttgtatttttagtagagatggggtttcaccatcttggccaggctggtcttgaactcccggcctcatgattcacttgcctcggcctcccacagtgctgggattacaggcgtgagccactgcgcccgcccgaaaacttttataacttaatgcagaaatctcagtctggtcttgaaggagctccaagattattttaagaagtttgcaaggtaaaaactattttcataatattactaagactttgtcttcttcattctttttttttttttttttttttttaagatgagg

SEQ ID NO: 167172 - DNA, 601 bp, Human
gcgggatacaaaatcaacatacaaaaatcagtagcatgaccaggtgcagtggctcatgcctataaacccagcactttgggaggccaaggtgggcagatcacttgaggtcaagagttcgagaccagcttggccaacatggtgaaacctcgtctctaaaaaaagtacaaaaattagccaggtgtggtggtgtgcacctgtagtcccagctactcgagacgctgaagtatgagaatcacttgaacctgggagggggaggtttcagtaagccaagatcgagccactgtactccagcctgggcaayagagcgagatcctgtctcaaaatatcagtagcatttatatatgccaatagtgaataatctgaaaaaaaatcaagaaatcccatttatagtaactacaaaaaatataaaatgcccaggaatcactctaaccaaagaagtgaaagggccatacaaggaaaactataaaactctgatgaaaaaagttgaagaggacccccaaaaatggaaagatagtccatgcttgtgggttgaaagaatattgtaaaaatgatagggtaaattactacctaaagtaatttacagatttattgtattccccat

SEQ ID NO: 167173 - DNA, 601 bp, Human
gaaatgaatacaacagaacactgctctttttgattttatttgtactttttggcctgggatatgggttttaaatggacattgtctgtaccagcttcattaaaataaacaatatttgtaaaaaaaaaaaaaaaaaaaaaaaacaaaaaaaaaaaaaaaacactaatgtgcaaaaagaaaacttttcaagatataaaacccaagatgtaaaattaagttcatagacaaacccagaagactatattactataatggtggtacacaatccacttataactttactatgaagcccaaaagacaaatmtatcaaaagcaataatagctatagcaacatgttaaagagatagtcaaaaaggcaggaacagaaatggagttaaatgtataatttctgagtgtgttttagcctttgtttttgttcttgtgtttgtgatataaaataagctgtcatctctttaaaataccttattctatctataagatttttttttgtgaatctcatggtaattacagcacaaaaactattaatatatactcactaaaaataaaaagcatcaaattaagacatattaccaaagaaaatcacttaaccacaaaagaagacagt

SEQ ID NO: 167174 - DNA, 601 bp, Human
acagtgctgagattttcatcagcaacaacccagaactcaaatatgacaatgagacagttcctggggccacagagagatgaaaaaactctgagcagatggtaagagcatctgatttccacatctgcaatggccctcccccaactcatggtttctacactggaaaaagtgagactgaggaggtcaactaccttccccatcttcctgggtgccctggcaggagatctaaccttgacttaacccatgggaagcatcacgactgcctgaaaggggaaatatccctgaggacaggcagagagaaagsggggaggcaagactatcacacccagccccagaaactctgctctgttacttggccaaaggagatgccaaatcagagtggctgctcagcagcactgcattgcaggaagtatattccacaggtctgcccatacacgaacctctagccagccttgacacacagctgggataatccctttgggacctccccattcaggacagacaatgctctggtcatttactaaagccaaggtgaacccggacttaaggtgtcacctaaagccaaagaggaggaagtgacctagcagtacagatttgctaagca

SEQ ID NO: 167175 - DNA, 601 bp, Human
aacagactaggaccctgatattctggtaccccaccctgaggactcatcaactgagtactcaacctctggaaaggaaaaaaaaaagacatcaaagaaaagacactataggaatgcaaatgtttattggaaaaagaagaaaagaaaaaacactcaagaaaactcagagtatgggactactagatattaaagaagaacagattagacaatatagttatatgaggaaagacatttaacttcattccttttaacttggccacgagggcactaaaattagaatgtcatttcttttttttttttttttgcaaattctgttgcaagaaacagagaggagtcattgatgactctgaagccaaccccactgatatgaacttcctctcaaaataatagttcttctattttcacccaaaggaagggatcaaggtaaacattttctttccataggaaatatatatatatagtctaaacattctctcaaattatttctagtgatctgggtcattcattctgatgctccattaagttcagctttaggaaagataggcagttcacaaatgctcaatatgtttacgacaactgaaacctacctgatttgagtctctga

SEQ ID NO: 167176 - DNA, 601 bp, Human
aagatttagtcagaaatggcttaactgactaatttataagggagactttgacttatggataccaaatacaaatatcttttctttctctcactatgaacacatttaaaagagaggagatcgattagcaacaataataacccaggggcacccacaaaagaaacagagctagcaaattatttcttaggaatctgttgatggggtctaaaatatcattaaaatatgccagtaagagtggggatctgcagaataaatctctgacctggtactagccataaacccgctggaagaagtgcacccaaargaccataggcaatagtcaaatccattctgagaatgttttgtcagcaagttctaatcacaaggacatcaacaagggatagtggtaatggaagaggtaggcaggagtctcagctggatcctgggatcccaggtggggtgtggggctgttagcagcctcatctttttgacatgcaaaaggaagcaaatcggatctggatgtggataggacagtataaatccctagtcccaggatgaggcattataagattggaaccacatttttaaataaatgaaactaccagggtgaaagtcatatcaactg

SEQ ID NO: 167177 - DNA, 601 bp, Human
tcaattaccactgcagacagaccatgccaaccaagatcttctctaagggccttaatacattattttttctcctccaactaaaacatcctgagaagtcccaactaaagtctgaatttctcaatgaatgagagagagaaaacactgtttctggggcttaaattttgttaaatattttcttcagagtgctttatcttgtgctggacctattacatttcaagtaacaatggaggcagcagaaggagggaaatttcctcatccagcccactcacttcagatttgatgcgttttgggctcctgtagycaagagtgactttagcttggttcttaaacccagagccacggcgatcatcaacccaatcaaatcagttttaatgccattcccccaagagggcttagtgtagggctagagacagaggtacagccaatacatgagaatcacggctgcccgggggagaacagaaaaaacaatggtctttattttgcaatacacaggccactgccaccacactccccaaattagtttctgcttttagtcttaactcaccgaatgcatccgatctaggacagcaaaccgatttcgagcgacccaaacggctgtcag

SEQ ID NO: 167178 - DNA, 601 bp, Human
gttctggccaacactttgactgtagcctcatgagagatcctaagccggaggcacctagctaagccatgccacaaattgtgaaataataaatgtttgtggttttaaactactaaatttggggataatttgttacacagaaatagagaactaatatagctgcttatctttgagacgtatccatccgtgctgagaaccttggatatccctgactcctctctgttacatctcaaatctagttaccgcaataaatcatgttgtttctaccttaaaatatatcctgaatctgaccactgctcacccstccactaatagcgccttggtccaaacctcatctttcaccttgcttgtttcctaatgtatcttaaatgctaatataatgcttggtatatagtgggttctcaaaaaatatcccttgactatatacatgaataaatgagtgaaacctccaaactgaaaataaagaataaaattctaatggcatccaaccaagtgcatttactagggcgtccactcaagaccttttaaaacctcctatctcccccatgaataactattctcctaagggtgtttggctggactgaatattctggctgcacctccc

SEQ ID NO: 167179 - DNA, 601 bp, Human
ataaaatactgaacaaagaacatgactacatatatagtaaaacctaagaaaatacaccaaaatattaaccgaagttattgatggtagtagagggatccctttttttctccctattttccaaattttctttaatgacctgaaaatgctatcttaagtttttaagactgcaccataaatgactggcatttcaatattccattaggctccatgcagaaaaaaaggacaagttaaactaaatgctaatggtattctctaggacagttcttcacaaaacaaacaacaaaagtgctatgggagaaayaggtacttacctttgctggcaatggtgccttcaaaaaatcctttggatacagtcaataaaggccaattggtatccaatggcatgataggtgcaggtggctggagcagcttggcattagggtcaatgtctgggatctgaatagtagaagaaaagaggctaaaaacaaatagcacttggaagtcacgtaaggaaagttatggagcctcctttgatctcatttgtttctctgcctctcctggtaaccaggtgggagagtgacattcataattttaaattgttctaagatcctagagttaatcc

SEQ ID NO: 167180 - DNA, 601 bp, Human
taaagagttttcatgaaaaatatacacctttccccttatgggtaggataatttcccttgattaaaatgagtcaaccatctcccggggaccctgggctaggcacactcaagaggaaaagccaaggttacttacccgcatggctgtttcgaaagagcctgccaggatgtgatcaactggaagctgagagttattacaccagatctaacaagaaacaaaaaaacccaagccaagtgaaactttgtcccttctctattctcctctgtaactatagtagaaaagtagccaacacctgttatatacyaatcaagtattagccactcatccctgccgtgctaggtttcttcccgcttacctgagttggacttgttcccttggttgggggcacaaagaaaccatcttcagccccaccagctgccccaggggatatatcctaggggaaaaacaaaaattgagtattgagtaattttttttttttttttgagacagggtcacactctgtcacctagactggagtacagaggcatgatctcggcacactgcaacctctgcctcccatgctcaagcaatcctccaacctcagcttcccgagtagctgggactg

SEQ ID NO: 167181 - DNA, 601 bp, Human
aaactggattacccctacttggtcatgaaggagctggaacagaaggaaagaaacaaggattttggccctgctgcataaaaagctacttttccttgggcaaggtaattaatttctctgttcacgtttcctcatcagtaaaatacacttaattgtaagacctacctcatttaatgatacctattaaagtatttaggatagtgcctggcacacagtgaacattaaataaacgttagcagttattgcagtgttatcattattgttgttattataacaatactggcttagtgttcaaaacagaccyctgcttggaaaggggtacttatctcactgatatgagccagaaagcaagctataaatgggtggaagatgactgaaggatatgccctaagagattactaggccaagtggaaggcagataacaggaaggcaagtgtacttaacaaagataaagagttttcatgaaaaatatacacctttccccttatgggtaggataatttcccttgattaaaatgagtcaaccatctcccggggaccctgggctaggcacactcaagaggaaaagccaaggttacttacccgcatggctgtttcgaaagagc

SEQ ID NO: 167182 - DNA, 601 bp, Human
tcgggtctaggggaaggaaggagtatttaggaggacagaaggctgcagacaacacctcaaaggatcccaacaccatggtttggtagttccgttgatgtgagacacaactgtactgcgtgaaaagaggtcccaacctctgtactggatgtatgtgaagggttaacaatcaccattcctattgtatcaaactttccccttctcaatacaaaagtggctccataatctagacccacattcctccaccaactctagagattatcagggtcaggtcctagaaagggttaaaacagacttccatcayccaaaaagaatgcatttggaggacacaagtaatgagatgtgtatgtgaagctttgtggtggttgtgatgggatatctggagcttaaggacaggactggggttactttcagctgcagtggagctattctaggttgcacggcactcttagacgagtgccatgtctcaataaactattaattttccaggaacaaaggaaacaccaagtcaggaagtaaacagagggtagcattctgttggctttttgttgaatgttgttatttattgctttgtttcagaggcaaggaccttggtctgctccct

SEQ ID NO: 167183 - DNA, 601 bp, Human
aaaacacaatcatgcctttacaacagtcccacaaaagtttaactcattccagcataaacccaaagtcaaagtccaaagtctcatctgagacaaggcaagtcccatccacttagaagcctgtaaaatcaaaagcaaatcagttacttctaagatacaatgggggtacaggtattggataaatgctcccattcaaaatgggagaaattggaccaagaagcagcttctccgctccttctaggatctccgcctggttcggcccgcctgcctccactcctgcctccaccatgtccatcagggtgayccagaagtcctacaaggtgtccacctctggcccccgggccttcagcagccgctcctacacgagtgggcccggtgcccacatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagtttgcctccttcat

SEQ ID NO: 167184 - DNA, 601 bp, Human
agcataaacccaaagtcaaagtccaaagtctcatctgagacaaggcaagtcccatccacttagaagcctgtaaaatcaaaagcaaatcagttacttctaagatacaatgggggtacaggtattggataaatgctcccattcaaaatgggagaaattggaccaagaagcagcttctccgctccttctaggatctccgcctggttcggcccgcctgcctccactcctgcctccaccatgtccatcagggtgatccagaagtcctacaaggtgtccacctctggcccccgggccttcagcagcygctcctacacgagtgggcccggtgcccacatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagtttgcctccttcatagacaaggtacagttcctggagcagcagaacaagatgctggagaccaagt

SEQ ID NO: 167185 - DNA, 601 bp, Human
tctcatctgagacaaggcaagtcccatccacttagaagcctgtaaaatcaaaagcaaatcagttacttctaagatacaatgggggtacaggtattggataaatgctcccattcaaaatgggagaaattggaccaagaagcagcttctccgctccttctaggatctccgcctggttcggcccgcctgcctccactcctgcctccaccatgtccatcagggtgatccagaagtcctacaaggtgtccacctctggcccccgggccttcagcagccgctcctacacgagtgggcccggtgcccrcatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagtttgcctccttcatagacaaggtacagttcctggagcagcagaacaagatgctggagaccaagtggagcctcctgcagcagcagaagacggc

SEQ ID NO: 167186 - DNA, 601 bp, Human
tcccattcaaaatgggagaaattggaccaagaagcagcttctccgctccttctaggatctccgcctggttcggcccgcctgcctccactcctgcctccaccatgtccatcagggtgatccagaagtcctacaaggtgtccacctctggcccccgggccttcagcagccgctcctacacgagtgggcccggtgcccacatcagctcctcgagcttctcctgagtgggcagcagcagctttcggggtggcctgggaggcggctatagtggggccagcggcatgggaggcatcaccgcagtcayggtcaaccagagcctactgagcccccttgtcctggaggtggaccccaacatccaggctgtgtgcacccaggagaaggagcagatcaagaccctcaacaacaagtttgcctccttcatagacaaggtacagttcctggagcagcagaacaagatgctggagaccaagtggagcctcctgcagcagcagaagacggctcggagcaacatggacaacatgttcgagagctacatcaacaaccttaggcggcagctggagactctgggccaggagaagctgaagctggaggcggagcttggcaa

SEQ ID NO: 167187 - DNA, 601 bp, Human
gcagaagacggctcggagcaacatggacaacatgttcgagagctacatcaacaaccttaggcggcagctggagactctgggccaggagaagctgaagctggaggcggagcttggcaacatgcagaggctggtggaggacttcaagaacaagtatgaggatgagatcaataagcatacagagatggagaatgaatttgtcctcatcaagaaggatgtggatgaagcttacatgaacaaggtagagctggagtctcgcctggaagggctgactgacgagatcaacttcctcaggcagctgtaygaaaaggagatccgggagctgcagtcccagatctcggacacatctgtggtgctgtccatggacaacagccgctccctggacatggacagcatcattgctgaggtcaaggcacagtacgaggatattgccaaccaaagacgggctgaggctgagagcatgtaccagatcaagtatgaggagctgcagagtctggctgggaagcacggggatgacctgtggcgcacaaagactgagatctctgagatgaactggaacatcagccagctccaggctgagattgagggcctcaaaggccagagg

SEQ ID NO: 167188 - DNA, 601 bp, Human
gaagtctgggatgcagaacatgagtattcatacgaagaccaccagcggctatgcaggtggtctgagctcggcctatgggggcctcacaagccccggcctcagctacggcctgggctccagctttggctctggcgcaggctccagctccctcagccgcaccagttcctccagggccgtggttgtgaagaagatcgagacatgtgatgggaagctggtgtccgagtcctctgacatcctgcccaagtgaacagctgtggcagcccctcccagcctacccctcctgcgctgccccagagcctgrgaaggaggccactattcagggtagcactgggaacaggagacccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaaaaaaaagggagaaattcgccaaaacaaaggggcttcaagttccatgcaagtctaaaatccagtgtggcagtcattaaattttaaagctctgaaatcatc

SEQ ID NO: 167189 - DNA, 601 bp, Human
tgcctgatggcctcacagccctgctctaaggagcccaaactagcaatcacagggttacatgaggaaggaacctcgagtctctagaagattaaaataagaagatgcagtaaaaaggaggcttatagccatgggacatctcaccgattctcggaagccatcatacttgtagacatggccattctttgtaagcagtttaagtccatggcccagagcaacacggcgccagataccttctgttaactccccagcctggatgttgtccactttgcctgtcttgctattcttgaagatgatgccctgrcggctcaacctcagtcgaccatcattctgtaagaaaagcaggcccagatgcatggagacagtacacagcatgtcctgggttctacagctctacctaacacacattcctgctgcaagtggactggccagattatcaatgcaggagcaacagctgagggtgccaaggagtctagattctaaaccagactctggtatctagaacccttaacagattctcagtttcctcatttgtaaaacaggaattgggaactgaacagcatatacggtccctataactctgagactatctctcagtattgcc

SEQ ID NO: 167190 - DNA, 601 bp, Human
gacttagcaacccagctcatggtaagattgttgaaagagattgcttctagccactggatctgacattcctggttacgggccatctgactttataaactttgtataggtattactttaatgaaagtggaaattaaaatcaaataaagcctttaactcaagcagttcaaaaaggaaaacaaaacccacactttaagatatcaagctagccaggcgcaatggctcacgcctgtaatctcaaccctttgggaggccaaggtgggcgatcccttgagtctgagagctcaagaccagactgggtaaygtggcaaaacgccgtttctaccaaaaattattaaaaatcagctgggcatggtggcatgtgcctgtggtaccagatactcaggaggctgagatggaaggattacttgagcccaggaggcggaggctgcagtaatccgagattgcgccactgcactccagcctgggtgacagagcaaggccctgtccccaaaaaaaaccaaaaacacacatacacacaaagaaatcaagctaagattctgaaccttgataaaagccacaggcagaaactactatctaaatcaagacagaagaaaatcttctg

SEQ ID NO: 167191 - DNA, 601 bp, Human
tgcctgacagagggtgcagggagcctggttagtgccaacctcagcagaggcaaagggcgtatctagcagcagcgacacgagtgctcatgtcctcgactaagtaaacctcactgagctgttctgacagaggcgctggcacctattgtgacacaaggtcccatccaggcctctaggaggccgcattcccatctcaggaagggtttaccaaggagacacggcatttcccatacccaggcagggcaggatcccaggcccacactctcacccttggaagttgcctggcactgtgatcttgcggttyaccagtgctttcatgacccggctgaccatctcatagagggatcctgacatgttcttggtgagccgaccctcaaagcgcttctccacttcttccctacaaagaaagcaaggtgaggtcacaacactactgccttctaatggcacacctgtctcctgcctggacagtggtaggaaacgagtccagggagacactcactcgttcatgttcagagtcaacgaaatgtcctcgtccttggagaagaggaggatcaggaagtggtagcgagtttggccttgcttgattgggggatccaggctgatc

SEQ ID NO: 167192 - DNA, 601 bp, Human
cacaggatgcatcagcttctgccccaatggaaatccccccacctcacccaggcacccagctctggcccaagggtgagtccagcccgggccacagcgaggagcgtctgaccatcctcgtgctcagcacggaggctaacccaccggtttcttctcctgagtcatcgctgctgtcattggcattctcctcccggatcttgccttcctccttcatcctctccaagtaggcatcatgctggtcctcatcagagtcagcatattcatcgtagcttgggttcatgccctagccagggaagagttcacrgtggggccaactcaccctcgagccagaatccctgcacactcaaaagcacacccccatgcctgtcaagtcagagcagcagctcccagaagacctggggctggattgtccacacacagccaacgtgcagggcctatgcccaagtacttcctgccaactgggttagtccaagccccaagcccctccctctcccagccccactgggggctcctgaggggctgcatagactggtctaaggtcatgcagaggaaacctgcaccaggagggggaaagggtcacacgcacctcttttttctataaggg

SEQ ID NO: 167193 - DNA, 601 bp, Human
actcctcaaacaatgcaactaccttacacctgtatgctgctggacagtcttcaaggcactttcacaagtatttgctcattaaaccttcataaaccttcataagcatgtggcaggctgaactagaggactcctgttgggtgttttttttgctgcccgacattcttttacaatccttctggattaagagagcagagtcccaattttctgttgggaaccaccttgcccccactcaggaagggcttaccccaaccacaggctctaagggtgggcacttggcctatttctggcccatcagaccccrgcccattctaataactcaggctagaaaggggcaggtaaccactgtgttcactatgctgttcaccaaaagaggcacttctggtgttgttttaaaccagtaggattaagcctgccctgagcttctgagagtcactgggcaccccatggggtaaacctatttttaattaaggaaatcggaagaaatagatttgagcgcctgaatccagtagtgtctgaagccaattaaatccccagactccgcagtaatatgaacttatgaaattcccttttatatgttcccttttaaagtgagagtgaatca

SEQ ID NO: 167194 - DNA, 601 bp, Human
catcgtaacaaggctggagggtggcacatttcacacacgcacgtaacacccaaccattatgtttatgaactacaaaaggattggcccctacagtcttctgatgaaaagataatcagttactacaaaaagaggaaaaccaacttcagtccaacccagtgcctacccctgtaattgacagtcttgtctgatatatgtgaaactcctcaaacaatgcaactaccttacacctgtatgctgctggacagtcttcaaggcactttcacaagtatttgctcattaaaccttcataaaccttcataarcatgtggcaggctgaactagaggactcctgttgggtgttttttttgctgcccgacattcttttacaatccttctggattaagagagcagagtcccaattttctgttgggaaccaccttgcccccactcaggaagggcttaccccaaccacaggctctaagggtgggcacttggcctatttctggcccatcagaccccagcccattctaataactcaggctagaaaggggcaggtaaccactgtgttcactatgctgttcaccaaaagaggcacttctggtgttgttttaaaccagtagga

SEQ ID NO: 167195 - DNA, 601 bp, Human
atgagtacaccagaagaatcagagggcacagcctaaagcagcccaatgtgcaaaacctacttgatatttcttgctttatcttttagagttcatgcaaactgtgcactgcactccataatagtatttttttcgttcccccataccttcaaataaaatggtccaggaaaagaggccatatttccccagtgacttgaatgccctattgtgtcacccatacttgggcaatggcctacccaggtttgagaagcactaccctactgcagtcagaagcatctctgctgtctttaactttccaatgctyaacttcggcctgttaaaaaaaaaaaagtctgccacaaaaatcagtgactgggccatgttctcgacactcacctcttagaagactcgcctcggcccccttcatattctttcatggctttttcatagtccctcctggcatcctcagccttgcgatcccactcctgtctcacacacagaaaaaaacagttaagaataagacctctcccatctcccctctcccctgatgcaggcaaaatcgatacagaaagtcccaccaatggctcatactgctcccctatcagtcatgagactcgccacccca

SEQ ID NO: 167196 - DNA, 601 bp, Human
catgagtacaccagaagaatcagagggcacagcctaaagcagcccaatgtgcaaaacctacttgatatttcttgctttatcttttagagttcatgcaaactgtgcactgcactccataatagtatttttttcgttcccccataccttcaaataaaatggtccaggaaaagaggccatatttccccagtgacttgaatgccctattgtgtcacccatacttgggcaatggcctacccaggtttgagaagcactaccctactgcagtcagaagcatctctgctgtctttaactttccaatgcycaacttcggcctgttaaaaaaaaaaaagtctgccacaaaaatcagtgactgggccatgttctcgacactcacctcttagaagactcgcctcggcccccttcatattctttcatggctttttcatagtccctcctggcatcctcagccttgcgatcccactcctgtctcacacacagaaaaaaacagttaagaataagacctctcccatctcccctctcccctgatgcaggcaaaatcgatacagaaagtcccaccaatggctcatactgctcccctatcagtcatgagactcgccacccc

SEQ ID NO: 167197 - DNA, 601 bp, Human; identical to SEQ ID NO: 29461

SEQ ID NO: 167198 - DNA, 601 bp, Human; identical to SEQ ID NO: 29462

SEQ ID NO: 167199 - DNA, 601 bp, Human; identical to SEQ ID NO: 29463

SEQ ID NO: 167200 - DNA, 601 bp, Human; identical to SEQ ID NO: 29464

SEQ ID NO: 167201 - DNA, 601 bp, Human; identical to SEQ ID NO: 29465

SEQ ID NO: 167202 - DNA, 601 bp, Human; identical to SEQ ID NO: 29466

SEQ ID NO: 167203 - DNA, 601 bp, Human; identical to SEQ ID NO: 29467

SEQ ID NO: 167204 - DNA, 601 bp, Human; identical to SEQ ID NO: 29468

SEQ ID NO: 167205 - DNA, 601 bp, Human; identical to SEQ ID NO: 29469

SEQ ID NO: 167206 - DNA, 601 bp, Human; identical to SEQ ID NO: 29470

SEQ ID NO: 167207 - DNA, 601 bp, Human; identical to SEQ ID NO: 29471

SEQ ID NO: 167208 - DNA, 601 bp, Human; identical to SEQ ID NO: 29472

SEQ ID NO: 167209 - DNA, 601 bp, Human; identical to SEQ ID NO: 29473

SEQ ID NO: 167210 - DNA, 601 bp, Human; identical to SEQ ID NO: 29474

SEQ ID NO: 167211 - DNA, 601 bp, Human; identical to SEQ ID NO: 29475

SEQ ID NO: 167212 - DNA, 601 bp, Human; identical to SEQ ID NO: 29476

SEQ ID NO: 167213 - DNA, 601 bp, Human; identical to SEQ ID NO: 29477

SEQ ID NO: 167214 - DNA, 601 bp, Human; identical to SEQ ID NO: 29478

SEQ ID NO: 167215 - DNA, 601 bp, Human; identical to SEQ ID NO: 29479

SEQ ID NO: 167216 - DNA, 601 bp, Human; identical to SEQ ID NO: 29480

SEQ ID NO: 167217 - DNA, 601 bp, Human; identical to SEQ ID NO: 29481

SEQ ID NO: 167218 - DNA, 601 bp, Human; identical to SEQ ID NO: 29482

SEQ ID NO: 167219 - DNA, 601 bp, Human; identical to SEQ ID NO: 29483

SEQ ID NO: 167220 - DNA, 601 bp, Human; identical to SEQ ID NO: 29484

SEQ ID NO: 167221 - DNA, 601 bp, Human; identical to SEQ ID NO: 29485

SEQ ID NO: 167222 - DNA, 601 bp, Human; identical to SEQ ID NO: 25183

SEQ ID NO: 167223 - DNA, 601 bp, Human; identical to SEQ ID NO: 25184

SEQ ID NO: 167224 - DNA, 601 bp, Human; identical to SEQ ID NO: 25185

SEQ ID NO: 167225 - DNA, 601 bp, Human; identical to SEQ ID NO: 25186

SEQ ID NO: 167226 - DNA, 601 bp, Human; identical to SEQ ID NO: 25187

SEQ ID NO: 167227 - DNA, 601 bp, Human; identical to SEQ ID NO: 25188

SEQ ID NO: 167228 - DNA, 601 bp, Human; identical to SEQ ID NO: 25189

SEQ ID NO: 167229 - DNA, 601 bp, Human; identical to SEQ ID NO: 25190

SEQ ID NO: 167230 - DNA, 601 bp, Human; identical to SEQ ID NO: 25191

SEQ ID NO: 167231 - DNA, 601 bp, Human; identical to SEQ ID NO: 25192

SEQ ID NO: 167232 - DNA, 601 bp, Human; identical to SEQ ID NO: 25193

SEQ ID NO: 167233 - DNA, 601 bp, Human; identical to SEQ ID NO: 25194

SEQ ID NO: 167234 - DNA, 601 bp, Human; identical to SEQ ID NO: 25195

SEQ ID NO: 167235 - DNA, 601 bp, Human; identical to SEQ ID NO: 25196

SEQ ID NO: 167236 - DNA, 601 bp, Human
gaagtgcaggatcccaggagaaaggtaggtaggggtgtgtgtatgtgcgtgtgtgtgtgtgtgtgcacgcgcaagttggtatcacatactcagcagatgatgtagttatgagcagggagtttggaatcagagaccttgttttgacccctagctgtttctcccatttctgtgagaccctggactagttaatatgtgtcggtatgagtttctctacctgtgaaatggagctaatgcgtggtttctcagtggaggatctgttgacattggggctggataattcattgctgaggggctaccctgygcattttaggatgttttgcagtatatctctagcctctacgcactagattccggtagcatcttccctgctgtctccctgtgacaaccaaaaatgtctctggacattgccaaatatcccctgggagtcaaaattgtttcagagccgctggcctatactacttctctctccctcccttcctgcctcccttctttcctccttccctttcttcgttcccttcctaatgtgtactgtttttccacacccactaatgggttgcaacccacagtttaaaaatttactgttctaaatcaaggagcacaa

SEQ ID NO: 167237 - DNA, 601 bp, Human
tttaaaaatttactgttctaaatcaaggagcacaagttcaaatgtctgtactagccaagcaagtgagtcaaacaggtagatatttacaggaaattgcaagaacatagataaatgacaacactcagcttcactgtttggaaaacaacttcctacagggcagtaattggtcagagattacagagtccctgactatccctcatcttctgcagagcacattcctgtgcacccccaccctcaccctgtattgccccttctctgaggaattagtggtggtggttctaagacagattgctcatctgcygcactgtcagaaattactctcttgtacaggacattttccacatccacaccttctcttcctgctttgagtattttagaggactgtgcctcgtagtaagaaaaaaatgaaactcagtttcttgaaccacaggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattca

SEQ ID NO: 167238 - DNA, 601 bp, Human
atgggcagtgtctgcagaggagggtcctgagaggactctgaagggggacccagcgctggggaaagaaaggacagagggaatgttggagctacagtatcagggatggactgcagagcaggtgaagaccttggcaggagcattaggtcactccaggaactagactgttcttctaatgagaccttagacaagtctctggcattcatcaactgctttagaataaaaataaccgggcaggtacagtaaaatagtgatgatgctatctacctcaaaagattaagaagcagaaagccaggctgggcgyggtggctcacacctgtaatcccagcactttgggaggccgaggcaggtggatcacgaggtcaggggttcgagaccagcctgaccaacatggtgaaaccctgtctctactaaaaatacaaaaattagctgggcatggtggcgggcacctgtaatcccagctattcaggaggctgaggcaggagaattgcttgaacctgggaggcggaggttgcagtgagccgagatgacgccactgcactccagcctgggcgacagagcaagactccgtctcaaaaaaaaaaacaaaaacaaaacaaaaaca

SEQ ID NO: 167239 - DNA, 601 bp, Human
cacctgtaatcccagcactttgggaggccgaggcaggtggatcacgaggtcaggggttcgagaccagcctgaccaacatggtgaaaccctgtctctactaaaaatacaaaaattagctgggcatggtggcgggcacctgtaatcccagctattcaggaggctgaggcaggagaattgcttgaacctgggaggcggaggttgcagtgagccgagatgacgccactgcactccagcctgggcgacagagcaagactccgtctcaaaaaaaaaaacaaaaacaaaacaaaaacaaaaaaaaaaacaaagaaggagaaagccgggccgggcatggtggctctcatctgtaagttcaaggagttgaaggtatgctaggactttgggaggccaaggccttcaagaccagcctgggcagcatggcgaaacctgtctccattaaaaaaaaaaaagttgggggtacggctgggcatggtggctcacacctgtaatcccagcactttgggaggctgaggtgggtggaacacctgaggtcaggagttcaagaccagcctggccaacatggcaaaaccctgtctctattaaaaacacaaaaattagcctggca

SEQ ID NO: 167240 - DNA, 601 bp, Human
aggtggatcacgaggtcaggggttcgagaccagcctgaccaacatggtgaaaccctgtctctactaaaaatacaaaaattagctgggcatggtggcgggcacctgtaatcccagctattcaggaggctgaggcaggagaattgcttgaacctgggaggcggaggttgcagtgagccgagatgacgccactgcactccagcctgggcgacagagcaagactccgtctcaaaaaaaaaaacaaaaacaaaacaaaaacaaaaaaaaaaacaaagaaggagaaagccgggccgggcatggtggytctcatctgtaagttcaaggagttgaaggtatgctaggactttgggaggccaaggccttcaagaccagcctgggcagcatggcgaaacctgtctccattaaaaaaaaaaaagttgggggtacggctgggcatggtggctcacacctgtaatcccagcactttgggaggctgaggtgggtggaacacctgaggtcaggagttcaagaccagcctggccaacatggcaaaaccctgtctctattaaaaacacaaaaattagcctggcatggtggcaggcgcctataatcccaactactcagg

SEQ ID NO: 167241 - DNA, 601 bp, Human
cagctattcaggaggctgaggcaggagaattgcttgaacctgggaggcggaggttgcagtgagccgagatgacgccactgcactccagcctgggcgacagagcaagactccgtctcaaaaaaaaaaacaaaaacaaaacaaaaacaaaaaaaaaaacaaagaaggagaaagccgggccgggcatggtggctctcatctgtaagttcaaggagttgaaggtatgctaggactttgggaggccaaggccttcaagaccagcctgggcagcatggcgaaacctgtctccattaaaaaaaaaaaagttgggggtacggctgggcatggtggctcacacctgtaatcccagcactttgggaggctgaggtgggtggaacacctgaggtcaggagttcaagaccagcctggccaacatggcaaaaccctgtctctattaaaaacacaaaaattagcctggcatggtggcaggcgcctataatcccaactactcaggaggctgaggcaggagaatcgcttgaacccaagagagtgaaggttgcagtgagctgagatcatgccacttcactccagcctgagtgaaacagcaaaactctgtctcaaaaaa

SEQ ID NO: 167242 - DNA, 601 bp, Human
gtctcaaaaaaaaaaacaaaaacaaaacaaaaacaaaaaaaaaaacaaagaaggagaaagccgggccgggcatggtggctctcatctgtaagttcaaggagttgaaggtatgctaggactttgggaggccaaggccttcaagaccagcctgggcagcatggcgaaacctgtctccattaaaaaaaaaaaagttgggggtacggctgggcatggtggctcacacctgtaatcccagcactttgggaggctgaggtgggtggaacacctgaggtcaggagttcaagaccagcctggccaacawggcaaaaccctgtctctattaaaaacacaaaaattagcctggcatggtggcaggcgcctataatcccaactactcaggaggctgaggcaggagaatcgcttgaacccaagagagtgaaggttgcagtgagctgagatcatgccacttcactccagcctgagtgaaacagcaaaactctgtctcaaaaaaaaaaaaaggaagaaagaaaaaaggccaggcgcggtgactcacgcctgtaatcgcaacactttggcaggccgaggcaggcgattcacaaggtcaggagttcgagaccagtct

SEQ ID NO: 167243 - DNA, 601 bp, Human
caggcgcggtgactcacgcctgtaatcgcaacactttggcaggccgaggcaggcgattcacaaggtcaggagttcgagaccagtctggctaactaacatagtgaaactccgtctctactgaaaatacaagaaattaccctggcatggtggtgtgcacctgtaatcccagctactcaggaggctgaggcaggagaatcgcttgaacctgggaggcagaggctgcagtgagccgagatcgcgccactgcactccagcctggatgacagagcaagactctgtctcaaaaaaaaaaggccgggcscggtggctcatgcctgtaatcccagcactttgggaggctgaggcgggcggaccacgaggtcagaagatcaagaccatcctggctaacaagatgaaaccctgtctctgccaaaaaaatacaaaacttagccgggcatggtggcaggcgcctgtggtcccaactacttgggaggctgaggcaggagaatggcatgaacccgggaggcggagcttgcagtgagccgagattgcgccactgcactccagcctgggcaacagagcgagacaccatctcaaaaaaaaaaaaaaaaaatggggcggg

SEQ ID NO: 167244 - DNA, 601 bp, Human
aaaaaaaaaaatggggcgggcgggccaggcgcggtgtctcacacctgtaatcccagcactttgggaggctgaggtgggcggatcacttgaggtcaggagttcaagaccagcctggccaacaccaggaaaccctgtctctgttaaaaatacaaaaattagccaggtgtggtggcacgcgcctgtagtcccagcaggagaataacttcaacctgggagacagaggttgcagtcagctgagatcgcaccactgcattccagcctgggtgacagaccgagactctgtctcaaaaaaaaaaaaaaagaagaatacccatatgcattcattaatatatagggctagagggctagagagctatagacataaaatagacaaaaaatttttttgctcatttttgggtcaaaggagtcttgggactctaattcttttaatttttgtgttatgtgaatttgttatcatttacatgtattatgttattaagtaggtaataatgataatactaataataaacttacaaaacgatccaatgtagttgttttcagactttgttcctcggagccctaggactttgcaaagctgtttctggagtcatggtgggagtgg

SEQ ID NO: 167245 - DNA, 601 bp, Human
attagggcttctatccccatctagctgcacactggagctgtgccaagcaaggttcttggtcttatgttgtacttaggcatcagcaaagcctgggaaaatatcttttttttttttttgagacagaatctcgctctgtcgcccaggctggaatgcagtggcaccatctcagctcactgcaacctccgtctcccagattcaagtgattctcctgcctcagcctcccgaatagctgggattacaggctggtcttgaactcctggcctccagtgatccacccaccttggcctcccaaagtgctgcrattacaggtgtgagccaccatgcccagctggggaaaatatctttaatctacttagtcctagaaaaattatctttcaagtgctttttttttttttttttcagtggactgaaggcttttgcagagcaaaagccaggaagttttgtcacaaacttccaccaaggccaggaagcagagtctattccgtgccaaaattaagggaagaaaagagggaaaatctaggcaaatggaatttaatatctcaaaaagattatcttgccgagccatagtcacatagcaagctgaggcagcggaggcttgggg

SEQ ID NO: 167246 - DNA, 601 bp, Human
acctttccttctcctgtttgaaacctacttgagtctcctgactttttttctgctgtagtcccatcattttggggtacatgcttacaaattcatcacttctactccttccatctgtatttccaccctatcttttctccttctcctttctctagccttggccaaggcagacattgtatattttaggctggaaacaggattctcaagtttcttcatgcatctctactatattgaatggcaaaatgtgagtcgtgttcctattctacacatctgtttctttttccagtcaactcatcagaagacyctggtggcttagcaagtcctgtgtgtatgtgggtacctgtgtacagcatacatatacatgtgtagacgtgtataagtatatccttgtatatgcatatatgtggtaagtgcatgtgtgcacatgagttaaatggcttaagtgcattagcagaaattgaacaatttagtttgatgagtagggagggagagaagacagaatatggagcccagaggatcccaactggcaagctatctcatccccagttaccagatatttccacctttttaggatggcaaaacacagacctatgagacagaaaac

SEQ ID NO: 167247 - DNA, 601 bp, Human
aagacttcatagaggagggtttttttcgagacagggtctcactctgtcactcaagctgcagtgcattgacatgatctcagctcactgcaatctctgcctcccgagttcaagcagttctcctgcctcagcctcccaagtagctgggactacaggagcccgccaccacacctggctaatttttgtatttttagtagagacggggtttcaccatgttagccaagctggtctcgaactcctgacctcaagtgatccacaccctcagcctcccaaagggctgggattacaggcatgagccacagcrcccagctgaggaggttatttttgaccattctttgctcagttatttatccactcatggacttatccacccatctatccatccctatctaatgtatttgaccattcatgactcatttagcagaaccaggacagcctgtataaggcacagaagagtgaatatatgtgacaggtccagagcattgttcaaattcaagatacgttgggggaggtataaatatgagatttttttcaaatcaattggaatggctatttaatcaaagccatagatgttaggtggaaagtaggaattaagaacttaaca

SEQ ID NO: 167248 - DNA, 601 bp, Human
atcccttgggagtagactgttgaaaccattgaggtgaggtgataggttaaggtgagcattctggacatataatatcaataataaatattcaaatacaaagcaggtataatatgaagagtaatttctatctccccaagccaatatgagttttgtttgtttgtttgtttttcttttgagataaagtctcattctgttgcccaggccggagtgcagtggcacaatcccagctctctgtaacctctgcctcccaggttcaagcgattctcctgccttagcctccctagtagctgggattataggygcctgccaccactcccagctaatttttgtatttttagtagagatggggtttcaccatgttggccaggctggtcatgaactcctgacctcaagtgctcgtccgtcttcggcctcctaaagtgctggcattacaggcgtgagccactgcacccagcctgagttttttttttttttttaagccaaaggaggaggagtagttttgtgcacaaaagccactatttagagttccttaggttttaaacagataattaatttaatgtactaacaaatgcaaaattaaaattttacttatgccttttaa

SEQ ID NO: 167249 - DNA, 601 bp, Human
gatgctaaggcacagaatcacttgaacctgggaggcagaggttacagtgagccaaaatcgcgccactgcactccaacctgggcaacacagcaagactctgtctcaaaacacaaaaaaagaataggctgggtacagtggctcacgcctgtaatcccagcactttgggaggccgaggcaggtgaatcacctgaggtcaggagttcgagaccagcttggccaacattgtgaaaccccatctccattaaaaatacaaaaaataagccgggtgtgatggtgcacgcctgtaatcccagatacttgkgaggctgggacagaagaatcgcttgaacccgggaggcgaaggttgcagtgagccgagatcatgccactgcattccagcctgagcgacagagtgagaccttgtctcagaaaaaaaaaaatagggtgatttttatataaaaacactctcatttgttcttgaattaattgccatattgaacagattaaactcctttaaaccattttttctatctacaaacataattagtattcccataagcattttaagctccctttaaaaatttaatatgctcgattttcttttttcttttatttatttatg

SEQ ID NO: 167250 - DNA, 601 bp, Human
gaagttggtttcttttgtcattcttatactaaattctaaatcttcctggcacttaaggatatttacccaaggaagggggtgagatttaccggctcaggtacaccgaggttactggcttgaaaattcaagaccacagcatggtaaatttttcttcagagattcaaggttcatacataggacttgaagggcacatgctactcaaatgagtatatccaacttgagtgctacatcaacagggaccccatgtccactcttttcagtcgaaattggcttactatctacttcttctgggctattcagkttccgacaattgattgctttcagttaatttctttattgcccagttgaattctgcattcttctagattctttttgttccttcagcctcaatcataataccatttaatgacagtctcatatcctattagactagggtttctcagccttggcactattgacatattgggtcagataattctttgtcctgtgcattgtagaatttagcatcttccttagcttctactcactagaagccagtagcactgtgtgcacatcctccttgccccctgccagctatgacaaccaaaatgtctccagacat

SEQ ID NO: 167251 - DNA, 601 bp, Human
ttattgcccagttgaattctgcattcttctagattctttttgttccttcagcctcaatcataataccatttaatgacagtctcatatcctattagactagggtttctcagccttggcactattgacatattgggtcagataattctttgtcctgtgcattgtagaatttagcatcttccttagcttctactcactagaagccagtagcactgtgtgcacatcctccttgccccctgccagctatgacaaccaaaatgtctccagacattaccaaatgtccactgagaggcaaattcactcygagttgacaacccctgtattaaacccaggggccctgcacttcttacatacttttgtctggtcaccagttgaaagtccttcttcttttttttttctctttttgagatggagtctcgctctgtcaccaggctggagtgcagtggcatgatctcggctcactgcagcctccacctcccgggttcaagcaattctcctgcctcagcctcctgagtagctgggattacaggcacgtgccaccacccagctaatttttgtatttttagtagaggtggggtttcatcatggtggccaggatggtctc

SEQ ID NO: 167252 - DNA, 601 bp, Human; identical to SEQ ID NO: 21625

SEQ ID NO: 167253 - DNA, 601 bp, Human; identical to SEQ ID NO: 21626

SEQ ID NO: 167254 - DNA, 601 bp, Human; identical to SEQ ID NO: 21627

SEQ ID NO: 167255 - DNA, 601 bp, Human; identical to SEQ ID NO: 21628

SEQ ID NO: 167256 - DNA, 601 bp, Human; identical to SEQ ID NO: 21629

SEQ ID NO: 167257 - DNA, 601 bp, Human; identical to SEQ ID NO: 31332

SEQ ID NO: 167258 - DNA, 601 bp, Human; identical to SEQ ID NO: 31333

SEQ ID NO: 167259 - DNA, 601 bp, Human; identical to SEQ ID NO: 31334

SEQ ID NO: 167260 - DNA, 601 bp, Human; identical to SEQ ID NO: 31335

SEQ ID NO: 167261 - DNA, 601 bp, Human; identical to SEQ ID NO: 31336

SEQ ID NO: 167262 - DNA, 601 bp, Human; identical to SEQ ID NO: 31337

SEQ ID NO: 167263 - DNA, 601 bp, Human; identical to SEQ ID NO: 31338

SEQ ID NO: 167264 - DNA, 601 bp, Human; identical to SEQ ID NO: 31339

SEQ ID NO: 167265 - DNA, 601 bp, Human; identical to SEQ ID NO: 31340

SEQ ID NO: 167266 - DNA, 601 bp, Human
ggctcacgcctgtaatcccagcactttgggagcctggggtgggcagatcacgagattgagaccatcctggctaacacggtgaaaccccatctctactgaaaatacaaaaaaaaaaaaaatatatatatatatatattagctgggcatggtggcaggtgcctgtagtcccagctactcaggaggctgaggcaggagaatggcgtgaacccgggaggcggggcttgcagtgagctgatattgtgccactgcactgcagcctgggcgacagagcgagactccatctcaaaaaaaaaaaaaaaaatactgacattcatagtttatattagcagtaatgttaggcatcatgcaatatgtgttttctaacttgtacaacaagttgccattgttcccatttacagatgaggaaactggaagctaagagaagttacatgactataggattatgcagctagcaagagatagagcctggatttgaaccctggtctgttcctacttcagagcctgatctgttaacctgtacagatagaatggatatttattcaccttacaaacatagaactagttttgatagggctaatgtaacaaagcactggaaaattat

SEQ ID NO: 167267 - DNA, 601 bp, Human
tatgctatctgatttgagctttacaacggttaattagtgcacaaggcaatgctgttttcatggatgatgaaattgaggcttagagggttacacgatgttctcatattcctgtggccagccgggatagatctcaagtcttagaccaacttgagggtgagtgctcttgcatgatgtaagggaacatacacaactaggcgtcttttctgttgtatccatgggaagacagtctttagatctgcagctctatcatttcatgcagaatagttgctttatatttttcatctttctgcatcacagtgtytgtcagtaacttacagactttttcactgccccgttcatagcaatacatttttatatattgatctgatatgtatgtgaaaaaagttttatgaaataattcttacaaccacaaatgattttatcatgttttattcagtcctccttttttgttatcagttatttaattaggttcttcttaagaaatgtagaacaccaatttgtgaggataaattccatgagtcggggcaaacacagatcgcaggtagtcctggagcttaggaatagctttgatttttggtaaaatttgtgactccacagcttt

SEQ ID NO: 167268 - DNA, 601 bp, Human
ttagtgcacaaggcaatgctgttttcatggatgatgaaattgaggcttagagggttacacgatgttctcatattcctgtggccagccgggatagatctcaagtcttagaccaacttgagggtgagtgctcttgcatgatgtaagggaacatacacaactaggcgtcttttctgttgtatccatgggaagacagtctttagatctgcagctctatcatttcatgcagaatagttgctttatatttttcatctttctgcatcacagtgtctgtcagtaacttacagactttttcactgccccrttcatagcaatacatttttatatattgatctgatatgtatgtgaaaaaagttttatgaaataattcttacaaccacaaatgattttatcatgttttattcagtcctccttttttgttatcagttatttaattaggttcttcttaagaaatgtagaacaccaatttgtgaggataaattccatgagtcggggcaaacacagatcgcaggtagtcctggagcttaggaatagctttgatttttggtaaaatttgtgactccacagctttctgatcaatcttgtgctgctctgtaatcttgta

SEQ ID NO: 167269 - DNA, 601 bp, Human
atctcagcttcctggtgtctgggcttctgcagctgctgctgcttgaataagcatcagtgggatgttttgggatttttacatcgctgataacaattttggttgaggtggcaatgacagatttctggtgttttcttcatagaggaactcgattgaggaccagaggtccagtcacaagtaacaagccactagccaggtgcttcaggaagaccgccctcttgcctctgtggaatccagtgaggatgatcagaacgttccccggggtaatgctggttcgcagttttctcacgtgtcaactgagggkttttttttttttttgccatggctcaacagcttttgaggcacatcttcagtaggaaaatatctaggcattttatgaagtttaaccacctgggtactaccattcttgtcaccaccaactggttttgtaacagttgcaagaaccttctttttcttttcaacctcgtacttagcggctgagtacttcctcttatacacagcttttctggaatacatagcacatcgggaatacctgccaattcctctgacaaggacagggttgtgctgcaatggggcttccccttcttgggcttcttagccttga

SEQ ID NO: 167270 - DNA, 601 bp, Human
ttggtcatttcaagtggtgtcccagctttttgtggttaatctgtgatagttgaaataatcagtacttagcttgtgagtgcctctttctcaaattgcagagaagtgactaagatatcctcttaccacctgtcctaaagtgccctgcctggtgtaaccaccctgaggtaaatgtgtctgcattgctagaacaccagtgttttggagcctagaattggtgagttttcatttaatgcaaaacctcgtgtggaaaaccaggctgctctagaaactcaatggggagtaattagtagttttactagtygtagttatgaggatgagctatgtgcagaattttagctttttttccttccagtatttactgcatctttcctatatgcaagatactatgctgtgctgcagtaacaatgctacaataatcaaaacagcatagcgctggcataaagagcaacagctaacaccactagagtataacagagcacccagaacggagccacccttacacaattattgatttttgacaaatacactaaaaccaaatggaaggaaagatattttcagtaaatgatgctgaacaactggatatccatacggaaataataag

SEQ ID NO: 167271 - DNA, 601 bp, Human
ctataggcatggagaacgccaagtggacttaaacttactggtctcaggtctcattctcaattattgatagacccagagagcttttatttacataggacacatttattgataattaccatattagaaattaaagccaggaaattacaaaatgtatattccatgtagaaatgcaataataaacccatagtatgctaacagatatttttatgaaaagactatatttgcgaaaacaaacacttcagtgagaaaagtgacattgttttagaaacctctggcatagtagttggattctatttctctytccagtctgttgctgtatgttgttttcaagtacacgaagaaaattcatccacagataagtagttagaaaaaggagtatcttaatagccttttcagataattgtggatattcttcttgatactacaccaaaactagacaattggtttcttaaagatcagttgcaatgtggattctgaaatcatttcaatgaacttttcatacattaaagcctgttctattttgctctttgaatggatctttttacctagatgtgattttgtaacatcttgattttgtaatgtcatggttcagtgaattatg

SEQ ID NO: 167272 - DNA, 601 bp, Human
gaaatgcaataataaacccatagtatgctaacagatatttttatgaaaagactatatttgcgaaaacaaacacttcagtgagaaaagtgacattgttttagaaacctctggcatagtagttggattctatttctctctccagtctgttgctgtatgttgttttcaagtacacgaagaaaattcatccacagataagtagttagaaaaaggagtatcttaatagccttttcagataattgtggatattcttcttgatactacaccaaaactagacaattggtttcttaaagatcagttgcartgtggattctgaaatcatttcaatgaacttttcatacattaaagcctgttctattttgctctttgaatggatctttttacctagatgtgattttgtaacatcttgattttgtaatgtcatggttcagtgaattatgcagatcttcttaatgttgacatttttgattagataatattaaaaaatctcattaatatcaccactgatttcattggaaaaggcttcaagtattgggaagctattaagctcctggtggtgggtacaagttttccacttttccagttctcacttgacagctggaat

SEQ ID NO: 167273 - DNA, 601 bp, Human
acacttcagtgagaaaagtgacattgttttagaaacctctggcatagtagttggattctatttctctctccagtctgttgctgtatgttgttttcaagtacacgaagaaaattcatccacagataagtagttagaaaaaggagtatcttaatagccttttcagataattgtggatattcttcttgatactacaccaaaactagacaattggtttcttaaagatcagttgcaatgtggattctgaaatcatttcaatgaacttttcatacattaaagcctgttctattttgctctttgaatrgatctttttacctagatgtgattttgtaacatcttgattttgtaatgtcatggttcagtgaattatgcagatcttcttaatgttgacatttttgattagataatattaaaaaatctcattaatatcaccactgatttcattggaaaaggcttcaagtattgggaagctattaagctcctggtggtgggtacaagttttccacttttccagttctcacttgacagctggaattttatcatcggtggtaaatactatcattgttttcttttagctttaagcttgttttgttcagttctgaga

SEQ ID NO: 167274 - DNA, 601 bp, Human
cttctcacattcgtatattttccaactgaattaaaatatgtacatacatttgcttttacagttggtttttcaagtcaggtcaacacgaagttcaatccttgcatttgcttattatgaatcttggtttcttttaatgaagaacgttgtcattttctcaacttggctgattttttccatgccattgacttgctggagaaactggggctagttttgtaaaatgtctttgatttgtgtaattgcttcctggcatattgacacttagttaattcctctcttccctacatttaacaaggatacttcrtagacgatggctgggtaattcctgtagtataacataggtggtacataatcttttactgatgtcaagcttgatcattgggttcaaatggtggcaggctcatctttccattgtcaccattggcctttttcataaggttttagcatccattgatgatcattgtctgagtgaatgagctttggaactatgaggtgctaaatacttgtgtggaggtagtacacaggtaatattatatcattactgttaatacagtcggggacagtgtctttatttgaacaaagccatctttggaataatatccaa

SEQ ID NO: 167275 - DNA, 601 bp, Human
tggctttttgtggacggcatgaagtggcttgagatcaaagcttgaatttttttttttttttaataaagtcctgaatctgagactgcgttattttcagctccaccaccactcctctcccccacctctcccaataaaacagtctatttggaaagacttcaaaacatttattcatccagccacagtaatattagtggtggtaattttcctgccttctccggaatattttaagccatcgattttatgtttgcattgttaatacgtccttttgggtcctaagaacctctgcctaaagtataaagcygtatatatttatatgcctttgttgtaataaggtatcacatttcaaacactgtttagtctgttggatagaaaatgtcatcttgaaatatttcttagaaacaaatgagttgtctggaaggctttgcttgtatattttagaagaaattagttgataatgtattgtggttttattgggaggggttaaagggtataaggtggagaagttacgtttaaattattttaaaagaagactatatctagcttaatttttaactcaaagctcagaggttctattggaatacttttgccaaatcataaactt

SEQ ID NO: 167276 - DNA, 601 bp, Human
cttgtattttgattttttccataaagatatttgttttatttgcttaattagaaatgaaaataagttttatgttaataaccattgagtagatagatattcagaaaggaactctcatttttgccttgcccagtgttgtctaacacacacttggtctggaataagaatcacttacataggtttactctgctggcttgtggcattcccagattcttaaatttgaaccttttcaactatttgataaggtaggaaagtaacttaatatagtggcagtttttgcttttgtttagtgtgtttttttgtytttatagaggaaagccctgaaggaaagtaattactgtaaagataattgttgataacttcgagtccagctcatgaaatgacttagattttttccccagagctattaactgccattatataattaaatgtgtttttaatcctgagatttttggagaaatatgtttccatgcttaaaaagtaaagcacaggtgtttctttctaaagatttttaaagatttccttcttggtagtaatgacatggtatccattccttttattcttttgtagaaatgagttagcattttttaaggcttggtgctga

SEQ ID NO: 167277 - DNA, 601 bp, Human
tttagtagaaacgaggttttgccatgttggcctggctggtcttgaattcctgattcaggtgatctgctcgcctcgacctcacaaagtgctgggattaccggcgagggccactgcgcctggcctagaatttactttatctttaaacattgaaaagcttgagttaaaagacgacgtagttttaagaagttgttctttttgtgagatccatcattagtaaaccattgttactgattaatagtggtacatcagttaagtagtagacatgatatggggaagaagttcctgcctttgctcagcgagygtctattgaaatagtaaaagaggactcagaggcttaagttctttcactgatgtccctttagtctctgtgtcattttttgggggaggtggtggtggtggtggtggtggtggtatatttcagcttctttatttaaaaaattagaataatagaattcttgcactaaaagaaatttcgaagtcaggtagtttattaccttgcctttagacagaaccactgttatataattccaggtagatgagagttagctatttaaactgataaccagaaaaatattatgcactcctcacaacttggcctaag

SEQ ID NO: 167278 - DNA, 601 bp, Human
tcctgattcaggtgatctgctcgcctcgacctcacaaagtgctgggattaccggcgagggccactgcgcctggcctagaatttactttatctttaaacattgaaaagcttgagttaaaagacgacgtagttttaagaagttgttctttttgtgagatccatcattagtaaaccattgttactgattaatagtggtacatcagttaagtagtagacatgatatggggaagaagttcctgcctttgctcagcgagcgtctattgaaatagtaaaagaggactcagaggcttaagttctttcaytgatgtccctttagtctctgtgtcattttttgggggaggtggtggtggtggtggtggtggtggtatatttcagcttctttatttaaaaaattagaataatagaattcttgcactaaaagaaatttcgaagtcaggtagtttattaccttgcctttagacagaaccactgttatataattccaggtagatgagagttagctatttaaactgataaccagaaaaatattatgcactcctcacaacttggcctaagttatagcacccaatcttaagcagtgttttacagtaataactagctca

SEQ ID NO: 167279 - DNA, 601 bp, Human
gctgggcacattagctcacgcctgtaatcccagcactttgggagcccgaggcaggcggatcacaagggcaggagactgagaccatcctggccaacatggtgaaaccccatctctactaaaaatacaaaagttagctgggtgtggtggcgggcgcctgtagtcccagctactcgggaggctgaggcaggagaatcgcttgaacctgggaggcggagcttgcagtgagccgagatcgcaccactgcactccagcctgggcaacagagtgagactgtctcaaaaaaaaaaaaaaaaaaaaaaaatttactgggtatctgtttcactttgtaggtcatcagaagattgagagaaagaggagaaccaatcagactatttggagagactgattatgatgcttttcaacgtttaaggaaaatagagatcctcacaccagaagttaacaaggtaagaggacagaacaaagctagaaaaataccactgtactgcattcactagaatagagtttgactaattgcattattgtaggcaacaatggaaaagtaaagtgagcagattattgctgctgaatggaagttttcattaattttttgaaaagctcatat

SEQ ID NO: 167280 - DNA, 601 bp, Human
ttttaaaaataaacttgtctttttgtaaatggattataggaattctttgtatattctggatagaagttctttgtcagatatacgaatattttttgtgactattttcttgtagtttagggcttacctgttctcttaattgaatcttttgctgaacagaagtttgtgtgtgtgtacacacacgctttttgagacagggtctcactctcacccaggctggagttcagcatgatcatggctaactgcaacctctagctcctgggcttaagcgatctcccacctcagccttccaagtagctgagamcacaggtgtgtgccaccatgcctggctgattttttaatttttgtagagatgaggcctcctcatgttgcccaggctgatcttgaactcctctactcaagggatcctcccgccttggcctcccgaagtgcccgggccagaagttttatattttaatgaagtccaatttattgttttttccttttatggtcattgctttttgtgtcctgcttaagaaatctttgcctatcccaagatttcaaatatatattcttaattttcttctagaagcttaatattatagtttttgctttacatttaagg

SEQ ID NO: 167281 - DNA, 601 bp, Human
atggtcattgctttttgtgtcctgcttaagaaatctttgcctatcccaagatttcaaatatatattcttaattttcttctagaagcttaatattatagtttttgctttacatttaaggctctgatcttgttttatggcttagcatatggtttattccatgggctcttgaaaagagtattgttttgctttcatggtacagttctacaaatgtcagtgatgatagtgttgttcagatcttctttggccttgctaactttttatctacttgctttctcaattattgagagacaggtgtggttayctatgactatgtaacagactactccaaaacttactagtgtttgtttatttattataaaggatttatcattaccaaatctgtttttggtgattaacaagccaccctgaaacttgatagcttaagataatttgttattgtcttaataattaccagttctgtggttttattgggctggattgagcagtatcttgcttggggtctttcttgtgattgcagtcagatgaaggctgcggccgaaatcatgtgaggctgcctctggactggtcttctaagctgatatcttgcccctttcctggcgtc

SEQ ID NO: 167282 - DNA, 601 bp, Human
tgctctggttgaaatcttgtttttatactttcacatgcaattcagtgaccacatcttctctcggaatctatttttgatcccagtcagaattaattgcttccttctccatgtgcctatgagtaaacctttgttagtgtacttactgtttttcgctattattagagttatgtgcatatttatctcttcctggtgggcaaaggctgttttacctttgtatgccaagtcctgtgccgtgcatctagaggttttgaggacaaagcacaggagcacaaggtctggattccattcctggattatagtratcaattatttggccgttggcaagtcttttactctatttgaaccttagaatcttcattggtaaaacagaggcagtgatatttggctcactgggatgcactgagaattcgatgaggtgacctctgggaatgcctggcgtcatactttttacacagcaggtgatcagtcagtgtttgagaaattataagtgttttgagttgaatgtttctcttctgtgtttatgaagggacaggagacaatgatcagatgctttttgtgtgagaacgttaggagttaacattggttgaatgtgcaccgtgct

SEQ ID NO: 167283 - DNA, 601 bp, Human
agttagcactatgtttttaagagctatccttgatgctctgtgtacactgaatcctttgcttttaattgctacataggattccatgtgttacgccattcactgcatttgactttttgttctccggtaatgatggacagctagattgttcccagctctctcctaccacaaacagcttcctgatgaacagtcttgtgcataaccacgatggcctagcaaagtgggattgtgggatttatatatgtatatttaacttgtctaagtactgccaagttactctctggaatggctgtcctagtctacrcccagcagtgtgagggtcccctgtctttccagccctgccaacgcttggcaatatcttgctgtctgatttttgctatagtgctgcttttggagtgttagtgtataatcttaattaaaaagcaattttgtatcatgtaagtagcatgtaaaataaatatggcttaaagttcttaatgcttaaggaaacataaacttatttttctgtttcctttaattcctggctcttgtatgtgtagctgtccctctgaataagatcatagttgaggaagacgtcattttaatcccctgcctcctccaatac

SEQ ID NO: 167284 - DNA, 601 bp, Human
tttgactttttgttctccggtaatgatggacagctagattgttcccagctctctcctaccacaaacagcttcctgatgaacagtcttgtgcataaccacgatggcctagcaaagtgggattgtgggatttatatatgtatatttaacttgtctaagtactgccaagttactctctggaatggctgtcctagtctacacccagcagtgtgagggtcccctgtctttccagccctgccaacgcttggcaatatcttgctgtctgatttttgctatagtgctgcttttggagtgttagtgtatmatcttaattaaaaagcaattttgtatcatgtaagtagcatgtaaaataaatatggcttaaagttcttaatgcttaaggaaacataaacttatttttctgtttcctttaattcctggctcttgtatgtgtagctgtccctctgaataagatcatagttgaggaagacgtcattttaatcccctgcctcctccaatacctgtctatggtccctaaattttactaaaataattggtatgggcaaccagttgtgggcttttttttttttttttttcctattggtgtatttatttgtttattttt

SEQ ID NO: 167285 - DNA, 601 bp, Human
gggatttatatatgtatatttaacttgtctaagtactgccaagttactctctggaatggctgtcctagtctacacccagcagtgtgagggtcccctgtctttccagccctgccaacgcttggcaatatcttgctgtctgatttttgctatagtgctgcttttggagtgttagtgtataatcttaattaaaaagcaattttgtatcatgtaagtagcatgtaaaataaatatggcttaaagttcttaatgcttaaggaaacataaacttatttttctgtttcctttaattcctggctcttgyatgtgtagctgtccctctgaataagatcatagttgaggaagacgtcattttaatcccctgcctcctccaatacctgtctatggtccctaaattttactaaaataattggtatgggcaaccagttgtgggcttttttttttttttttttcctattggtgtatttatttgtttatttttaaaaaacagctttattgagatattgacataccatacagttgactgatttaacatatacaaatcagtggtttttagtatattcacatggtggtgcaaccattatcacaatctaattttagaaca

SEQ ID NO: 167286 - DNA, 601 bp, Human
ttgaggaagacgtcattttaatcccctgcctcctccaatacctgtctatggtccctaaattttactaaaataattggtatgggcaaccagttgtgggcttttttttttttttttttcctattggtgtatttatttgtttatttttaaaaaacagctttattgagatattgacataccatacagttgactgatttaacatatacaaatcagtggtttttagtatattcacatggtggtgcaaccattatcacaatctaattttagaacattttggttcccccaaaaagaaatctcacattcrttaccccctcttgacttttcataaaaggtaacatgctctccaaatttaagtggcaaatccgtgttttttgtttttggtttcttatctagaaattccatcagatttttaagtaaaaattgaacagcatatgtgaccaagagccatgtttagactggtgttggtaatatatatgtttagttgttgctctgtattaatgaacagaagcattgtttctttttcttcaggcgcttggagagtccttagggaaaggcgatgatcataaggacatggacatcatcaccaaattcctgaaggtgcgtg

SEQ ID NO: 167287 - DNA, 601 bp, Human
gaacattttggttcccccaaaaagaaatctcacattcattaccccctcttgacttttcataaaaggtaacatgctctccaaatttaagtggcaaatccgtgttttttgtttttggtttcttatctagaaattccatcagatttttaagtaaaaattgaacagcatatgtgaccaagagccatgtttagactggtgttggtaatatatatgtttagttgttgctctgtattaatgaacagaagcattgtttctttttcttcaggcgcttggagagtccttagggaaaggcgatgatcataargacatggacatcatcaccaaattcctgaaggtgcgtgtcttaggcgaggggatgaggatgccttggatccttatgaactattcttatatttttggattaccaagggttaaaggctggaacgggaaagcctcaatacacatttctcacacatacatgatgtttatgatatcactatgcacttgatgtagcagttagtaagagaaaatgcatatttacttttcttgtggcttttttttttttttggaaacagagtcttgctcttgtctctcaagctggggtgcagtggtgtaatctcagctc

SEQ ID NO: 167288 - DNA, 601 bp, Human
tcttgtggcttttttttttttttggaaacagagtcttgctcttgtctctcaagctggggtgcagtggtgtaatctcagctcactgcaacctccacctcccgggttcaagtgattctcctgcctcagcctcctgagtagctgggattacaggcacccaccaccatgcttggctaatttttgtatttttagtagagatcgggtttcaccatgttggccacgctgatcttgaactcctgacctcaggtgatccacccacctcagcctcccaaagtgctgggattacaggcatgagccactgcgmctggtctgcttttcttgtggcatattttttaaagctggctcattaatgtaaacacatagaaaagaatcacaacagcagaattaataagaagttggtagagttgcttatttttttctggaggcagagtcttgctctgtcgcccaggctggaatgcagtggcaccatctcggcttgctgcaaccactgcttcctggattcaagcgattatcctgcctcagcctctcaagtagcatgccaccacacccgactagtttttgtattttttatttatttatttatttatttttttagtaaagagac

SEQ ID NO: 167289 - DNA, 601 bp, Human
gtgttcagaccaagagatttacatgcaaggaatgctttttcttgtgtgtacagtttagatacaacatattattcatcaagattctgaatatattgaggatacagcatggaagtagatagggcataagaattagtatgaactagaatttcctctttgagtgatggcctcttcttttttaggatatgcatagatgatgcccctagaggacaacatcctcctcagccttctctgtttcctacttccaggaagggtgccctttatacagttaaacccaaggggcactgaggtagttatctagggrtgggggtggagtgggaatgctgggtcttggcttctttatttctgtttctctttctccttcctctcctttagtcaggtgctttcatggtttttaaacttaatcatggtctctacagcatatgtagaaagtccagttttcttgtaactcgtaacttgttgaattttatgtatataatacaaatacaaatacaagtttatttcctctcaaatagttaactatgaaacttgatagttgttttctgagggaagcaaattatcctgagctaggaatagatgtagactagggaagttggtgacttgc

SEQ ID NO: 167290 - DNA, 601 bp, Human
atgttttaaatgacgaaactcagcggaaatatattcaggtaagcagtttggagagccgggaattgccctggaagtgaatattctctaattcccaaaactctaagtctggaaagcaggcagagaattacagcaaatagaacatagcgtgataggatggaagtcccctctggataagcactgacactgaagccaccttcactgaataaagtaaaaacctttcaactttcatatatgttggaagacaagggtgaagtattgtgctttaattaccttagcactgaaataaaatgattgcagtttsctttttttttttaagacgtgtattaggaagtaaaagttgagctcatcagagaaatgtgggagtttagtgaagagcaacaaacttagagtattttacaataaatcctgctttgttgctttcaaggtaaatctaacatctactgggttcaagatgtatggagagtaaagacttggctttaatgtacgtagcacgtaacaacacttctttagtcatgtgaataggtctaaagtgccgatggtttgttttcttcaagttatacatgcttcacataaacttgttggtactgtttttgggctaaac

SEQ ID NO: 167291 - DNA, 601 bp, Human
cctccaaacgtgactttaccagcaacactgataggcacccttgccctgtggcttctgactggagcaggcgatgagagggactggaaggcattttgtaggttggagaagaatgagtttagggtattgattttcccaacttgctccctggaggggcccctagggtgactgcatccctctgcccgaggctgtcgcttctctcgggtggctgtctccatacagctaccctccctaggttccagtggccactctcctcctttgccttcagaatttgggctagccacagcttcccaggattgccagygctaggttgctctactgtgtcttgttggtcctaagtccagcccactcctttgtaacatcctcgaaactactaccatcacattatccagttcgactgctggcatcctcctcgctatgtatagatgaattgatctgtgcactgtgttacagattcctttggaggttagaagattaaggaataataatcttctaatgatttccgttaagcttttgctattacaaaaggtaaatatcctataatattattctctggcaagttgttttcagtaagcttaagtttataagtttcctagtaaagaca

SEQ ID NO: 167292 - DNA, 601 bp, Human
gtggaatatacaatattgacaaatgagacctttagttcctggattccactgatgctggcagccaggctttcacccctcagttagtaagttggaggattctgctctgtgaaactgacccaagagaaagcatctgagttactaacacttaagtgttccttcagtgaaaaaaccagcttgctgccctgtcatctgaaaatgctgtcctatgggcaagccccacctattcagggagtttttccattcagctctatagtgcgttactcatcagcatgaatgttcacctaagattcatcagacattkggagaaagtctccaacatgaaaacagagaccaaaacacacagaaaaaaagaccttcatagaaacagaattatagagaacagaaaaaaatttcattgagaatgataattaatatccttagaggccaagcgtggtggctcatgcctgtaatcccaccactttaggaggctgaggtgggaggggtgcttgagaccgggagttctagaccagcctgggcaaaatagatcccttctctacaaaaaataaaaaatttagctggacgtggtggtgcatgcctattcaggaggctgaggtaggaggat

SEQ ID NO: 167293 - DNA, 601 bp, Human
aatattgatttcactaaaaatgtggtttggggaggatgtgggagaaagtgcttttgaggcgtgtgcgtgcatatgtggggccagtggacagtggtgtaagagtgagatatcctctgcttcatagtaggaagtcaggagatatcactaatatctggtggaaaaaccaagcactgtcagtatagtatttagaaatgtggcaataaatgccagaggaaacacttaaaacgttggaaaagggttgcctgtggagagctggaattaggatttggaaagagtgaggtagaggactgctattatttgwtacaagaatcgtgtgatttttttttttttcccctcaaacagtgtacacagaaaacccggaattatccttggcttttttcttcctgtcacaacccatatcctatccatgtcaaagcttgatggttctatattcaaagtatgtctggagcccgatcccttctcaccaccttccttgctgccactgggtccagccaccacctctcatctgaattattccagtgtcttctctctggtccctgagtttctcttattgctcctctccagtttcttagcagcattccccagactgatccagttcaca

SEQ ID NO: 167294 - DNA, 601 bp, Human
aaaatgtggtttggggaggatgtgggagaaagtgcttttgaggcgtgtgcgtgcatatgtggggccagtggacagtggtgtaagagtgagatatcctctgcttcatagtaggaagtcaggagatatcactaatatctggtggaaaaaccaagcactgtcagtatagtatttagaaatgtggcaataaatgccagaggaaacacttaaaacgttggaaaagggttgcctgtggagagctggaattaggatttggaaagagtgaggtagaggactgctattatttgttacaagaatcgtgtgatttttttttttttcccctcaaacagtgtacacagaaaacccggaattatccttggcttttttcttcctgtcacaacccatatcctatccatgtcaaagcttgatggttctatattcaaagtatgtctggagcccgatcccttctcaccaccttccttgctgccactgggtccagccaccacctctcatctgaattattccagtgtcttctctctggtccctgagtttctcttattgctcctctccagtttcttagcagcattccccagactgatccagttcacatacagtcagatcgtgt

SEQ ID NO: 167295 - DNA, 601 bp, Human
ctattccttcaggaaccttaagatgccaaattagtgctatcatctatatttccatggctaccgatcaaagttctgcatacacatgattagaattcacagcaggataagctggactatgtgatggaatggtctttatcccaaagcaaatacctgattacacagggaacaacaacaacaaaaaggagccaagtgaatgacgtgtgcaaaagcccttcttgtgaatcagttgaaagataacctccctccacacccctaattcctaaatctcataatgtgggcaatccttgaatccaccaaggaytttaaatacttcacagtcttgtttctctgatgtggaatctgttagattatggctccattcatagaagtatgtcatttgtcccttaatatcctcagggattggttccaggaccctgcagataccaaaatctggatgctcaagtccctgatagaaaatgacatagtatttgcatataatctatgcacatcctcctgtatactttaaatcatctctagattacttacaatacccaacacaatgtaaatgctatttaaatagttattatatgatatttatttgtattatttttaattctttttt

SEQ ID NO: 167296 - DNA, 601 bp, Human
cggggcagccggggcgcagggcgcagggcgcaaggtgcacggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccccggccgccttgggtcctcaccgcgcaccgcgcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgccccggcaccccagccccagcgccccttccccggcactccacttacccctgcgcggtcccggagctccgccaaggcccgggaaagttggagaactcgc

SEQ ID NO: 167297 - DNA, 601 bp, Human
gcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgycggggctaggaggagccgcgttgtgtggcttcgctttcctgatgctcgggtcaaaaactgtgacatccgataagacccagaacttatgtttccccctgataatttcccgcatcctcttgcctgctttcactgcgatgaaaaagatttctgttccaaaagagaaattcctaaagttcaaaattacgtgttagaataattattgggctactcgaaaaggcaggttagtaatttggtgtagtacctaaaagagcaagtttcgatcccttactccaaaaacaagacatttagatatactgtatt

SEQ ID NO: 167298 - DNA, 601 bp, Human
tttcctgatgctcgggtcaaaaactgtgacatccgataagacccagaacttatgtttccccctgataatttcccgcatcctcttgcctgctttcactgcgatgaaaaagatttctgttccaaaagagaaattcctaaagttcaaaattacgtgttagaataattattgggctactcgaaaaggcaggttagtaatttggtgtagtacctaaaagagcaagtttcgatcccttactccaaaaacaagacatttagatatactgtattagtgaatgacttgagatggaaatatttcaggaacyattgcaagaacaatttgaacaatcttggttctattatttttcctatagtggaattttgaaaaattaaataatcgaaatccaggtcccttaattaggcccattaacagagaagtatttggcatgcatttccttaaaaaaaaaaatcccagtttttaatgaatgaaaaaaaaatcacgactcatttagactgtaagtggtgggagctgtttcctttctctccatttgcaggttttctcacagcagttttcagagcatctgataggtttcatctcgaggagttatcagagccgtggagctcat

SEQ ID NO: 167299 - DNA, 601 bp, Human
aaattacgtgttagaataattattgggctactcgaaaaggcaggttagtaatttggtgtagtacctaaaagagcaagtttcgatcccttactccaaaaacaagacatttagatatactgtattagtgaatgacttgagatggaaatatttcaggaactattgcaagaacaatttgaacaatcttggttctattatttttcctatagtggaattttgaaaaattaaataatcgaaatccaggtcccttaattaggcccattaacagagaagtatttggcatgcatttccttaaaaaaaaaaatcccagtttttaatgaatgaaaaaaaaatcacgactcatttagactgtaagtggtgggagctgtttcctttctctccatttgcaggttttctcacagcagttttcagagcatctgataggtttcatctcgaggagttatcagagccgtggagctcatccctgttcagtaccaacggcattagttctgcttcggctcgaatgctccattggacacatgtgctcacagcttcgattatatgtttcacaatttaatttgtattttttgttgttgctttttattttggtttttgtttgtttttt

SEQ ID NO: 167300 - DNA, 601 bp, Human
tttggtttttgtttgtttttttgaaatggagtctcactctgttgcccaggctggagggcagtggcacagtcttggctcactgcaacctccacctcccgggttcaagtgattctcctgcattagcctcccgagtagctgggttaccggcatgccccaccaaagctggctaatttttgtatttttattagagacaggattttgccatgttggccaggctggtcttgaactcctgacctcaggtgatctacccgcctcgacctcccaaaatgctgggattacaggcctgagccaccgtgcctgrcctgtttcagttttgctttttccttgtgaaagccttaggaattcttaaatcttacaagttgtaggaaaaattacagattcccactcataatagaaggatgaagtgggcctgttgcagaatttccaagttattacttcctgcaggttaatttttttctaagacacataatgaagtgtagttttctgtttccttgattcattcatttgaaagtcttttgagcctctctttcttagaagcactggttgactccaggtcagcactctcttaacgtcaggccacattttgcttttctgaaatatt

SEQ ID NO: 167301 - DNA, 601 bp, Human
ccgagtagctgggttaccggcatgccccaccaaagctggctaatttttgtatttttattagagacaggattttgccatgttggccaggctggtcttgaactcctgacctcaggtgatctacccgcctcgacctcccaaaatgctgggattacaggcctgagccaccgtgcctggcctgtttcagttttgctttttccttgtgaaagccttaggaattcttaaatcttacaagttgtaggaaaaattacagattcccactcataatagaaggatgaagtgggcctgttgcagaatttccaarttattacttcctgcaggttaatttttttctaagacacataatgaagtgtagttttctgtttccttgattcattcatttgaaagtcttttgagcctctctttcttagaagcactggttgactccaggtcagcactctcttaacgtcaggccacattttgcttttctgaaatattccttgaaggaacaatgtggaagaaacccacaaatgacagaatctctgggaccagtcagttcagcacagcagctgccttttgagaggagacagttctcagggccgttgggggcatggttctttctagt

SEQ ID NO: 167302 - DNA, 601 bp, Human
caaccctttcataggactactgaccaacaggtagggcagactactttagtcaaagagtttgatatttgtatcagtcctagcttatgtccttcctggaattctgcttcttactcattggtgagagtctggaaaatccatggtgggtgagctggggaaaacccagtccccttcccctatgtctctgttcccagataaccacaatttcctattctattctcccttctgttgctcaacaagtaagaaaatattaaagaagacagaataaagaggacctcttccaccaagtgggaggactttggcytgtctaaatgccaggtttcgtaagtgcatttgtcagaatcgcccttggcagcaggaactctacagccaccatggctgtcatcctattttatgagccatgtggcctcctcttatctcctacctcaggccatgcacttctctgtagagagccaaggtgtcttcttttggaactggcatgttaaagcctctcacagataccaggtagggagtgtgggaaaaggttggacgcactggtgcgcagatggagctccgagttgatgccgaggtcatgggctgtgttcttcccttctgctggctacgt

SEQ ID NO: 167303 - DNA, 601 bp, Human
aaacatgctaagcaaattaacccagcgaagggctgactgtgagcccattaagaaggtgacattcagtgactcctctgttctcaggagaaaaaccaaaccgacctcagtagttgcaggattgttttctttccttttttcaagactaagaatgcttcttaaaatgcatctggtataattacagaaaatagctcagggttttgtattctgagaaagcaaacagctcaaatattgtatgtgaaaattgaggacattatcgtaataataccttgccaatcacttgggtggaacgttactagccgtwcagtgtaatacttagaaattcggctgaaatgatgtgagtactccaatcttccaaacgcaaatggcaaatgaaaagcttttttaaaaatcccattcttatttttaatgctttgcttatgccatggggaagaggcttgtttaaaaccagtgagctctttcccctgttaaatactccaacggctttgaggctgtagccacaccaggctcatgtttgggacttcaaaaacattatcttccattttgtgacttgtgaaatttagtctattctcatggtgagtaatccactttagaaattatctag

SEQ ID NO: 167304 - DNA, 601 bp, Human
tggccaggctgatctcgaactcctgacctcaagtgatcctcctgcctcagcctctcaaagtgctgggattacaggcgtgagccaccatgcccggccctgtctgttttttttaaatattcgataagttctcacaccaaaccctgaaaatatagagtaacaattcttgggttcatttaactgctaataggatgcacattcttcctgtttcatttgttattcagatcctgtatttctgctgaaaatatatgaccagttaggtggcaaaaacctttgatttgggtgtgtgtagtgatgacctggmcaatagcacactttccaagaaagcctgaggttgctggattgacctgatttccatgttggaacctcttgcctcctattttataattttggctgaactattcatttcatgattgcagttgtgtgcaggtggtaccagaaattatactagtgatacttggtcatcatttggtctaagaagcaaattttagatatatatgtccataagaggaaagttccaggcacatgaacaatgggacaacacgtttacatttctctcttccctcagtcaggtaacgatatggcattgtggtcttgcttagca

SEQ ID NO: 167305 - DNA, 601 bp, Human
aggaaagttccaggcacatgaacaatgggacaacacgtttacatttctctcttccctcagtcaggtaacgatatggcattgtggtcttgcttagcataaggttgaaataatagttgcatcttcagaaccaaaagatattccacaccaaacgactggcttgggaaagagttaacttcattgctggggaccgtttcccttgcttccttcttagcttgtcattgtctcagtgatctgctttttatcaagccagcgtcaatggcttaatttatttccatagttacttagtatatttgaaagcagytctttttgcttgcaaatcttagctaacatctgaacgacaaggaggaagccacagggcatgaaatctctacgaaatctaccatggttttattttatttttttgctagcttcagccagtgggtctgaagtgggctgtgtaggaacaagcagtgaccttttcagcttctctatggacagggaaaccggctgttctgagaagagatctcccatcctgcatgtggttaggatggtagggagggcttgatgagtctttgcttctgaaatcagaggaaactggctgtggaattagaacattcctagg

SEQ ID NO: 167306 - DNA, 601 bp, Human
tgatttttagtcttactcaaatggattaactgcttcgtgatgctctgtagaggatgactgtgggccagtatgacatttggctaaaggtttgctgaatcagatctggctctgcttagcaatactttaattgagaaggccctgaattgagacaaggggggcaactcagacacagattgtgactaatgtcagttgagtttctgtctgtttaggagatactgtggggaagcagaaagggtttggtccttctgcccaccactcaatgactagggacgctggacgactctccttctatggtgggtgyccgaggggccagaagagtttgagaacggagacccaggagcttcccagggagtcttctttgccttgaagccgagctctggggaaaaatgatgcccagcgcttaccactgagcagcccatgcagtggcttggcctgtgttgaaagtgcaggcacaggtgtgtccggtactgaggaggcggcaacatgagcctggttgtatctgaagccattggcttgctctgcagccatgggtgagccactctgtctctgaacctcagctttctcatctaaggtgagggtttggactggctagcccttgagt

SEQ ID NO: 167307 - DNA, 601 bp, Human
tgaagggttccatattagagccttataaatagccaaaatgaagaactggtgaaacaagagtgaagcccctaattccaatagctttgatacgtattggtacttcaacaactagattttccaaatatatattgaacagagggagaagcctgtgtttattccaggacagcccggaagattgtcatatgcccgttctttcatgggacaaactgtagttgctgaaaataaattgcctgtgagttctcctctctgagcctcctggacgtttcctgattcagtatcctgcagtgccgtgtgagccccyggtgttgggtttcttttgtccacatgaataaggggtacagagaatcagctctgggtgggctgagacagaagaagctgtcacccgatggccatctgaactgcaggtcagaatcctggcatcttctctggtttacccaatttgcttggggccccactttgtgaattacaagctcatctctgttcacagcaggggaatctttgcatggtttgtgggaggggactgactgtctgggaatctgtcatgcttgtgagttactctctgtatttttggtatttggtttctggatacaggtgaagcagt

SEQ ID NO: 167308 - DNA, 601 bp, Human
aagacaactgaactctaaccgaacagaacaatagggcagccaccccaaagccttattggaacaaagtagagagagaaacacaagagtcaaatagatggttctagtacagggagagggcatgtgtcccaggggtggtgtccccactttctctccctgcagtgggcccccccttcgggagtgtgctctatgagtttgtggggaagacggctccgttcctggtgctggccgccctggtactcttggatggaggtgagtgagtccacgtgggcgccatgccatgaccttggcatcgtgctggcaygcgcttgggccacacctgctttctgaagaggggcttgtcttttttatttttattttttagctattcagctctttgtgctccagccgtcccgggtgcagccagaggtaagcggctgggaatgagggccctgggggagggggcatggtgctgcttctgacccgtgtttttttcttgacagagtcagaaggggacacccctaaccacgctgctgaaggacccgtacatcctcattgctgcaggtggggctctgtgggtcttctgagtcaggggaatgcgaggtgatggccgcgtgctggaggc

SEQ ID NO: 167309 - DNA, 601 bp, Human
gacaactgaactctaaccgaacagaacaatagggcagccaccccaaagccttattggaacaaagtagagagagaaacacaagagtcaaatagatggttctagtacagggagagggcatgtgtcccaggggtggtgtccccactttctctccctgcagtgggcccccccttcgggagtgtgctctatgagtttgtggggaagacggctccgttcctggtgctggccgccctggtactcttggatggaggtgagtgagtccacgtgggcgccatgccatgaccttggcatcgtgctggcacgygcttgggccacacctgctttctgaagaggggcttgtcttttttatttttattttttagctattcagctctttgtgctccagccgtcccgggtgcagccagaggtaagcggctgggaatgagggccctgggggagggggcatggtgctgcttctgacccgtgtttttttcttgacagagtcagaaggggacacccctaaccacgctgctgaaggacccgtacatcctcattgctgcaggtggggctctgtgggtcttctgagtcaggggaatgcgaggtgatggccgcgtgctggaggcag

SEQ ID NO: 167310 - DNA, 601 bp, Human
cgaacagaacaatagggcagccaccccaaagccttattggaacaaagtagagagagaaacacaagagtcaaatagatggttctagtacagggagagggcatgtgtcccaggggtggtgtccccactttctctccctgcagtgggcccccccttcgggagtgtgctctatgagtttgtggggaagacggctccgttcctggtgctggccgccctggtactcttggatggaggtgagtgagtccacgtgggcgccatgccatgaccttggcatcgtgctggcacgcgcttgggccacacctgmtttctgaagaggggcttgtcttttttatttttattttttagctattcagctctttgtgctccagccgtcccgggtgcagccagaggtaagcggctgggaatgagggccctgggggagggggcatggtgctgcttctgacccgtgtttttttcttgacagagtcagaaggggacacccctaaccacgctgctgaaggacccgtacatcctcattgctgcaggtggggctctgtgggtcttctgagtcaggggaatgcgaggtgatggccgcgtgctggaggcaggggtggatggccagggc

SEQ ID NO: 167311 - DNA, 601 bp, Human
ggcttccctggaacctcactgcctagtacctgctcacaggagacacaaagatgctacccagcactcctggactgtcatcgacacttccagacagcccgactggggaagggagttgagagccaagtggctgtccacttgaggggagtcctgccattgatatgctctgcctttaagtgtcatgtcgaatgaacagacctttcttcaccatatgtgcaccttcatcacgattgcacaatattctttgaatttgttgtagcaaattagaggttccaagaggcacaacacgggaagttcccagaaygatggagaacagttccgtgggtctttttccagatagttctatatttacaaagggttctggttaagagatcatgaatatttgcataggtgcccttatgtaccgctgaaccccgccccctccacctaacggcatgcctgtactgaatgcacctgatcctgcttggattttctggcatttctaggtatcattagaaatgcccacgtatattgcacagtaaaacacagatgcgagagcctcaggctgccccgagactgtgtgtggtctggaagtggcctgattgctgggtggccccaagcaagc

SEQ ID NO: 167312 - DNA, 601 bp, Human
ttataacaaaatcaaagtgtgctgattgaggacgtaaaacatttttaaatttcatgctcatctttctccctcccccagcccatctcctgtgatattcattgttaacagttctatgtctttttctagatggttctgtgtttaccaccctattgcatgaaatgcctaaaaatccagtcaagtgaattttgccatttacatcactgtgtgacctcttgtttttccttcatgcaattttgtggccatgtttccgtgtcagaacaagtagatttactttttaaaactaattaaattttatttttttatcaaagttacacatgtacataattgtaagtcaaagataaaagaattataaggaaaaacagctgtctttttcccacgcctcttgatccccaaagcccttcagattccatcaccttcaacgtttttagatctttcttctgctgatacccttatgtctctaaataatatgtgtacacccccgactctttttttttttttttttgagacaaagtctcactctgtcacccaggctggagtgcggtggcacgatctccactcactgcaacctctgcctcccgggttcaagcgattctcctgcctc

SEQ ID NO: 167313 - DNA, 601 bp, Human
gggagactctttgtattattacttgaatgaatccccctattttctctcctgttttactgcagttggctgagcgttagactccctacttttattcttctaatttcttgtctttccccttttccattgagttattcctgttcatcttttaaactgcttattgagtttttaaaattgatgctatcatatcttaaatctgaagagccttttgtgtataccctgagtgtttggggttttggtgaggttgttgttattgcaaaaacaccctcccaccatgttcctgtttcagcctcttgtgttgccscggttgccattctggttaatttctgtggagaaactgtctcctgccagggtgaaggctggagtgctaggggccccactgctcttaacacagcctctctgcctgctttcatgttgacagcctctgctttcagccccaccttcacagtacccgaagcttcagttcctttctggctgtgaggcacaatggctcttgcctcttgctggcctcaccatttgcaggtggaagattccagcattctctgcggtgtcctctgctcacttcttcctcgtattgtcccttctcctctcccactctgtttgt

SEQ ID NO: 167314 - DNA, 601 bp, Human
tggggaaggggggtgtcttgccagaagctgccccctggcttagactttccctgttctgcctgcctccctgcagttgggctggcctgagtaccagtgtctttggaatctgcagagttgctatgctctctcatcgaacaatacctaaaaagtcccaaatggccgggggagagggggtaaggatggagagaaactgctaatggggtgtgaggtttctttgtgggatggtgacaatgttctgtaatcagatggtgatgatggttgctcaactctgtgaatacactaaacatcactgagcgatgcmctgtcaaagggtgaattttgtttttttttgagacggagtctcagtctgttgcccaggctggagtgcagtggcacgatctcagctcactgcaacctctgccactcgggttcaagcaattctcctgcctcagcctcctgagtagctgggattacaggtgcctaccactgtacccggctaattttgtatttttagtagagacagggtttcactatcttggccaggctagtcttgaactcctgacttcgtgatccccctgcctcagcctcccgaagtgctgggattacaggcgtgagccaccgc

SEQ ID NO: 167315 - DNA, 601 bp, Human
tgtgaatacactaaacatcactgagcgatgcactgtcaaagggtgaattttgtttttttttgagacggagtctcagtctgttgcccaggctggagtgcagtggcacgatctcagctcactgcaacctctgccactcgggttcaagcaattctcctgcctcagcctcctgagtagctgggattacaggtgcctaccactgtacccggctaattttgtatttttagtagagacagggtttcactatcttggccaggctagtcttgaactcctgacttcgtgatccccctgcctcagcctcccraagtgctgggattacaggcgtgagccaccgcatcctgcccaaagggtgaattttaaaccatgtgaattgtgtcataaaacaaaacccaaaccaagcctgacatcagaagaggtattcagtgaaggaggaaggattcttggaattaaacaagaatgtttcttaggcagaaaatttagctctgaactccctagcagccaagatgaaagtggaagcccaaagaccttcagagctcctaaagaggcgtgccgcttggcaggaggggtggacttggatctgacaccgagtcagcaaacagcagat

SEQ ID NO: 167316 - DNA, 601 bp, Human
aattttgtatttttagtagagacagggtttcactatcttggccaggctagtcttgaactcctgacttcgtgatccccctgcctcagcctcccgaagtgctgggattacaggcgtgagccaccgcatcctgcccaaagggtgaattttaaaccatgtgaattgtgtcataaaacaaaacccaaaccaagcctgacatcagaagaggtattcagtgaaggaggaaggattcttggaattaaacaagaatgtttcttaggcagaaaatttagctctgaactccctagcagccaagatgaaagtrgaagcccaaagaccttcagagctcctaaagaggcgtgccgcttggcaggaggggtggacttggatctgacaccgagtcagcaaacagcagatgagaagacaccctccagccttgttgctcatacccgctgctgacactggagaggctgtttcccagcttttcttccctctggcccttgaggtgatgtggatctctcggtgttttcaggaggcgcccgctgtccaagtggggtgtgcactgctgagtccagctgctgtgttgactttgcatgcaactcttgagctgagaagctcttatttg

SEQ ID NO: 167317 - DNA, 601 bp, Human
gcctcaacctcctgggctcaagctgtcctcctgcctcagcctctcaaagtattgggattacaggcgtgaactgggtctcccggccacctagctgaactctcatcctctttgaatgtgtcctggccatgtgcaggacacttaagatgttttgtgctcatcctcttcagacaaagcctgaggctttctttataaaatctttaaagtcagccagaagccatgggccatcaggggcagatagcagagtgcaggctgcctggatctcatcagattgctgtgtggggcctatcaccggcgccagacrttcactcaaccagcttgctgcacatttccaccaccgaggttcctcctttcatttgccccagagatagacatgtctgtctttaagagaatcaggtttctctacctgcctcctgtgtcagcaccagcaggaggggaaataccccaccttccctagttctctgtagctttcagcccatggctccctgaccctggggatggggtactgtgagtgaagcagtgcggaggacccagtgctgagggcggggagctgcccctgcagcccagactctggtgttcaggaatcttctctgagctcgctcca

SEQ ID NO: 167318 - DNA, 601 bp, Human
tgggctcaagctgtcctcctgcctcagcctctcaaagtattgggattacaggcgtgaactgggtctcccggccacctagctgaactctcatcctctttgaatgtgtcctggccatgtgcaggacacttaagatgttttgtgctcatcctcttcagacaaagcctgaggctttctttataaaatctttaaagtcagccagaagccatgggccatcaggggcagatagcagagtgcaggctgcctggatctcatcagattgctgtgtggggcctatcaccggcgccagacattcactcaaccmgcttgctgcacatttccaccaccgaggttcctcctttcatttgccccagagatagacatgtctgtctttaagagaatcaggtttctctacctgcctcctgtgtcagcaccagcaggaggggaaataccccaccttccctagttctctgtagctttcagcccatggctccctgaccctggggatggggtactgtgagtgaagcagtgcggaggacccagtgctgagggcggggagctgcccctgcagcccagactctggtgttcaggaatcttctctgagctcgctccagtccagggtgaa

SEQ ID NO: 167319 - DNA, 601 bp, Human
tcggtcatctgatatctacctgcatgtctcacttatgcagtcctctgattgagaacaaagtaacttttactatgtgtgggcaaggcttggaatcaagtctggtatatctgatttcaaggaaaaaatactaaaatcactaggagtttgaaaagcagtcactcataaagagattgtcctgtggttctgaggaccacacacagcttggatggatgaggaccagacacagctgatgtggacaattcccctgtagccaagctgggtctgataatggttaggcctttctgttcaatgcggaggacasgttcaaggccactgctgccaccaccagcagggaatcaccctgggcacatcagaacctgggggatgcaggtgtcctctgtggggacagcaataaaacttggataggaggccggacgtggtggctcacgcctgtaatcccagcactttgggaggctgaggcaggcggatcacctgaggtcaggagtttgagcccagcctggccaacatgttgaaactcagtctctactaaaaatacaaaaattaactaggcatggtggcgcatgcctgtcgtctcagctacttgggaggctgaggcaagaga

SEQ ID NO: 167320 - DNA, 601 bp, Human
ccaagctgggtctgataatggttaggcctttctgttcaatgcggaggacacgttcaaggccactgctgccaccaccagcagggaatcaccctgggcacatcagaacctgggggatgcaggtgtcctctgtggggacagcaataaaacttggataggaggccggacgtggtggctcacgcctgtaatcccagcactttgggaggctgaggcaggcggatcacctgaggtcaggagtttgagcccagcctggccaacatgttgaaactcagtctctactaaaaatacaaaaattaactaggcrtggtggcgcatgcctgtcgtctcagctacttgggaggctgaggcaagagaatcacttgaacctgggaggcagaggttgcagtgagccaagatcgtgccactgcactccagcctgggtgacagagcgagactccatctcaaaaaaaaaaaaaaaaaaaaaaatctgacttgacaacaaaaaatgaccaggcagacatttatgtttctgacatagaaaaatgttcataaagctaactgaaacaagcaggatagagtataatcccttttttttgtaaatcaaaacacacataaatatatttat

SEQ ID NO: 167321 - DNA, 601 bp, Human
tcagaacctgggggatgcaggtgtcctctgtggggacagcaataaaacttggataggaggccggacgtggtggctcacgcctgtaatcccagcactttgggaggctgaggcaggcggatcacctgaggtcaggagtttgagcccagcctggccaacatgttgaaactcagtctctactaaaaatacaaaaattaactaggcatggtggcgcatgcctgtcgtctcagctacttgggaggctgaggcaagagaatcacttgaacctgggaggcagaggttgcagtgagccaagatcgtgccrctgcactccagcctgggtgacagagcgagactccatctcaaaaaaaaaaaaaaaaaaaaaaatctgacttgacaacaaaaaatgaccaggcagacatttatgtttctgacatagaaaaatgttcataaagctaactgaaacaagcaggatagagtataatcccttttttttgtaaatcaaaacacacataaatatatttatatatgtaaataaacttacaggagaaaataactgtggtgattatctgagtaatggatggggtttggggtaattttaacatttttctttttgtttatctca

SEQ ID NO: 167322 - DNA, 601 bp, Human
tgacatagaaaaatgttcataaagctaactgaaacaagcaggatagagtataatcccttttttttgtaaatcaaaacacacataaatatatttatatatgtaaataaacttacaggagaaaataactgtggtgattatctgagtaatggatggggtttggggtaattttaacatttttctttttgtttatctcacggttccctaattctttcaatgactgcgtcttacttctgtcggatgaaatcacacataagattgcaggtgctgagctcccaggcaggagctgtttgtattggcccaygtgtgaagcccaccaccagccagagatggaggcaagatgaagcagttgatagagaaaggactttcatttctggagtgtctcagcagctttgtgtggaggataagccacgtgggtccagaccggatccggcaggcgccggatattagctgctggggtgtgggccccggggcttcgttttatctgctctcatcaacattgtggtgtctacagttattactttttctaacatatgactgatatcagcactgataaggtctccttttcataaatttacaggcgttgccttcttgccagctagta

SEQ ID NO: 167323 - DNA, 601 bp, Human
aacaaggtgtttggacttaagctgttttatattgtaagatataatgctgttttcatggatcacaagtgacagaatcatgaactagtttataagcatgtgagtttgtcttccatttggtttactggatttctgttttttataatcagcattatcagtataggtggaggaaaaaaactgttactcaagtccctctgcacatacaggaaatatcaacattaccatttgaggaaaagtgtcttataagacagttacacggtagcgcttcactctcaaaattcccagttgagaagagctgtgttgtggatttttttttccaggttgaagaattatttttaaagacaaggcacgcttcttaattttactcttgaagtttctaattgttgccaagacaagaaattaggtggtttgaggattgcagctttcttttcctggatggctctgatagttgttccataaagcccttccagcaatagctctgttttctggatgccatgcgtggggcaaggatggggtggcccgaggctgctgagatagaccacattctgcatattctaagttgtttatagaatttgtccctttgcaggtatttaaatagtgggtg

SEQ ID NO: 167324 - DNA, 601 bp, Human
acagagggttattgtgatgtattgccactaaaatgcttagcatggtcttggcatgataaatgccagctatcaaatataagcaaatactattggacaatctggtttgaaagcagagcagcacgtttttgtcacagtttttaaattttcagtaacaataaaggagggcatgagagtttcatgctcatcagaagaggatttttaaaaaatcatatattttagctagaggacagccaggattggggacaggcggtcaggaaatcacatgtgtgaaaaaataatagctctagcatgttttgcctamgaagaaatctaaggggccatgacaatatggtcttaaaagattgggggccaagcatggtcacttgcacctgtaatcctaccactttgggaggttgaggcaggaagatcacttgagcccaggagtttgagcaacctgggcaatgtagtgagatgtcatctctacaaaaaaaaaaaaaaattaaaaattagccagtcttgatggcatatgcatgtagtcacagctactcgggagtctgaggtgggaagatggcttgagcctgggaagcagcagtgagctgagatcgcaccactgcactatggc

SEQ ID NO: 167325 - DNA, 601 bp, Human
cagagggttattgtgatgtattgccactaaaatgcttagcatggtcttggcatgataaatgccagctatcaaatataagcaaatactattggacaatctggtttgaaagcagagcagcacgtttttgtcacagtttttaaattttcagtaacaataaaggagggcatgagagtttcatgctcatcagaagaggatttttaaaaaatcatatattttagctagaggacagccaggattggggacaggcggtcaggaaatcacatgtgtgaaaaaataatagctctagcatgttttgcctaakaagaaatctaaggggccatgacaatatggtcttaaaagattgggggccaagcatggtcacttgcacctgtaatcctaccactttgggaggttgaggcaggaagatcacttgagcccaggagtttgagcaacctgggcaatgtagtgagatgtcatctctacaaaaaaaaaaaaaaattaaaaattagccagtcttgatggcatatgcatgtagtcacagctactcgggagtctgaggtgggaagatggcttgagcctgggaagcagcagtgagctgagatcgcaccactgcactatggca

SEQ ID NO: 167326 - DNA, 601 bp, Human; identical to SEQ ID NO: 40238

SEQ ID NO: 167327 - DNA, 601 bp, Human
ctttcaatcaaataattgtgactttgtttggtgttgcctaacagggtagcatgtaggttccttggggtagggcagggttctgtttcactaatgtgtgcccctggtgcctgccattaagttgacgcctggtacattcttgtgggtgaattatgagcggctgcagtggtagcacgggatgcgtgtgcagctcttccccaggagagtcagacagggtttttagggttggggacagtggacctgtggctttaaaggataaataggagtttgccagctggagaagagggaagggagaatgattaaygaccccaggcatagtggggtgcctgaaactgtattgagacaaatctgggcctccagggctcatattctccatgttcggcacatgctcgtggcgggagacaggaggacttcgagaagtggaaagagtagtagagtgacatgatgaggcgcttggagaagggaaagctcatgtgagatggtgtagtcacctaaggcttcctggaggaggtggagaccttgactggatcttggggaaggattaggaattaggaggaggaaggaaattcctggaagaaggctcagcatgagccgaggctcacag

SEQ ID NO: 167328 - DNA, 601 bp, Human
tttatgcagaacaactgtgccagccaggcacggtggctcatgcctgtaatcccagcactttgggaggccgaggcgggtggatcacctgaggtcaggagttcaagaccagcctgaccaacatggtgaaaccccatctctactaaaaatacaaaattagctgggtgtggcggcaaatgcctgtaatcccagctactcagaaggctgaggtggaagaattgcttgaacccgggaggtggaggttatagtgagccgagattgtgccattgcactccagcctgggcaacaagagtgaaactctgtytcaaaaaaaaaaaaaaaaaaaaaaaaaaaaaactgtgcctcagagaaagccctgggcgaagacaggctgttcgcctgtggctcagaggacagggagggctgggaagagcacctggcctggaacttatcacagtgaaatctctaatgtgctgtgcaatcttggaccactcgctgcccttctctggtcctcagtcctcacctgggaaatgaagatggagaacctatgactttcatggccctttcgttcgacagggacttacggatgataggaagcagcccccacatgcacaaagtcgagact

SEQ ID NO: 167329 - DNA, 601 bp, Human
gcgggtggatcacctgaggtcaggagttcaagaccagcctgaccaacatggtgaaaccccatctctactaaaaatacaaaattagctgggtgtggcggcaaatgcctgtaatcccagctactcagaaggctgaggtggaagaattgcttgaacccgggaggtggaggttatagtgagccgagattgtgccattgcactccagcctgggcaacaagagtgaaactctgtttcaaaaaaaaaaaaaaaaaaaaaaaaaaaaaactgtgcctcagagaaagccctgggcgaagacaggctgttsgcctgtggctcagaggacagggagggctgggaagagcacctggcctggaacttatcacagtgaaatctctaatgtgctgtgcaatcttggaccactcgctgcccttctctggtcctcagtcctcacctgggaaatgaagatggagaacctatgactttcatggccctttcgttcgacagggacttacggatgataggaagcagcccccacatgcacaaagtcgagacttccccgtgaggcaccactccctcaccctacgctgagtgagaccttcagccttggccctgaccctcaagggct

SEQ ID NO: 167330 - DNA, 601 bp, Human
cggtttcctcatctgcagcacgggacacagtagtgcctgctttgcagggctcagtaaaaagaccatagagcccacagttccctgactggcacagaactgcattccctacatgtgcactacggacagatttaaaaacccattccaggccgggcacagtggctcacagtggctcatgcctgtaatcccagcactttgggaggccaaggcgggcagatctcctgaggtcgggagttcaaaaccagcctgaccaacatggagaaaccccgtctgtactaaaaatacaaaaaaaattagccgggcrtggtggcgcatgcctgtaatcccagctactcgggaggctgaggtaggagaattgcttgaaccctgggaggcggaggttgcggtgagccgagatcgtgccattggattccagcctgggcaagaagagcgcaactccatctcaaaaaacaaaaaacaaaaagcaaaaaaaaaaaaccaaaaaccccattccagaaccaaatatttatgagaatgaataaaacagaagcagaacgtttgtaaatagtccaataacctttccatggagctcagtcggttctgtggacttggtgtttttggtttt

SEQ ID NO: 167331 - DNA, 601 bp, Human
tgagacttcatctcaaaaaaaaaaaggaaaaggagaagagacatagaatcagagacacatggagagaaggccatgcaaagacagagggttgcagaggtcagagtgatgtatctacaagagacacatgagggaccagagaacatgagggactgccagccaccactggaagctgggagagacattgaaaggttttctccttagagcctccacaaaggaaccaaccctgccaaacacctggatctcagccttctggcttccagaactgtgaaagaatccacttgtgttgttttaagcccccagygtgtggcattttgttgcagcaccctcggacacgaatacagtctgctctgggcatcaagggagtcagcttctgttggttgcaaccggcaacgagacatttcacagataaggaaactgaggccattgcagagaatgacttatctgtgctgttttggctggggacaagtggggctatcactatatccccagagtctgggagctttgtctgctccttgaaccaggtgagctcacaccctgcgggacttcatcatcaagactatgaagatgcctacgtcttgggggtcagcgggtgctcagtagg

SEQ ID NO: 167332 - DNA, 601 bp, Human
gagaagagacatagaatcagagacacatggagagaaggccatgcaaagacagagggttgcagaggtcagagtgatgtatctacaagagacacatgagggaccagagaacatgagggactgccagccaccactggaagctgggagagacattgaaaggttttctccttagagcctccacaaaggaaccaaccctgccaaacacctggatctcagccttctggcttccagaactgtgaaagaatccacttgtgttgttttaagcccccagtgtgtggcattttgttgcagcaccctcggacaygaatacagtctgctctgggcatcaagggagtcagcttctgttggttgcaaccggcaacgagacatttcacagataaggaaactgaggccattgcagagaatgacttatctgtgctgttttggctggggacaagtggggctatcactatatccccagagtctgggagctttgtctgctccttgaaccaggtgagctcacaccctgcgggacttcatcatcaagactatgaagatgcctacgtcttgggggtcagcgggtgctcagtaggctccggaaacccccagcagcacccaggagggg

SEQ ID NO: 167333 - DNA, 601 bp, Human
tatatccccagagtctgggagctttgtctgctccttgaaccaggtgagctcacaccctgcgggacttcatcatcaagactatgaagatgcctacgtcttgggggtcagcgggtgctcagtaggctccggaaacccccagcagcacccaggagggggtcttcaaggctcatggttgagaaccccagaaaagccccggagctgcctgggtgctggagagaggggatatgtcgtactgatgtgaagcaaacttactgtaggcttggccacaccctggtgtctagcccagaacctggcatggagsggggactggaaggaatgaaaagtccatgaatagctgacttttgagggggaccttaggcaaatcactttctcctcgctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagcc

SEQ ID NO: 167334 - DNA, 601 bp, Human
cctgcgggacttcatcatcaagactatgaagatgcctacgtcttgggggtcagcgggtgctcagtaggctccggaaacccccagcagcacccaggagggggtcttcaaggctcatggttgagaaccccagaaaagccccggagctgcctgggtgctggagagaggggatatgtcgtactgatgtgaagcaaacttactgtaggcttggccacaccctggtgtctagcccagaacctggcatggaggggggactggaaggaatgaaaagtccatgaatagctgacttttgagggggaccttrggcaaatcactttctcctcgctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagaca

SEQ ID NO: 167335 - DNA, 601 bp, Human
agactatgaagatgcctacgtcttgggggtcagcgggtgctcagtaggctccggaaacccccagcagcacccaggagggggtcttcaaggctcatggttgagaaccccagaaaagccccggagctgcctgggtgctggagagaggggatatgtcgtactgatgtgaagcaaacttactgtaggcttggccacaccctggtgtctagcccagaacctggcatggaggggggactggaaggaatgaaaagtccatgaatagctgacttttgagggggaccttaggcaaatcactttctcctcrctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagacatgatgctgagtgcacaaagg

SEQ ID NO: 167336 - DNA, 601 bp, Human
aggcttggccacaccctggtgtctagcccagaacctggcatggaggggggactggaaggaatgaaaagtccatgaatagctgacttttgagggggaccttaggcaaatcactttctcctcgctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatgrggtgagcacatcgcacctgtccactcaggggactagaactcagccatagaaaggtacggagcctggacacacgccattgcacagatgaacctcgaagacatgatgctgagtgcacaaaggccacgggtgtgtgacactgtttggatgcaacgtccagaagaggcaaatccagcgggacgggaaggagattcttggttgccaggggctgggggagggaggaatagggggcagctgtctgatgagaacagaggttctgcctggggtgatggaaaagccgcagaaatagatcatggaggtggt

SEQ ID NO: 167337 - DNA, 601 bp, Human
ctcctcgctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagacatgatgctgagtgcmcaaaggccacgggtgtgtgacactgtttggatgcaacgtccagaagaggcaaatccagcgggacgggaaggagattcttggttgccaggggctgggggagggaggaatagggggcagctgtctgatgagaacagaggttctgcctggggtgatggaaaagccgcagaaatagatcatggaggtggttgcacacatcgtaagtctaattaatgccgccaactcgcacacttaagatggctgaaatggaaaattgcatgttatatatattttaccacaataatttttctaaaaagcagcgag

SEQ ID NO: 167338 - DNA, 601 bp, Human
gactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagacatgatgctgagtgcacaaaggccacrggtgtgtgacactgtttggatgcaacgtccagaagaggcaaatccagcgggacgggaaggagattcttggttgccaggggctgggggagggaggaatagggggcagctgtctgatgagaacagaggttctgcctggggtgatggaaaagccgcagaaatagatcatggaggtggttgcacacatcgtaagtctaattaatgccgccaactcgcacacttaagatggctgaaatggaaaattgcatgttatatatattttaccacaataatttttctaaaaagcagcgagaacctgaggca

SEQ ID NO: 167339 - DNA, 601 bp, Human
gaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagacatgatgctgagtgcacaaaggccacgggtgtgtgacactgtttrgatgcaacgtccagaagaggcaaatccagcgggacgggaaggagattcttggttgccaggggctgggggagggaggaatagggggcagctgtctgatgagaacagaggttctgcctggggtgatggaaaagccgcagaaatagatcatggaggtggttgcacacatcgtaagtctaattaatgccgccaactcgcacacttaagatggctgaaatggaaaattgcatgttatatatattttaccacaataatttttctaaaaagcagcgagaacctgaggcacctctcgggaattctgcg

SEQ ID NO: 167340 - DNA, 601 bp, Human
ggaaaagccgcagaaatagatcatggaggtggttgcacacatcgtaagtctaattaatgccgccaactcgcacacttaagatggctgaaatggaaaattgcatgttatatatattttaccacaataatttttctaaaaagcagcgagaacctgaggcacctctcgggaattctgcgatggcacatagagtccttgtgagtcctctgtgtccccagcaccgagaggcagcctctcagcaagtgtccgctcacggtgcccactccggctcgtgggtcatcgtagcttcacgcccatctcctcygaggcctctccctgaatgccccattatgatttcccttaaatgtttacataagagcccagctcttccttcttagcatttagctctgttgttgttattggcatgatttgtttaggtttctctctaactgcttttgcagatgaccacaaaaagcaattcgttcgccttatctgtgtgctgttgtgtgtggtgtctctgacttgtcctgaaacagccacgtgaagtcagggccaacgtcttctggttcaactcggaactccccatttccagcccagcgcccgaaacccagtgggcctgggaatt

SEQ ID NO: 167341 - DNA, 601 bp, Human
ttaggtttctctctaactgcttttgcagatgaccacaaaaagcaattcgttcgccttatctgtgtgctgttgtgtgtggtgtctctgacttgtcctgaaacagccacgtgaagtcagggccaacgtcttctggttcaactcggaactccccatttccagcccagcgcccgaaacccagtgggcctgggaattatgaatttactgttgaatgaatgaataaattatgttaaaaccttccggaacagaatagaagggatggaaagttctagaggactctcgggtgcactgactgacaatgacrttgttgggaagacttggtcgactttgccgtctcgtgaatttctttctttcttttttttttttttttggcctccctctgaggaagtcccattaaccttgtgccaaattctgtccccagagcccagtgttaagggccccgggcaccaggaaatggcattcatctacgcacgctgaactctaagcccactgttccggggagcgacatatttttagatgtttgacgtccaaattccagaggaagagcaagtaatgcttagaggaaaactggctttcttcctccaccacgcaaaccagtgctggg

SEQ ID NO: 167342 - DNA, 601 bp, Human
cgtccaaattccagaggaagagcaagtaatgcttagaggaaaactggctttcttcctccaccacgcaaaccagtgctggggtgcatttttattggtctggccgctaagctgctggaactttccaaagaagggtaaaagctcctgcatgtggaaggaagggggtggtgagcactgagggaggcatgtgggtagctttggtggcagctctggagattggattctttttccctaaatggaagtggtttataaattcttctactgattattaaaagaatgatgtttactgtaaaaaaaaaaaaaagtcaggcaacacagaaagttataaattagtagaaatgatctgaattcttcctccaagatgtaaactctggtgacattctggggtgtctgtctagattgtttcatgaagcagttacacacagcacacgtgttttctcttagtggtattttattcgtactgattcagatttcttttattgaaatgaaattcacatgacagacaattcaccctttcaaaggtacaattcagtggtgtttagtatactcagagtcatgcaaccgtcctaactgcctagttttggaacgttcccatcaaccctac

SEQ ID NO: 167343 - DNA, 601 bp, Human
tgagcactgagggaggcatgtgggtagctttggtggcagctctggagattggattctttttccctaaatggaagtggtttataaattcttctactgattattaaaagaatgatgtttactgtaaaaaaaaaaaaaagtcaggcaacacagaaagttataaattagtagaaatgatctgaattcttcctccaagatgtaaactctggtgacattctggggtgtctgtctagattgtttcatgaagcagttacacacagcacacgtgttttctcttagtggtattttattcgtactgattcaratttcttttattgaaatgaaattcacatgacagacaattcaccctttcaaaggtacaattcagtggtgtttagtatactcagagtcatgcaaccgtcctaactgcctagttttggaacgttcccatcaaccctacaggaaaccctgcagccattagccgtcagtcctccttccctcttcccgcagcctctggcaactaccaatccactttctgtctttatggatctgcctgttgtagacgtttcatggaaatggaatcatccagtatgtgctatttggtgtctggcttattcacactgtt

SEQ ID NO: 167344 - DNA, 601 bp, Human
ccaaaatgggcatttccccacctgcttcctagggatatcagtggcagaatggctttgcaaatctatttttgttcatctatatgaacaaaaggtcatatagtttcactcttgtcacccaggctggattgcagtggtgccgtctggctcactgcaacttctgcctgcgtggttcaaatgattctcctgcctcagcctcctgaatagctgggattataggcacccgccaccacgcctggctagtttttgtatttttagtagagacgggtttcaccatattggccaggctggtctcgaactcctracctcaggtgatccacctgccttggcctcccaaagtgctgggattataggtgtgagccaccgcgcccggccaggaatcatttttatccaggtaaggcatacagaaccggagggttcttgtctaagttgtaccatgaatgtgtgctcagtggctactttgaaatagacttactgtacaatccctgagcaggaatgaaaataaaagctggaaatcacgggttgctctggggttttcaggaaggtgtcgtccgtctggggtgagtgtcctcctttctcagggatttcatgtggcattattttg

SEQ ID NO: 167345 - DNA, 601 bp, Human
tgctcagtggctactttgaaatagacttactgtacaatccctgagcaggaatgaaaataaaagctggaaatcacgggttgctctggggttttcaggaaggtgtcgtccgtctggggtgagtgtcctcctttctcagggatttcatgtggcattattttgttttcatctgagaggcaacataagctgggagggaagggctgcaaagagggggccaggacaaatgtgtacctgggggcccccattttgactccaccctgagctggggctgggccacaggagggcagagggaacactttgggasggggagggagcccctggactgaaagaatgggaagaaattgacaggcaccattgggaagcaactcccagttccaggctcctgggtcaggaacgcccatggagtaggacagacccaggttcgagtcctgcctctgactcttctcagctgcttgctcttgggcaaatgcttttagtttttttgtgcctcagtttcctcatcagtaaagtgggtttagaatagcagcagccccagagggtgatactgaagattcagtatgtgaggacccagcacagcattggcacacagtaagagcttactaaa

SEQ ID NO: 167346 - DNA, 601 bp, Human
gggtgagtgtcctcctttctcagggatttcatgtggcattattttgttttcatctgagaggcaacataagctgggagggaagggctgcaaagagggggccaggacaaatgtgtacctgggggcccccattttgactccaccctgagctggggctgggccacaggagggcagagggaacactttgggacggggagggagcccctggactgaaagaatgggaagaaattgacaggcaccattgggaagcaactcccagttccaggctcctgggtcaggaacgcccatggagtaggacagaccsaggttcgagtcctgcctctgactcttctcagctgcttgctcttgggcaaatgcttttagtttttttgtgcctcagtttcctcatcagtaaagtgggtttagaatagcagcagccccagagggtgatactgaagattcagtatgtgaggacccagcacagcattggcacacagtaagagcttactaaatgctgcctcccttgccataagcatgaatcacacagcccaggctctaagcctggtgtctgtgtatggtgactgtgtgcctccgtttcctcacctatgcaatggggacagcagtg

SEQ ID NO: 167347 - DNA, 601 bp, Human
ccgtttcctcacctatgcaatggggacagcagtggtacctactggggagggctggaggcgacttcaggtggtcctccgagggcagtgctcttgcacatgctgggtggctgtttccgcatggccccttctcttaggaactctgcgagttgtttgccctggtcttatccagaaatgatgaggttatatccaatcccacttttcactgttgctggtgggtttctcgtacgtgtatctgcagcctcagctggactggagctccttaggtttcttctgcatctgctgagcatctaacctaacgctrtggagatggtgggcgttcactaaatcatctgggagtgaattgagggaggatacagcggaaatgaagaaagactggaagatatgaagaatgaagttactatgggacgagaggcttctgagtccattgattaaaaataaaaggagccaggcgtggtggctgacgcttgtaatcccagcactttgggaggctgaagcaggcagatcacctgagctcaggagttcaagaccatcctgggcaacaaggcaaaaccccatctctactaaaaatacaaaatattagccaggcgtggtggcgggcacc

SEQ ID NO: 167348 - DNA, 601 bp, Human
gacgcttgtaatcccagcactttgggaggctgaagcaggcagatcacctgagctcaggagttcaagaccatcctgggcaacaaggcaaaaccccatctctactaaaaatacaaaatattagccaggcgtggtggcgggcacctgtagtcccagctacttgggaggctgaagcatgagaactggttgagtctgggaggcggaggttgcagtgagctgagatcgtgcccttgcactccagcctgggtgacagagtgagaccttttctcaaaataataataataataataataataataataataataataataaaaggaataaaaatcaggtgaactatggattagcattgcccgtgctgagccgagcacacgcaggtgtggtctcttttgatcttcaccacagacatcggcagcaggtattacttttgtgtccattttgcagatgacgctcagatacgttagtgattttcctgtatgatcgcacagccatggggttcaaacccagacgcgtcagactcctacacctgagcccttaatccctgtgcaaagcagcctttgatgtataagagatcatgagcttcggtcccttccatcttgggata

SEQ ID NO: 167349 - DNA, 601 bp, Human
actcccctaattcacatccgcattaagtgagcataggagtgtgatgatgcttgcccatagcacagccttacacaaacaaaagggctgcccccacacctgtgcaggacccctgctctgcagaacccactgcacagggcccatgtgcagatcagcgagttaatgcatgttaagcacttagaagggtgcccagcaaactgccagggtgtgttgaccaccatcatcctcatcttcatcatcatcatcatcatcacagcttttgttccacccgaagaatatttactgagtacttgctatgtgccakgcactgttctacgagccagggacacaggtaagaacaaaaccaagttcctgtccctaggagggagaaaaacagcaaacaaatgagttcataatacacagtccacccaagggtgatgaggtgtgtgaagctccacaaagcagggagagggggaagggaaggctgtatgagcagatcccgggtaggtgagagccgggcagatatggtgggtgggcggggaaagagccagtgcaaaggcccagaggtgggactgggtggctggagagaatgagtaaggaggggagtgctggaagagaggtcaga

SEQ ID NO: 167350 - DNA, 601 bp, Human
ccacaaagcagggagagggggaagggaaggctgtatgagcagatcccgggtaggtgagagccgggcagatatggtgggtgggcggggaaagagccagtgcaaaggcccagaggtgggactgggtggctggagagaatgagtaaggaggggagtgctggaagagaggtcagagacgtggagggggtcaggggagtcaattccagtccgacctctaggccaagaaccttggctgttaactcctttaacccatggggccagggataaattggagggtaagctgttcatgtctctgagtaaaagytatttcccagaactccagaaaacgccctgtgtttagaaccctctttgagtgtcaccttgcgtgacatgaaatatttttcaaaacatgtaatcctttaatctgggcctctcagtgaaatcagtgctttatcactcacgtccatctgttgtttcagtcacgcagtaaataactcgggagatgtggcttctaaggcgcttatctctttgttctctccaaattctgagaatcgacatttgaattttcctctgagacggcggcacagctcaaattgatctctgcgtaccctcccatctgggactg

SEQ ID NO: 167351 - DNA, 601 bp, Human
agatgccagcctgggtgtagacgccatgctgagtgtagacgccagcctgggtgtagatgccatcctcagtgtagatgccagcctgggtgtagatgccagcctgggtgtagacgccagcctgggcatagatgccatcctgggtgtagacaccagcctgggcatagatgccatcctgggtgtagacaccatcctgggtgcagactcaggataccccaggagggaagttctgtagggagaaactgatgcttgcccaaggtcacacagcaagtgagtggcagagaggatttaagccctagagccrggatttgaaccaaggccgttagctgtggagcccgctctggttgcccgtctgctctgccggatgagacaagctcagctggaggaaacggtttgaagagatgaatgtgcttggagggcgaggggaggagggagggcagtttgctggcatgtaaggacaaggagggtcggggcgatgagatgaggccaatgtatcctatatctaagttattaaatcgaaaaagtaacatgtacctggttggcgcagggctcggaggtcgagtggggagctgggactttgtcccgagggtgctgggaagcctct

SEQ ID NO: 167352 - DNA, 601 bp, Human
tgctgagtgtagacgccagcctgggtgtagatgccatcctcagtgtagatgccagcctgggtgtagatgccagcctgggtgtagacgccagcctgggcatagatgccatcctgggtgtagacaccagcctgggcatagatgccatcctgggtgtagacaccatcctgggtgcagactcaggataccccaggagggaagttctgtagggagaaactgatgcttgcccaaggtcacacagcaagtgagtggcagagaggatttaagccctagagccgggatttgaaccaaggccgttagctgyggagcccgctctggttgcccgtctgctctgccggatgagacaagctcagctggaggaaacggtttgaagagatgaatgtgcttggagggcgaggggaggagggagggcagtttgctggcatgtaaggacaaggagggtcggggcgatgagatgaggccaatgtatcctatatctaagttattaaatcgaaaaagtaacatgtacctggttggcgcagggctcggaggtcgagtggggagctgggactttgtcccgagggtgctgggaagcctctggggccttggagcacagaggtgacca

SEQ ID NO: 167353 - DNA, 601 bp, Human
agagatgaatgtgcttggagggcgaggggaggagggagggcagtttgctggcatgtaaggacaaggagggtcggggcgatgagatgaggccaatgtatcctatatctaagttattaaatcgaaaaagtaacatgtacctggttggcgcagggctcggaggtcgagtggggagctgggactttgtcccgagggtgctgggaagcctctggggccttggagcacagaggtgaccaaatccacaggtgcctttcataaagcctctttgggctgcagtttggagaatggatggatttggaggcakcgaggccagggacgaggccactgtggaggcactgatggggacttgggcctggggtggggttcatttatagaatgtgcctggcagagggacagatatcaagtttccaggggccgccgtaacaaatgaccacaaactggggtgggaggggtggttaagccaacagaaatgaattgtctcatggttctggggccagaagttcagcatcagcttcactggactgagatcaaggggtcagcagagccgcgcccccccaactccagaggttccttccttgccaatccctcttccggtggctgctgg

SEQ ID NO: 167354 - DNA, 601 bp, Human
cttggagggcgaggggaggagggagggcagtttgctggcatgtaaggacaaggagggtcggggcgatgagatgaggccaatgtatcctatatctaagttattaaatcgaaaaagtaacatgtacctggttggcgcagggctcggaggtcgagtggggagctgggactttgtcccgagggtgctgggaagcctctggggccttggagcacagaggtgaccaaatccacaggtgcctttcataaagcctctttgggctgcagtttggagaatggatggatttggaggcagcgaggccagggasgaggccactgtggaggcactgatggggacttgggcctggggtggggttcatttatagaatgtgcctggcagagggacagatatcaagtttccaggggccgccgtaacaaatgaccacaaactggggtgggaggggtggttaagccaacagaaatgaattgtctcatggttctggggccagaagttcagcatcagcttcactggactgagatcaaggggtcagcagagccgcgcccccccaactccagaggttccttccttgccaatccctcttccggtggctgctggcaatcatggtcac

SEQ ID NO: 167355 - DNA, 601 bp, Human
cagagggacagatatcaagtttccaggggccgccgtaacaaatgaccacaaactggggtgggaggggtggttaagccaacagaaatgaattgtctcatggttctggggccagaagttcagcatcagcttcactggactgagatcaaggggtcagcagagccgcgcccccccaactccagaggttccttccttgccaatccctcttccggtggctgctggcaatcatggtcactccttggtctgtagacgccatctctgcctccctcttcacatgactttcttgtgtgcatgtgtgtgtgcrtgcgtgtgtacatgtgtgtgtggggggggcgtgcttgtgtgtgtgtgtgtgatctccctctgctcccctcttctcagacacttgtgactggatttagggcccactggaaaatgcagaatcatctccccatgtcaagatccttaacctaattgcgtctgcaaagaccctttttcctttgcatttaggattccagggagtagggcctggtgtctttggggacctttattcagccaactgtatgtgcaggaggagacacaggaggctcgaggccctcccttgaaggggtcgctcactggttaa

SEQ ID NO: 167356 - DNA, 601 bp, Human
agcgggggtggtgtggccctaaccctggcctgggagggctggtgtcaccgaagcacatcccagccttgagcgctgatttgagtctcggggaatggtccctctggaagacctgaaggaacgggcattcggcagaggatcagcacgggcaaaggcctggaggtgacggcgcccacactgtcatcaaagcagcttcagtagctttgtgaggttctgtgagtcaagtctagattaagccaggacttggatgatgtgccctcgctctgcatggagactgcctttaaattgaagaagaatgtgtacrtggtaaaaagacattgaaccactgcagaagggtgtacaatagaaagaaatctctctcagctttacaccctattcttctctccaaaggcacctttcctaatggtttcttgtgtgatcttgtgtatccttccaaaaacgttctcagcctatgcaaatagatatatatatgttacatctgtgtgcatttttttaaaaacacagatggggcagaggctacacgctgttccgaaccgtggttttcttcatgagccgccatatcctggcgatctttcatatgtggcacattgagtcttatttcatt

SEQ ID NO: 167357 - DNA, 601 bp, Human
agggctggtgtcaccgaagcacatcccagccttgagcgctgatttgagtctcggggaatggtccctctggaagacctgaaggaacgggcattcggcagaggatcagcacgggcaaaggcctggaggtgacggcgcccacactgtcatcaaagcagcttcagtagctttgtgaggttctgtgagtcaagtctagattaagccaggacttggatgatgtgccctcgctctgcatggagactgcctttaaattgaagaagaatgtgtacgtggtaaaaagacattgaaccactgcagaagggtrtacaatagaaagaaatctctctcagctttacaccctattcttctctccaaaggcacctttcctaatggtttcttgtgtgatcttgtgtatccttccaaaaacgttctcagcctatgcaaatagatatatatatgttacatctgtgtgcatttttttaaaaacacagatggggcagaggctacacgctgttccgaaccgtggttttcttcatgagccgccatatcctggcgatctttcatatgtggcacattgagtcttatttcattttttgccaacaccttaaaggcaggttttcatggc

SEQ ID NO: 167358 - DNA, 601 bp, Human
gtcaccgaagcacatcccagccttgagcgctgatttgagtctcggggaatggtccctctggaagacctgaaggaacgggcattcggcagaggatcagcacgggcaaaggcctggaggtgacggcgcccacactgtcatcaaagcagcttcagtagctttgtgaggttctgtgagtcaagtctagattaagccaggacttggatgatgtgccctcgctctgcatggagactgcctttaaattgaagaagaatgtgtacgtggtaaaaagacattgaaccactgcagaagggtgtacaatagwaagaaatctctctcagctttacaccctattcttctctccaaaggcacctttcctaatggtttcttgtgtgatcttgtgtatccttccaaaaacgttctcagcctatgcaaatagatatatatatgttacatctgtgtgcatttttttaaaaacacagatggggcagaggctacacgctgttccgaaccgtggttttcttcatgagccgccatatcctggcgatctttcatatgtggcacattgagtcttatttcattttttgccaacaccttaaaggcaggttttcatggctgtctacta

SEQ ID NO: 167359 - DNA, 601 bp, Human
aggtgacggcgcccacactgtcatcaaagcagcttcagtagctttgtgaggttctgtgagtcaagtctagattaagccaggacttggatgatgtgccctcgctctgcatggagactgcctttaaattgaagaagaatgtgtacgtggtaaaaagacattgaaccactgcagaagggtgtacaatagaaagaaatctctctcagctttacaccctattcttctctccaaaggcacctttcctaatggtttcttgtgtgatcttgtgtatccttccaaaaacgttctcagcctatgcaaatakatatatatatgttacatctgtgtgcatttttttaaaaacacagatggggcagaggctacacgctgttccgaaccgtggttttcttcatgagccgccatatcctggcgatctttcatatgtggcacattgagtcttatttcattttttgccaacaccttaaaggcaggttttcatggctgtctactattccaatttgcagatatgccctatgtactgggccagcacaagggggccagattttgaatatgttgggggaggacttgtggggaggtaagtaggtgaagcattttagattaaagg

SEQ ID NO: 167360 - DNA, 601 bp, Human
gtgagtcaagtctagattaagccaggacttggatgatgtgccctcgctctgcatggagactgcctttaaattgaagaagaatgtgtacgtggtaaaaagacattgaaccactgcagaagggtgtacaatagaaagaaatctctctcagctttacaccctattcttctctccaaaggcacctttcctaatggtttcttgtgtgatcttgtgtatccttccaaaaacgttctcagcctatgcaaatagatatatatatgttacatctgtgtgcatttttttaaaaacacagatggggcagagsctacacgctgttccgaaccgtggttttcttcatgagccgccatatcctggcgatctttcatatgtggcacattgagtcttatttcattttttgccaacaccttaaaggcaggttttcatggctgtctactattccaatttgcagatatgccctatgtactgggccagcacaagggggccagattttgaatatgttgggggaggacttgtggggaggtaagtaggtgaagcattttagattaaaggaacagtttaggcagaggccaggaggcagcgcaagccagggtggtttttttccaat

SEQ ID NO: 167361 - DNA, 601 bp, Human
gtatccttccaaaaacgttctcagcctatgcaaatagatatatatatgttacatctgtgtgcatttttttaaaaacacagatggggcagaggctacacgctgttccgaaccgtggttttcttcatgagccgccatatcctggcgatctttcatatgtggcacattgagtcttatttcattttttgccaacaccttaaaggcaggttttcatggctgtctactattccaatttgcagatatgccctatgtactgggccagcacaagggggccagattttgaatatgttgggggaggacttgyggggaggtaagtaggtgaagcattttagattaaaggaacagtttaggcagaggccaggaggcagcgcaagccagggtggtttttttccaattaatctatcctgtatctaactctgtgtgtgtgtgcaaatgagcacaaactgctcaccacgcaccccattttcatagaagcagaagagtgttactgggcctggatggagtctggtgtcaggggacccagggcagtttgcctggtggcttaaactttctcggtcttacctttaaaatattgatcttattggtcactcacccatattcctat

SEQ ID NO: 167362 - DNA, 601 bp, Human
tgtggcacattgagtcttatttcattttttgccaacaccttaaaggcaggttttcatggctgtctactattccaatttgcagatatgccctatgtactgggccagcacaagggggccagattttgaatatgttgggggaggacttgtggggaggtaagtaggtgaagcattttagattaaaggaacagtttaggcagaggccaggaggcagcgcaagccagggtggtttttttccaattaatctatcctgtatctaactctgtgtgtgtgtgcaaatgagcacaaactgctcaccacgcaycccattttcatagaagcagaagagtgttactgggcctggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccgg

SEQ ID NO: 167363 - DNA, 601 bp, Human
accttaaaggcaggttttcatggctgtctactattccaatttgcagatatgccctatgtactgggccagcacaagggggccagattttgaatatgttgggggaggacttgtggggaggtaagtaggtgaagcattttagattaaaggaacagtttaggcagaggccaggaggcagcgcaagccagggtggtttttttccaattaatctatcctgtatctaactctgtgtgtgtgtgcaaatgagcacaaactgctcaccacgcaccccattttcatagaagcagaagagtgttactgggcstggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttttgtatttttagtag

SEQ ID NO: 167364 - DNA, 601 bp, Human
ggcaggttttcatggctgtctactattccaatttgcagatatgccctatgtactgggccagcacaagggggccagattttgaatatgttgggggaggacttgtggggaggtaagtaggtgaagcattttagattaaaggaacagtttaggcagaggccaggaggcagcgcaagccagggtggtttttttccaattaatctatcctgtatctaactctgtgtgtgtgtgcaaatgagcacaaactgctcaccacgcaccccattttcatagaagcagaagagtgttactgggcctggatggrgtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttttgtatttttagtagagacgggg

SEQ ID NO: 167365 - DNA, 601 bp, Human
actgctcaccacgcaccccattttcatagaagcagaagagtgttactgggcctggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgcycgccaccacgcccggctaattttttttcttttttttttgtatttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgg

SEQ ID NO: 167366 - DNA, 601 bp, Human
gaagcagaagagtgttactgggcctggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccggctaattttttttyttttttttttgtatttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctga

SEQ ID NO: 167367 - DNA, 601 bp, Human
gagtgttactgggcctggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttttgtatttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctgactgcttttt

SEQ ID NO: 167368 - DNA, 601 bp, Human
gtgttactgggcctggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttttktatttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctgactgcttttttt

SEQ ID NO: 167369 - DNA, 601 bp, Human
gttactgggcctggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttttgtwtttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctgactgcttttttttt

SEQ ID NO: 167370 - DNA, 601 bp, Human
cgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctgactgcttttttttttttttttttttttagtggagaaggggtttcgctatgttggccagcctggtctcaaaacttctgagctcaagtgattcacccaccttgacttctggaaatgctgggattatacgcktgtgtgccacagcacctggcccctatatcttatttttgaactttttattaaaacataatactttgggccaggcgcggtggctcacacctgtaatcccagcactttgggaggctgaggcaggcggatcacctgaggtagggaggtccagaccagcctggccaacatgtagaaaccctgtctctactaaaaatacaaaattagccgggtgtggtggcacatgcctctaatcccagctactcgggaggctgaggcaggagaatcgcttgaacccaggaggtggaggttgtggtgagctgagat

SEQ ID NO: 167371 - DNA, 601 bp, Human
gagtagtgcgatcacagctcactgcagccttgacctcctgggatcaaaccatcctcccgcctcagcctcccaagtacctgggactacaggagagaatgagcatgcctgactgcttttttttttttttttttttttagtggagaaggggtttcgctatgttggccagcctggtctcaaaacttctgagctcaagtgattcacccaccttgacttctggaaatgctgggattatacgcttgtgtgccacagcacctggcccctatatcttatttttgaactttttattaaaacataatacttygggccaggcgcggtggctcacacctgtaatcccagcactttgggaggctgaggcaggcggatcacctgaggtagggaggtccagaccagcctggccaacatgtagaaaccctgtctctactaaaaatacaaaattagccgggtgtggtggcacatgcctctaatcccagctactcgggaggctgaggcaggagaatcgcttgaacccaggaggtggaggttgtggtgagctgagatcgcgccactgcattccagcctgggcaacaagagcgaaactccgtctcaaaaacaaaacaaaaca

SEQ ID NO: 167372 - DNA, 601 bp, Human
accatcctcccgcctcagcctcccaagtacctgggactacaggagagaatgagcatgcctgactgcttttttttttttttttttttttagtggagaaggggtttcgctatgttggccagcctggtctcaaaacttctgagctcaagtgattcacccaccttgacttctggaaatgctgggattatacgcttgtgtgccacagcacctggcccctatatcttatttttgaactttttattaaaacataatactttgggccaggcgcggtggctcacacctgtaatcccagcactttgggagkctgaggcaggcggatcacctgaggtagggaggtccagaccagcctggccaacatgtagaaaccctgtctctactaaaaatacaaaattagccgggtgtggtggcacatgcctctaatcccagctactcgggaggctgaggcaggagaatcgcttgaacccaggaggtggaggttgtggtgagctgagatcgcgccactgcattccagcctgggcaacaagagcgaaactccgtctcaaaaacaaaacaaaacaaacaaacaaaaaatacttcaaagcgtataaatcctacgtgttcagct

SEQ ID NO: 167373 - DNA, 601 bp, Human
ggccagcctggtctcaaaacttctgagctcaagtgattcacccaccttgacttctggaaatgctgggattatacgcttgtgtgccacagcacctggcccctatatcttatttttgaactttttattaaaacataatactttgggccaggcgcggtggctcacacctgtaatcccagcactttgggaggctgaggcaggcggatcacctgaggtagggaggtccagaccagcctggccaacatgtagaaaccctgtctctactaaaaatacaaaattagccgggtgtggtggcacatgcctstaatcccagctactcgggaggctgaggcaggagaatcgcttgaacccaggaggtggaggttgtggtgagctgagatcgcgccactgcattccagcctgggcaacaagagcgaaactccgtctcaaaaacaaaacaaaacaaacaaacaaaaaatacttcaaagcgtataaatcctacgtgttcagctccatgaattcccccaaaataaacacaccatgtaaccagcccccagaccaagaaacagaacagagccagtcccaagaccacgtgttcccagccagtcactgcccaccagattcc

SEQ ID NO: 167374 - DNA, 601 bp, Human; identical to SEQ ID NO: 40239

SEQ ID NO: 167375 - DNA, 601 bp, Human; identical to SEQ ID NO: 40240

SEQ ID NO: 167376 - DNA, 601 bp, Human; identical to SEQ ID NO: 40241

SEQ ID NO: 167377 - DNA, 601 bp, Human; identical to SEQ ID NO: 40242

SEQ ID NO: 167378 - DNA, 601 bp, Human; identical to SEQ ID NO: 40243

SEQ ID NO: 167379 - DNA, 601 bp, Human; identical to SEQ ID NO: 40244

SEQ ID NO: 167380 - DNA, 601 bp, Human; identical to SEQ ID NO: 40245

SEQ ID NO: 167381 - DNA, 601 bp, Human; identical to SEQ ID NO: 40246

SEQ ID NO: 167382 - DNA, 601 bp, Human; identical to SEQ ID NO: 40247

SEQ ID NO: 167383 - DNA, 601 bp, Human; identical to SEQ ID NO: 40248

SEQ ID NO: 167384 - DNA, 601 bp, Human; identical to SEQ ID NO: 40249

SEQ ID NO: 167385 - DNA, 601 bp, Human; identical to SEQ ID NO: 40250

SEQ ID NO: 167386 - DNA, 601 bp, Human; identical to SEQ ID NO: 40251

SEQ ID NO: 167387 - DNA, 601 bp, Human; identical to SEQ ID NO: 40252

SEQ ID NO: 167388 - DNA, 601 bp, Human; identical to SEQ ID NO: 40253

SEQ ID NO: 167389 - DNA, 601 bp, Human; identical to SEQ ID NO: 40254

SEQ ID NO: 167390 - DNA, 601 bp, Human; identical to SEQ ID NO: 40255

SEQ ID NO: 167391 - DNA, 601 bp, Human; identical to SEQ ID NO: 40256

SEQ ID NO: 167392 - DNA, 601 bp, Human; identical to SEQ ID NO: 40257

SEQ ID NO: 167393 - DNA, 601 bp, Human; identical to SEQ ID NO: 40258

SEQ ID NO: 167394 - DNA, 601 bp, Human; identical to SEQ ID NO: 40259

SEQ ID NO: 167395 - DNA, 601 bp, Human; identical to SEQ ID NO: 40260

SEQ ID NO: 167396 - DNA, 601 bp, Human; identical to SEQ ID NO: 40261

SEQ ID NO: 167397 - DNA, 601 bp, Human; identical to SEQ ID NO: 40262

SEQ ID NO: 167398 - DNA, 601 bp, Human; identical to SEQ ID NO: 40263

SEQ ID NO: 167399 - DNA, 601 bp, Human; identical to SEQ ID NO: 40264

SEQ ID NO: 167400 - DNA, 601 bp, Human; identical to SEQ ID NO: 40265

SEQ ID NO: 167401 - DNA, 601 bp, Human; identical to SEQ ID NO: 40266

SEQ ID NO: 167402 - DNA, 601 bp, Human; identical to SEQ ID NO: 40267

SEQ ID NO: 167403 - DNA, 601 bp, Human; identical to SEQ ID NO: 40268

SEQ ID NO: 167404 - DNA, 601 bp, Human; identical to SEQ ID NO: 40269

SEQ ID NO: 167405 - DNA, 601 bp, Human; identical to SEQ ID NO: 40270

SEQ ID NO: 167406 - DNA, 601 bp, Human; identical to SEQ ID NO: 40271

SEQ ID NO: 167407 - DNA, 601 bp, Human; identical to SEQ ID NO: 40272

SEQ ID NO: 167408 - DNA, 601 bp, Human; identical to SEQ ID NO: 40273

SEQ ID NO: 167409 - DNA, 601 bp, Human; identical to SEQ ID NO: 40274

SEQ ID NO: 167410 - DNA, 601 bp, Human; identical to SEQ ID NO: 40275

SEQ ID NO: 167411 - DNA, 601 bp, Human; identical to SEQ ID NO: 40276

SEQ ID NO: 167412 - DNA, 601 bp, Human; identical to SEQ ID NO: 40277

SEQ ID NO: 167413 - DNA, 601 bp, Human; identical to SEQ ID NO: 40278

SEQ ID NO: 167414 - DNA, 601 bp, Human; identical to SEQ ID NO: 40279

SEQ ID NO: 167415 - DNA, 601 bp, Human; identical to SEQ ID NO: 40280

SEQ ID NO: 167416 - DNA, 601 bp, Human; identical to SEQ ID NO: 40281

SEQ ID NO: 167417 - DNA, 601 bp, Human; identical to SEQ ID NO: 40282

SEQ ID NO: 167418 - DNA, 601 bp, Human; identical to SEQ ID NO: 40283

SEQ ID NO: 167419 - DNA, 601 bp, Human; identical to SEQ ID NO: 40284

SEQ ID NO: 167420 - DNA, 601 bp, Human; identical to SEQ ID NO: 40285

SEQ ID NO: 167421 - DNA, 601 bp, Human; identical to SEQ ID NO: 40286

SEQ ID NO: 167422 - DNA, 601 bp, Human; identical to SEQ ID NO: 40287

SEQ ID NO: 167423 - DNA, 601 bp, Human; identical to SEQ ID NO: 40288

SEQ ID NO: 167424 - DNA, 601 bp, Human; identical to SEQ ID NO: 40289

SEQ ID NO: 167425 - DNA, 601 bp, Human
tctgtaaagcatagcctcagagccggcaaagcagaaatactgctgactctcctggctgttcacggaccggaggggagaaagttaagagtttgcacttactccacttgcaaaagcattcaactacagaggcggagggacggaggcctgggttcaaatcctgccctgccaactctccacatcgttgcagtgctttatgctgcgattttaggccaactgtttacaaaagcaatgaatgaatgtctacaggcagcgctcaaggagtaattttagttttgtgtgtgtgtgtgtgtgtgtgtgtgtccacgcgggttctcagtatcacccatcctctagtagtcacaccacaaataccctttgaattgaactaaatgcaaaatataatttgattatggaagcagttaaggaaagaaacacccacatgatccctggcacaattttgtactttttatttatttcgcaaacaatcatgtagcttgtacaggcactgttctgagcattttatacatactgactcacttatcctcgcaacagcactgtgagagtgcaggtgaggaaaccaagacccccagagattaaggaactcgttccaaaccacacagcc

SEQ ID NO: 167426 - DNA, 601 bp, Human
agcagtcccatatgtcgaatgaattaaatgaataaacaggagaatgaaggaataaacacaggaaggaacaagttcctgagtgtttgcaaaactatatctgaactatatctacttggtattctcttcttttggtttagtcttgctttatgagtatgccacagagaatatgtattatctgaatggtgcagaaacaaaatgtgatttcacagacagccccagccactgcctcgccacacatacgtgatctgtaagccctttctgctgtggccaggtagatcatacaaccggtctggcaaatggyccctttccctccacctctgccagctgagccctgattgctccaggctcccagtggctctgtcaggtgaacctgtgaccctccagcccagctcagcacccatttccttcccatcatctctcccccttccatcttcttggtgctcttgaacgctacttccacatcacttgaattccaaaaacaaaaatggcaatcgcagtaattgacatttatggagtgctcactatgtcccacgcagcataaggacttgcttccttaatcctcctaatgaccacactgtagcaggttaccagatgggtaact

SEQ ID NO: 167427 - DNA, 601 bp, Human
acagagtagcagtcccatatgtcgaatgaattaaatgaataaacaggagaatgaaggaataaacacaggaaggaacaagttcctgagtgtttgcaaaactatatctgaactatatctacttggtattctcttcttttggtttagtcttgctttatgagtatgccacagagaatatgtattatctgaatggtgcagaaacaaaatgtgatttcacagacagccccagccactgcctcgccacacatacgtgatctgtaagccctttctgctgtggccaggtagatcatacaaccggtctggyaaatggcccctttccctccacctctgccagctgagccctgattgctccaggctcccagtggctctgtcaggtgaacctgtgaccctccagcccagctcagcacccatttccttcccatcatctctcccccttccatcttcttggtgctcttgaacgctacttccacatcacttgaattccaaaaacaaaaatggcaatcgcagtaattgacatttatggagtgctcactatgtcccacgcagcataaggacttgcttccttaatcctcctaatgaccacactgtagcaggttaccagatg

SEQ ID NO: 167428 - DNA, 601 bp, Human
aggttaaatatgcccaatttcctcagtcagttctcacatgagaggctttaaattccttgtccagcctggattctcctctcctctgagactgtgtccagctgcctaacctggagactatggccaggactcttttagatggaaactaaatccagaacccactcacactggcctgagaaaaaatattacttggctcatgaaagtgaaccgtctaaagagaaagcttcaggcatggctggatcccagagttttctggcacgtcacctgtctccactcccaccaccaggctctgttcctgagttckcagacaggtactctctataaatggtagacatgccctgtgagctccaagccctcattattcttatttgttttaatcccagagaaagataaaaagactctttaccaacaactctgtccaaagtctcagggatgaatctgattggctagatttgagtcacaagggcccttgaaccaatcggttagcagaagagtggcttgctctgattggacaggtctgggttatgtgcactctcacaggaactacattggttgaccaggattattatgaaatggaagggagaggttcccccaaaggagggaa

SEQ ID NO: 167429 - DNA, 601 bp, Human
gtctcacaaggttaaatatgcccaatttcctcagtcagttctcacatgagaggctttaaattccttgtccagcctggattctcctctcctctgagactgtgtccagctgcctaacctggagactatggccaggactcttttagatggaaactaaatccagaacccactcacactggcctgagaaaaaatattacttggctcatgaaagtgaaccgtctaaagagaaagcttcaggcatggctggatcccagagttttctggcacgtcacctgtctccactcccaccaccaggctctgttcytgagttctcagacaggtactctctataaatggtagacatgccctgtgagctccaagccctcattattcttatttgttttaatcccagagaaagataaaaagactctttaccaacaactctgtccaaagtctcagggatgaatctgattggctagatttgagtcacaagggcccttgaaccaatcggttagcagaagagtggcttgctctgattggacaggtctgggttatgtgcactctcacaggaactacattggttgaccaggattattatgaaatggaagggagaggttcccccaaa

SEQ ID NO: 167430 - DNA, 601 bp, Human
aaagaaggatgtgtttgcttccccttttgccatgattgtaagtttcctgaggcctccccagccatgcaaaactgtgagccaattaaacctcttttctttacaaattacccagtcacgggtatttcttcatagcagcgtgagaagagactaacacactatccctgaattcctactgcgtggtcccatttaccacatagggttggtgtgggggtaggaacacaagaagtccacacttaccacatgacagcccctcaaacatctgaagacaacactggtatctcccaaggatctctcctcttgrtctcacaaggttaaatatgcccaatttcctcagtcagttctcacatgagaggctttaaattccttgtccagcctggattctcctctcctctgagactgtgtccagctgcctaacctggagactatggccaggactcttttagatggaaactaaatccagaacccactcacactggcctgagaaaaaatattacttggctcatgaaagtgaaccgtctaaagagaaagcttcaggcatggctggatcccagagttttctggcacgtcacctgtctccactcccaccaccaggctctgttcc

SEQ ID NO: 167431 - DNA, 601 bp, Human
tcagtctgtctcctgctgccacgtaaagaaggatgtgtttgcttccccttttgccatgattgtaagtttcctgaggcctccccagccatgcaaaactgtgagccaattaaacctcttttctttacaaattacccagtcacgggtatttcttcatagcagcgtgagaagagactaacacactatccctgaattcctactgcgtggtcccatttaccacatagggttggtgtgggggtaggaacacaagaagtccacacttaccacatgacagcccctcaaacatctgaagacaacactggtrtctcccaaggatctctcctcttggtctcacaaggttaaatatgcccaatttcctcagtcagttctcacatgagaggctttaaattccttgtccagcctggattctcctctcctctgagactgtgtccagctgcctaacctggagactatggccaggactcttttagatggaaactaaatccagaacccactcacactggcctgagaaaaaatattacttggctcatgaaagtgaaccgtctaaagagaaagcttcaggcatggctggatcccagagttttctggcacgtcacctgtctcc

SEQ ID NO: 167432 - DNA, 601 bp, Human
tctgggtccccacccaaatctcaccttgaattgtaataagtgtcaagggcaggacggggtggagataattgactcaggggggcagtttcccccatactgttttggtgatagttctcacaaaactgatggttttataaggggcttcccccttcacttggctctcagtctgtctcctgctgccacgtaaagaaggatgtgtttgcttccccttttgccatgattgtaagtttcctgaggcctccccagccatgcaaaactgtgagccaattaaacctcttttctttacaaattacccagtcaygggtatttcttcatagcagcgtgagaagagactaacacactatccctgaattcctactgcgtggtcccatttaccacatagggttggtgtgggggtaggaacacaagaagtccacacttaccacatgacagcccctcaaacatctgaagacaacactggtatctcccaaggatctctcctcttggtctcacaaggttaaatatgcccaatttcctcagtcagttctcacatgagaggctttaaattccttgtccagcctggattctcctctcctctgagactgtgtccagctgcctaacc

SEQ ID NO: 167433 - DNA, 601 bp, Human
ctgatatggtttggctctgggtccccacccaaatctcaccttgaattgtaataagtgtcaagggcaggacggggtggagataattgactcaggggggcagtttcccccatactgttttggtgatagttctcacaaaactgatggttttataaggggcttcccccttcacttggctctcagtctgtctcctgctgccacgtaaagaaggatgtgtttgcttccccttttgccatgattgtaagtttcctgaggcctccccagccatgcaaaactgtgagccaattaaacctcttttctttayaaattacccagtcacgggtatttcttcatagcagcgtgagaagagactaacacactatccctgaattcctactgcgtggtcccatttaccacatagggttggtgtgggggtaggaacacaagaagtccacacttaccacatgacagcccctcaaacatctgaagacaacactggtatctcccaaggatctctcctcttggtctcacaaggttaaatatgcccaatttcctcagtcagttctcacatgagaggctttaaattccttgtccagcctggattctcctctcctctgagactgtg

SEQ ID NO: 167434 - DNA, 601 bp, Human
ggttagtcggactctcctgacatacctcctgtgatgggggcctcactttctcctctggtagcccgttctaccttaagggcctcttcctctccaggtcaacccaaaatctatctgatatggtttggctctgggtccccacccaaatctcaccttgaattgtaataagtgtcaagggcaggacggggtggagataattgactcaggggggcagtttcccccatactgttttggtgatagttctcacaaaactgatggttttataaggggcttcccccttcacttggctctcagtctgtctccygctgccacgtaaagaaggatgtgtttgcttccccttttgccatgattgtaagtttcctgaggcctccccagccatgcaaaactgtgagccaattaaacctcttttctttacaaattacccagtcacgggtatttcttcatagcagcgtgagaagagactaacacactatccctgaattcctactgcgtggtcccatttaccacatagggttggtgtgggggtaggaacacaagaagtccacacttaccacatgacagcccctcaaacatctgaagacaacactggtatctcccaaggatc

SEQ ID NO: 167435 - DNA, 601 bp, Human
ggggctgtgagacaggagagtgcagaggcaaggaaggcctccttcaatcctttcttcaacatctatgccaagtggttagtcggactctcctgacatacctcctgtgatgggggcctcactttctcctctggtagcccgttctaccttaagggcctcttcctctccaggtcaacccaaaatctatctgatatggtttggctctgggtccccacccaaatctcaccttgaattgtaataagtgtcaagggcaggacggggtggagataattgactcaggggggcagtttcccccatactgttytggtgatagttctcacaaaactgatggttttataaggggcttcccccttcacttggctctcagtctgtctcctgctgccacgtaaagaaggatgtgtttgcttccccttttgccatgattgtaagtttcctgaggcctccccagccatgcaaaactgtgagccaattaaacctcttttctttacaaattacccagtcacgggtatttcttcatagcagcgtgagaagagactaacacactatccctgaattcctactgcgtggtcccatttaccacatagggttggtgtgggggtaggaa

SEQ ID NO: 167436 - DNA, 601 bp, Human
tctggctctccaaggaaaatgtcaggttcctcctcagtgaagtggggataatttctacttgtgggtgtcactctgctcattactccctcagagagaagataaattagataaactaacacacgcagagctcctacgtagggcctgggacttgggcatccctaaggtcagcatcgtgtgtgttggggacacacactggaggggtcggctggccagcacctgtcataaagggcaccccatgtcatgtctgagcgtttggaccttatggagaaaaggtgttggaagtgggaggcgggggagcaayctgacctgaaggttagaaagccacccctagcctggactgcaagctcactggggtcagggaaaggactcaactcagtacttggcaaagggcttggggcatagtagatgctcgagaaatgtcccggagaagacaaggtcatgatcaagggtggagccctaagaaacgcctagacttatcgggcaggaagcagaagcagcagcagaaggaagtgagaatgacaggagagagacataaaaggagaactaggcaagtctagccacgcagaagcagaagcacaagcgagggggactatcttttcag

SEQ ID NO: 167437 - DNA, 601 bp, Human
cagcccataagaagtagagctgaaatttgaacccaggcattacgggttctcttctataagcaagagacaaaggagtggacagccagcacgtgctgggaaaagcctatgacccaggattcagcccatgacttgggcccactcaagggagcaacacacccatgggggaaagagattggcagccatctaaccatgaaggatggggattccccgccaaggataccaccaccaaagggacaaagtccctctctccaggaggacttcgccaaggagttgaagaaacagacatgcacacgaccaccayacgggacaccaacaccacaaagacaaggagggcatccgagcagagggaacattcacaccgggccttgacgggtgtgtaggagtcctccaggaaggcgaaacagatgaagacagtgcaggcagagggaagagagtccacaggcctagggaagcgggaaggcaggccagcgcggcacaggggaagagctgagagcctcggacacagatctggattcaaagtgcagttcttcccaactgcagcatctccagcaagcgactctggctctccaaggaaaatgtcaggttcctcctcagtgaagtg

SEQ ID NO: 167438 - DNA, 601 bp, Human
aaaggacccctcaaccaatgggggataagagtcggtggctacgtgcccccgcctcccagggctgcaccctccatgttcctcttagggtccctgagggattctgtcccaggtgcccacagcagtaactgtaggattctgtcccaggcgcctacagcccataagaagtagagctgaaatttgaacccaggcattacgggttctcttctataagcaagagacaaaggagtggacagccagcacgtgctgggaaaagcctatgacccaggattcagcccatgacttgggcccactcaagggagcmacacacccatgggggaaagagattggcagccatctaaccatgaaggatggggattccccgccaaggataccaccaccaaagggacaaagtccctctctccaggaggacttcgccaaggagttgaagaaacagacatgcacacgaccaccacacgggacaccaacaccacaaagacaaggagggcatccgagcagagggaacattcacaccgggccttgacgggtgtgtaggagtcctccaggaaggcgaaacagatgaagacagtgcaggcagagggaagagagtccacaggcctaggga

SEQ ID NO: 167439 - DNA, 601 bp, Human
aaactaagtacagaactaaaaacaagatctatggcaggttaatttcaaaatgcactcatgaaataaaatattaaatgctgacgtgccatgcctgccttcaaaaaccagcctctggggacctgccactgctgaggccactgagctgaatcagaaaagtcacaggcacttgcttaagtgggagaggaaggtggcgatgcctgggctctggagtaagaggcctggggccagagcagtcacatggccagtggtagcggccgggagccttgtgggccactgggctgttactttggaggaggggacrgcgggccctcctgtgtgagcttagctctcagacatctacatggactgtcactcatttgcctactcaacaacatctgtgcaggctgccaggtactgttcccagcgctgccaatactgcagagaacaaagctgacctggttgccccacggggcttggatgctcccaggaaagtcacaagataaacaggtgcataactgcacatgtggctatgatcttaggcactgctaaatgctgcaaggagatgctttttgactccttgtcaccttctccaaggccatgtctggtttcagtggtagtgggc

SEQ ID NO: 167440 - DNA, 601 bp, Human
agccaaagaatgcaggcagtctctggaagcacaagaaggcaagaaaatggattctcccctggagcctccaggagaaagcagccctgtccacacctggattttagtcctgtgaggctcatgtcagacttttgacttgcagaactataagatgatgcatttatgttgttttaattcaccaagtttgtggtcatttgttacagtggccataggaaagtaacacaatgaccctggctaatgcctggcctaataaaggtccactgttaaccattgttgttatcaacttatttatttattgctcgcwaggaagcttacctaagtacctagaagacaaagtaagaataagtgcatgaagaaaagcgtgatgaccataaactaagtacagaactaaaaacaagatctatggcaggttaatttcaaaatgcactcatgaaataaaatattaaatgctgacgtgccatgcctgccttcaaaaaccagcctctggggacctgccactgctgaggccactgagctgaatcagaaaagtcacaggcacttgcttaagtgggagaggaaggtggcgatgcctgggctctggagtaagaggcctggggccagagca

SEQ ID NO: 167441 - DNA, 601 bp, Human
ggctgtggctgtaggggtcacacaggggccgccaggagcctggctctttgcatctcaagccaggttcttttcacccctcccccagctccagctgacccctggcccgcctgaagcagcagcagcttttatttgcaagccatgaacaatacactccattttataagcagcgtagaattctagccagaaacggggagaaaagtgcttccgggtcagagcagacctccaaaggcgagccctgcaggcaaaagtagggaaatcgggatttcctgggaaagtctctccagggcaggagggaacactygggttcaggaattaaggagcattgctccccagacacacgcacaggctttctgtgtcaacaacaatggcagaaatggcctctaaacaacagtggcctctaaacacttcccacggccccccatggcctgggcctgggccttaggtctgccccacggtgttccacagaagagcctcccgtggtcttcccttcttgtttcacaaagattttacattgcaagctggggtgcagggggtgtcaggagtgggggcgagaagcacacacgccaggtaagaattgcagcctggcctgcgtactgcctcg

SEQ ID NO: 167442 - DNA, 601 bp, Human
aaagtcacccaggaagagagtgtggtgttcccaagaatgggccacacagcagccaggtttggccaaatccagagagctgcagggtggacacagccctctctctgtccctctgttaggcaggggcccagagggggctgtggctgtaggggtcacacaggggccgccaggagcctggctctttgcatctcaagccaggttcttttcacccctcccccagctccagctgacccctggcccgcctgaagcagcagcagcttttatttgcaagccatgaacaatacactccattttataagcagcrtagaattctagccagaaacggggagaaaagtgcttccgggtcagagcagacctccaaaggcgagccctgcaggcaaaagtagggaaatcgggatttcctgggaaagtctctccagggcaggagggaacactcgggttcaggaattaaggagcattgctccccagacacacgcacaggctttctgtgtcaacaacaatggcagaaatggcctctaaacaacagtggcctctaaacacttcccacggccccccatggcctgggcctgggccttaggtctgccccacggtgttccacagaaga

SEQ ID NO: 167443 - DNA, 601 bp, Human
cccctgctctccaccctcactccccacccacgctcccctcccacggcccccaccccatggccctactaggttcctgtcctcctgcccacccaggagcctcatcctccttttttctttatgctttttcatcctaagatatgatttacacagcatgaactgcaccctgtgaaagtggacatttcagtgggtttcggtccattcacaaggttgtgcatggtgatgcaccccactgagctctcccagcacgagtgcccagcagaccgtgagtgctcagtttatatgtgttggggggatgagtgaycaaagtcacccaggaagagagtgtggtgttcccaagaatgggccacacagcagccaggtttggccaaatccagagagctgcagggtggacacagccctctctctgtccctctgttaggcaggggcccagagggggctgtggctgtaggggtcacacaggggccgccaggagcctggctctttgcatctcaagccaggttcttttcacccctcccccagctccagctgacccctggcccgcctgaagcagcagcagcttttatttgcaagccatgaacaatacactccattttataagcag

SEQ ID NO: 167444 - DNA, 601 bp, Human
ccatgctccctgctccacagccctcaccccatggcccccacctacactaccccctactccccaacccctgcgctccccatccacactcaccggccatagccctcatgccacggtccccaccccctgctccccaccccacactcaccctccacagccctcaccccctgctctccaccctcactccccacccacgctcccctcccacggcccccaccccatggccctactaggttcctgtcctcctgcccacccaggagcctcatcctccttttttctttatgctttttcatcctaagatatkatttacacagcatgaactgcaccctgtgaaagtggacatttcagtgggtttcggtccattcacaaggttgtgcatggtgatgcaccccactgagctctcccagcacgagtgcccagcagaccgtgagtgctcagtttatatgtgttggggggatgagtgatcaaagtcacccaggaagagagtgtggtgttcccaagaatgggccacacagcagccaggtttggccaaatccagagagctgcagggtggacacagccctctctctgtccctctgttaggcaggggcccagagggggctgt

SEQ ID NO: 167445 - DNA, 601 bp, Human
gccttctcacccatgctcccctcccactccccacccatgctccctgctccacagccctcaccccatggcccccacctacactaccccctactccccaacccctgcgctccccatccacactcaccggccatagccctcatgccacggtccccaccccctgctccccaccccacactcaccctccacagccctcaccccctgctctccaccctcactccccacccacgctcccctcccacggcccccaccccatggccctactaggttcctgtcctcctgcccacccaggagcctcatcctycttttttctttatgctttttcatcctaagatatgatttacacagcatgaactgcaccctgtgaaagtggacatttcagtgggtttcggtccattcacaaggttgtgcatggtgatgcaccccactgagctctcccagcacgagtgcccagcagaccgtgagtgctcagtttatatgtgttggggggatgagtgatcaaagtcacccaggaagagagtgtggtgttcccaagaatgggccacacagcagccaggtttggccaaatccagagagctgcagggtggacacagccctctctctg

SEQ ID NO: 167446 - DNA, 601 bp, Human
tacggattcacttattcattaccccatgcaacatccgaggcagaacctcccctcttcccaaaggactgaggcaacgaagtgtgactcagccagggctctgcgccaggctctgagtgaacacactgaaacccggccgtgggtacaacacggcgtcacagctctgccgtaaacacagggggacccactgagagcccaggggaccagcaagcctccccctggaggtctcctcatcggtgacacagcacgttgatcctcatcagccagctgagggggtgatgccctgggaatcgggcctggcacmcaggaagtgttgggaagcgctaggtgaggatgataaggacaaggcggccttgggaccaacggtgacaatggcaacagactatgaagcgaatggaggcagtgggggagccgggagttcagaggggagaggcagggctgtgctcagggaaaagggctgctcagggcctgtggggttggcgcatcatgcctggggacccagaagaagtggcagaataagaccctgcccagctgggaatgagccacagaaagggccaaggcaaagttctaggaggacatgaaacaaaagtgatcagaataaaat

SEQ ID NO: 167447 - DNA, 601 bp, Human
cttcccctctctgccccccagttccccggaggcctctccatctctgcctgggagcccctggttggtgggggcagactcgcagccagttttccttccccgtggactttaacaacactccagcccgcaagcctgcgcacaccagcccccacggggacagctgactcactttactcttctacggattcacttattcattaccccatgcaacatccgaggcagaacctcccctcttcccaaaggactgaggcaacgaagtgtgactcagccagggctctgcgccaggctctgagtgaacacactgaaacccggccgtgggtacaacacggcgtcacagctctgccgtaaacacagggggacccactgagagcccaggggaccagcaagcctccccctggaggtctcctcatcggtgacacagcacgttgatcctcatcagccagctgagggggtgatgccctgggaatcgggcctggcacacaggaagtgttgggaagcgctaggtgaggatgataaggacaaggcggccttgggaccaacggtgacaatggcaacagactatgaagcgaatggaggcagtgggggagccgggagttcagagggg

SEQ ID NO: 167448 - DNA, 601 bp, Human
aaaaaaaaaaagaataaaaccaattctttgtcaggatttttaaagtgtgacttccacccccagagagcaggaatgaatagacaggcaggaacgaatggatatggacagacataacaactgatttgttttgacaaatttgtggtttaataaaagcacatgtggccagacgcagtggctcatgcctgtaatcccagcactttgggaggccaaggcgagcagatcacttgagctcaggaattcgagaccagcctggccaacccggcaaaaccctgtctctactaaaaatacaaaaattagccaytcatggtggtgcacacctgtaatcccagctactcgggaggctgacgtaggagaattgcttgagtccaggaggcagaggttgcagtaagctgagatcatgccactgcactccagcctgggcgacagagacttcatctcaaaaaaaaaaaaaagtgcatggaaagggaaggacaaaaaggcagtgttgctggagtcagcgatgccagagtcagtgatgcctgcgtaacaaggaagctgcttctccacctttcacatgcaccaagaacggtagcccagagggacgcagctggcttgaaacctc

SEQ ID NO: 167449 - DNA, 601 bp, Human
tacaggcgcgagccactgcgcccggccaaggctctgtttctttatgtgatccgcattgtgtgggtatctgcgtgtaggcacattgtttctgcattggagctcacactgtaaatgcggtttgatatcccacgcaggagactcctcaaatgatccccgattcattgcattttcactaggtgtgaatgacccagctttcctagcttgacagagaacataagaaaatgaagtacaggatggccagaggaaaagaaagatgattacttcggcagaacctccggggtataagctgatctggataccsaaattaaaccgagagctaaaggttttccccctatgacaaagcactagcactttctttcatgataattctctacttccttaaatgggagttagtgtgttagacctgactccaccctctgacttagagaagagtggctgtaagcagtccctggaggctctgaggaccttattacagtatctatagcatctataaggagacgctgcgccactgaggggttcagcgtctggctcccaatcactgaacagccctggcacacactgctttatactcttgtgtctgcttttcactgttgtgctgcct

SEQ ID NO: 167450 - DNA, 601 bp, Human
ctcagtctcccaaagagccaggattacaggcgcgagccactgcgcccggccaaggctctgtttctttatgtgatccgcattgtgtgggtatctgcgtgtaggcacattgtttctgcattggagctcacactgtaaatgcggtttgatatcccacgcaggagactcctcaaatgatccccgattcattgcattttcactaggtgtgaatgacccagctttcctagcttgacagagaacataagaaaatgaagtacaggatggccagaggaaaagaaagatgattacttcggcagaacctccrgggtataagctgatctggataccgaaattaaaccgagagctaaaggttttccccctatgacaaagcactagcactttctttcatgataattctctacttccttaaatgggagttagtgtgttagacctgactccaccctctgacttagagaagagtggctgtaagcagtccctggaggctctgaggaccttattacagtatctatagcatctataaggagacgctgcgccactgaggggttcagcgtctggctcccaatcactgaacagccctggcacacactgctttatactcttgtgt

SEQ ID NO: 167451 - DNA, 601 bp, Human
cagttgacaaaaacaaaaccaaaccaaaaacaccctcctgtcctgctcaaaaaactttgcaaaagtattaaaaagtgtaaaaactgaaacccattactctgtttatttctaaactccttttggtttattccttatagggcatgaataaaggctctttttttttttttttttttgagacgaaatctcgctctgttgtccagcctgcagtgccgtggcacgatctcagcttactgcaacctccgcctcctgggttcaagcgattctcctgcctcagcctcctgaatagcagggattacaggcrcctgccaccatgctcggctaatttttgtagttttagtacagacgggctttcaccgtgttggccaggctgatctcgaacccctgacctcaggtgaactgcccgcctcagtctcccaaagagccaggattacaggcgcgagccactgcgcccggccaaggctctgtttctttatgtgatccgcattgtgtgggtatctgcgtgtaggcacattgtttctgcattggagctcacactgtaaatgcggtttgatatcccacgcaggagactcctcaaatgatccccgattcattgcattttcac

SEQ ID NO: 167452 - DNA, 601 bp, Human
agttgaagggagagctctcattactaagaggcctgatatcactataccacttgctgtcttttttcagagtgactttcctaactccctgcagttgacaaaaacaaaaccaaaccaaaaacaccctcctgtcctgctcaaaaaactttgcaaaagtattaaaaagtgtaaaaactgaaacccattactctgtttatttctaaactccttttggtttattccttatagggcatgaataaaggctctttttttttttttttttttgagacgaaatctcgctctgttgtccagcctgcagtgccgyggcacgatctcagcttactgcaacctccgcctcctgggttcaagcgattctcctgcctcagcctcctgaatagcagggattacaggcgcctgccaccatgctcggctaatttttgtagttttagtacagacgggctttcaccgtgttggccaggctgatctcgaacccctgacctcaggtgaactgcccgcctcagtctcccaaagagccaggattacaggcgcgagccactgcgcccggccaaggctctgtttctttatgtgatccgcattgtgtgggtatctgcgtgtaggcacattg

SEQ ID NO: 167453 - DNA, 601 bp, Human
ggaaagaattcttacatcctgctgcccagagcaaggggacagctgggcagtcgccatggcagcggctggcttctagcaggctgctaaggggagagagggcaaggctggggaaggagaaatgtcttcttgccaccaaagaggaaggagggctcagtggccgcccacgtctgtaagagggagggggcctgaggctggggctggaaggggccaggttcgttgctgaagttgaagggagagctctcattactaagaggcctgatatcactataccacttgctgtcttttttcagagtgactttcstaactccctgcagttgacaaaaacaaaaccaaaccaaaaacaccctcctgtcctgctcaaaaaactttgcaaaagtattaaaaagtgtaaaaactgaaacccattactctgtttatttctaaactccttttggtttattccttatagggcatgaataaaggctctttttttttttttttttttgagacgaaatctcgctctgttgtccagcctgcagtgccgtggcacgatctcagcttactgcaacctccgcctcctgggttcaagcgattctcctgcctcagcctcctgaatagcagg

SEQ ID NO: 167454 - DNA, 601 bp, Human
gccaaaccttgagacccactgacttagaggaagaggtggagaagaggaaatggtgagaactcactgctgggagaggggacgagacaaaggtctcaaggacagaaaagctgaagtgctcagagttcagcccccacgccctccttgctgcctgtctgccttttattttaagcaaatgactgcatgaagcagcttcctgcagagtccgtggttcctgagcacgcccatcaaagaccaccaggacagtccctccagtgctccctccccaaaatcccacaccccaagagagggaacagccatcatkagcaagagagctactgactatcagccctgggtaccaggaggcctttctgcctgtgctgcctctagctcctctgcttgcccataagccacgaggattcagatgcatatcatagcatcacactgagccccatctcagggctgccgtcactgaggatacagcaaggtcaggagccccatcctgaggacggtggtttccttctggtcggtgtcatgcactcagagcccaggccaattgcacgctggatgtccctgatttgaagactatggatgccctccccttcccacccagagagagtcttgt

SEQ ID NO: 167455 - DNA, 601 bp, Human
atcagcagtggggagccctaggctccctcgtctatgtcgggctattgtcactcctgtacgcgggaacactggcatatctactaaagggcacagagaaacgctgtcatgtatatattagtgtgacatgtgtgtgcgtatatatttgtgtatgtgtatatatacatatatttatgtgtataatatgtgtctatatgtgtacaggtgtgtttgtatatgtgtgtatatacatacatttgtgagtacaggtgtatatatgtgtgtatatatattcatgtatttgtgtatgtgtgttatatatacwtgtatgtgtatgtgtgtgttatatatatacatgtatgtgtatgtgtatgtgtgttatatatacatgtatgtgtatatgtgtgtgtgtatgcactaagacggcaaaactgcccagaagaaggttggtacctgggctttccatcaccctcactgtgccacttggtccccaacagggccaatggtccatctcttcaaactgaagctgagagtccaggtctaggcagaggagacagggagactgggcaaccccagtgggggacgggggacccaggacttcacccaaacacaggtaccagagaca

SEQ ID NO: 167456 - DNA, 601 bp, Human
gttctcggtcccttttgacctcacactgggcagtggaaggggaatcgctagttcttcatccctggttcagttactttccctcttctgaacaaattgggtccacaaaccccagtggcagtcacagccccacatcagcagtggggagccctaggctccctcgtctatgtcgggctattgtcactcctgtacgcgggaacactggcatatctactaaagggcacagagaaacgctgtcatgtatatattagtgtgacatgtgtgtgcgtatatatttgtgtatgtgtatatatacatatatttrtgtgtataatatgtgtctatatgtgtacaggtgtgtttgtatatgtgtgtatatacatacatttgtgagtacaggtgtatatatgtgtgtatatatattcatgtatttgtgtatgtgtgttatatatacatgtatgtgtatgtgtgtgttatatatatacatgtatgtgtatgtgtatgtgtgttatatatacatgtatgtgtatatgtgtgtgtgtatgcactaagacggcaaaactgcccagaagaaggttggtacctgggctttccatcaccctcactgtgccacttggtccccaac

SEQ ID NO: 167457 - DNA, 601 bp, Human
cccggcagactggaggcctctccccaaccctgctcaccctgaaggaggttctcggtcccttttgacctcacactgggcagtggaaggggaatcgctagttcttcatccctggttcagttactttccctcttctgaacaaattgggtccacaaaccccagtggcagtcacagccccacatcagcagtggggagccctaggctccctcgtctatgtcgggctattgtcactcctgtacgcgggaacactggcatatctactaaagggcacagagaaacgctgtcatgtatatattagtgtgayatgtgtgtgcgtatatatttgtgtatgtgtatatatacatatatttatgtgtataatatgtgtctatatgtgtacaggtgtgtttgtatatgtgtgtatatacatacatttgtgagtacaggtgtatatatgtgtgtatatatattcatgtatttgtgtatgtgtgttatatatacatgtatgtgtatgtgtgtgttatatatatacatgtatgtgtatgtgtatgtgtgttatatatacatgtatgtgtatatgtgtgtgtgtatgcactaagacggcaaaactgcccagaagaaggtt

SEQ ID NO: 167458 - DNA, 601 bp, Human
gtttttgcagctgcccggcagactggaggcctctccccaaccctgctcaccctgaaggaggttctcggtcccttttgacctcacactgggcagtggaaggggaatcgctagttcttcatccctggttcagttactttccctcttctgaacaaattgggtccacaaaccccagtggcagtcacagccccacatcagcagtggggagccctaggctccctcgtctatgtcgggctattgtcactcctgtacgcgggaacactggcatatctactaaagggcacagagaaacgctgtcatgtayatattagtgtgacatgtgtgtgcgtatatatttgtgtatgtgtatatatacatatatttatgtgtataatatgtgtctatatgtgtacaggtgtgtttgtatatgtgtgtatatacatacatttgtgagtacaggtgtatatatgtgtgtatatatattcatgtatttgtgtatgtgtgttatatatacatgtatgtgtatgtgtgtgttatatatatacatgtatgtgtatgtgtatgtgtgttatatatacatgtatgtgtatatgtgtgtgtgtatgcactaagacggcaaaactgc

SEQ ID NO: 167459 - DNA, 601 bp, Human
tcgcccaggctggagtgcagtggcgcgatctccgctcactgcaagctccgccttccgggttcacaccattctcctgcctcagccccccgagtagctgggactacaggcgcccgccaccacgcccggctaattttttgtatttttagtagagacggggtttcaccgtggtcttgatctcctgacctcgtgatccgcccacctcggcctcccaaagtgctgggattacaagcgtgagccaccgcgcccggccattttaaccactttaaagcatccaattcagtggctttaaggacactcacartgttgtgccatcatcgctactatctaatttcaccactccaacgagaactcccgtcctcaagaacagtcactccccattctccaccccactcccccaggccctggcagccactcttccactttctgtctctatggattggcctgtgctggacatttcattgaaatggactcatatgctatgtggcctctgcggtctggctttcactcagcgtcacatctccaaggatcatccctgctgccgcatgtgcgggtcaccacttcattccttttatggctgaacagcactccattgcatggagag

SEQ ID NO: 167460 - DNA, 601 bp, Human
agaaggtgaggacagaggagtccagggcacaggagaccccgaggggtgagggccccacctcccatgccccggggactgtgcctgaattcccaaacatcagcctgggctgcctcacctgtaaaacacgttcttttctttattgagataaaagtcacataacataaaattcaccattttaaccactttttttttttttgagaagggagtctcgctccgtcgcccaggctggagtgcagtggcgcgatctccgctcactgcaagctccgccttccgggttcacaccattctcctgcctcagccycccgagtagctgggactacaggcgcccgccaccacgcccggctaattttttgtatttttagtagagacggggtttcaccgtggtcttgatctcctgacctcgtgatccgcccacctcggcctcccaaagtgctgggattacaagcgtgagccaccgcgcccggccattttaaccactttaaagcatccaattcagtggctttaaggacactcacaatgttgtgccatcatcgctactatctaatttcaccactccaacgagaactcccgtcctcaagaacagtcactccccattctccac

SEQ ID NO: 167461 - DNA, 601 bp, Human
cttaaaggaaactgatcgtcatcaccactcacattggcacagcacttttcagtttacaaaacatgcttctatttcatctcatttggtctttgtaacaacgctgggaggcagatgaggtagagacgtcatggccactttcatcatcaacatccaaatcaccttcattgataagggctggaggctcagaggccacgtgatgtggccagactctcaacacgaggccagagccaagggcctggacaccttgggtgtgtgtgctcagccccctttctccagggaaatgccccaccaggccatggcyatctgggggtcagtaggtaacaacgcagcagggatagaaggaaggatggtctcagggacactgcgcaggtgaatccacagggcctggtgaccaactggatgtgagaaggtgaggacagaggagtccagggcacaggagaccccgaggggtgagggccccacctcccatgccccggggactgtgcctgaattcccaaacatcagcctgggctgcctcacctgtaaaacacgttcttttctttattgagataaaagtcacataacataaaattcaccattttaaccactttttttttttttg

SEQ ID NO: 167462 - DNA, 601 bp, Human
ggactccacaacacttacttcttaaaggaaactgatcgtcatcaccactcacattggcacagcacttttcagtttacaaaacatgcttctatttcatctcatttggtctttgtaacaacgctgggaggcagatgaggtagagacgtcatggccactttcatcatcaacatccaaatcaccttcattgataagggctggaggctcagaggccacgtgatgtggccagactctcaacacgaggccagagccaagggcctggacaccttgggtgtgtgtgctcagccccctttctccagggaamtgccccaccaggccatggctatctgggggtcagtaggtaacaacgcagcagggatagaaggaaggatggtctcagggacactgcgcaggtgaatccacagggcctggtgaccaactggatgtgagaaggtgaggacagaggagtccagggcacaggagaccccgaggggtgagggccccacctcccatgccccggggactgtgcctgaattcccaaacatcagcctgggctgcctcacctgtaaaacacgttcttttctttattgagataaaagtcacataacataaaattcaccatttt

SEQ ID NO: 167463 - DNA, 601 bp, Human
gtagagcgatatgtttgcttctcaaacattgtgtggatttgaatcactggggaaatcttaaacgcagcttctgattaaacagctctggggtctacgcttctaagaagcttcccagtgatgctgatgctactggtcaaaggatcacactgagttaaaaaaaaaaaaaaaaaatcaatctgcgtttcttcctagaatctaagtacgtccctgcagagtcccgcacgaagcatgtaggttagcaccaagacccaaggacacaaaccacctgtctacaggagatactggcctgcagctgacaagytcacttcctggtgattatctcaaaaccggagggggtaaccagcacgttcgccttcaacaagaagccgggtggtctaacgggtcatccatttgtccccgggagctaaggaacacgcagctctcagcagaccatgaatgcgtgatcctagctgcagtccagggtcagggactccacaacacttacttcttaaaggaaactgatcgtcatcaccactcacattggcacagcacttttcagtttacaaaacatgcttctatttcatctcatttggtctttgtaacaacgctgggaggcagatga

SEQ ID NO: 167464 - DNA, 601 bp, Human
tttgaatttttaaagtgatgtgtgtattggccaggtatggtggctcacccctgtaatcccagcactttgggaggcaaaggtgggaggatcacttcagcccaagagcttgagaccaacctgggcaacatggagaaatcacctctctaaaaaaaaaaaaaaaaaaaaaaaaaaaaacccaaaaaattagctgggcacggtggcaggcacctgtagtcccagctaccagggaggctaaggtgggaggatcacttgagcccaggaggttgagactgcagttgagtagagattacgccactgtackccagcctgggtggccaactgagaccctgtctcaaataaaataaaataaaataaaataaaataaaataaaataaaataaaataaaataaaataaaaatatgtgcgtgcatgtgtatgtgtgcattgcatgtgtgtgcgtgtgcatgcgggtgcatgtgtaccccactaggataaaccaaaattgttcaacatcagctcaactggcatctggggccagatcattctctctggtaggaaccatcccgtaaattgcagggtgctgagcagcacccctcacctggccccaccagttatgacaaac

SEQ ID NO: 167465 - DNA, 601 bp, Human
tagtagagatggggtttcactgtgttagccaggatgaatcttgatctcctgaccttgtattccacccgcctcagcctcccaaagtgctgggattacaggcgtgagccaccgcgcccagcctgattttttgaatttttaaagtgatgtgtgtattggccaggtatggtggctcacccctgtaatcccagcactttgggaggcaaaggtgggaggatcacttcagcccaagagcttgagaccaacctgggcaacatggagaaatcacctctctaaaaaaaaaaaaaaaaaaaaaaaaaaaaamccaaaaaattagctgggcacggtggcaggcacctgtagtcccagctaccagggaggctaaggtgggaggatcacttgagcccaggaggttgagactgcagttgagtagagattacgccactgtactccagcctgggtggccaactgagaccctgtctcaaataaaataaaataaaataaaataaaataaaataaaataaaataaaataaaataaaataaaaatatgtgcgtgcatgtgtatgtgtgcattgcatgtgtgtgcgtgtgcatgcgggtgcatgtgtaccccactaggataaa

SEQ ID NO: 167466 - DNA, 601 bp, Human
gatatggctccgaggatatttcacttatgactagggcaattaggtcaacaatgaattctgaacacatttccattggctgtgttatgcttgttctatcttatatagtcatttttattaaaatggctttgagggctattttgttccattgatccacattaagttttatttcaatgccacactgtttttattatcatgactttaaaatttgtttcacaatccactatgctaagttcccccaccctccactgctctgtattatcaaaatatcatttgatattctggaatttttttttttttttttgagacagagtctcgctctgtcgcccaggctgaagtgcagtggcgcgatctcgactcactgcaagcttggcctctagggttcacaccattctcctgcctcagcctcccgagtagctgggactacaggcgcccaccaccacacctggctaattttttgtatttttagtagagatggggtttcactgtgttagccaggatgaatcttgatctcctgaccttgtattccacccgcctcagcctcccaaagtgctgggattacaggcgtgagccaccgcgcccagcctgattttttgaattttta

SEQ ID NO: 167467 - DNA, 601 bp, Human
gctcaaagtctgggtgggcccattgcacagatgtgggtgccgccagcagtgccagggcccagccaaaaaaaatttaaaaataaaaatttaaaaaggctcaaattatggatcttatttagggaccagaaattcatcctctttgtagaccagaaattcatcaactctttttgcctcaatctttgcagtttggaatgagactctacactgtagagagacaggaggggcaaggggggtgctgggtatgaagaggaaacaaagaaaatggctcttaatttggcccgggatatggctccgaggatayttcacttatgactagggcaattaggtcaacaatgaattctgaacacatttccattggctgtgttatgcttgttctatcttatatagtcatttttattaaaatggctttgagggctattttgttccattgatccacattaagttttatttcaatgccacactgtttttattatcatgactttaaaatttgtttcacaatccactatgctaagttcccccaccctccactgctctgtattatcaaaatatcatttgatattctggaatttttttttttttttttgagacagagtctcgctct

SEQ ID NO: 167468 - DNA, 601 bp, Human
cccgtaccccaagtgaacaaccttggaagtttctgacattgcaaatgtccattttctttaatggccagaatggaaaagacttaaagtaggcactgttcagagagggtacaaatgaattctcccacgggatccttgcgaccaccgccgacagtcagccaggacaccacagggtagtggccgctattcgggtccccccaccagttcccgtctctagaagcaagcaacctgccccacccacggaggcaggcacccagctgccaagcttctgttatgggataggtgggatcgtaaacacagttamctcctcctagccagcatcctgaaacaattctggtgacatttcaccaatggctttactggtgcagagacatagcatggcttgtcccaagtcacagctaagctacagacccaggagtcgaacccagccctctccctccttgcaggatggtgacccttggcgagctttgacctccagactctggaggaactcagtacctgtacgacctccttcaccagggtcttgtccgtcccggttttggcgcgctgcagcccgctgacgttctcaccgatccacgtgatgagggcaaacttggacctcttg

SEQ ID NO: 167469 - DNA, 601 bp, Human
tcagattttcttttctcaacatgaccgtgttacccgtaccccaagtgaacaaccttggaagtttctgacattgcaaatgtccattttctttaatggccagaatggaaaagacttaaagtaggcactgttcagagagggtacaaatgaattctcccacgggatccttgcgaccaccgccgacagtcagccaggacaccacagggtagtggccgctattcgggtccccccaccagttcccgtctctagaagcaagcaacctgccccacccacggaggcaggcacccagctgccaagcttctgytatgggataggtgggatcgtaaacacagttacctcctcctagccagcatcctgaaacaattctggtgacatttcaccaatggctttactggtgcagagacatagcatggcttgtcccaagtcacagctaagctacagacccaggagtcgaacccagccctctccctccttgcaggatggtgacccttggcgagctttgacctccagactctggaggaactcagtacctgtacgacctccttcaccagggtcttgtccgtcccggttttggcgcgctgcagcccgctgacgttctcaccga

SEQ ID NO: 167470 - DNA, 601 bp, Human
tccttttgcgaaatggagatccctttagtagggaaagacctctctccctcatctaccctaccccggggttaccttttggagttcagattttcttttctcaacatgaccgtgttacccgtaccccaagtgaacaaccttggaagtttctgacattgcaaatgtccattttctttaatggccagaatggaaaagacttaaagtaggcactgttcagagagggtacaaatgaattctcccacgggatccttgcgaccaccgccgacagtcagccaggacaccacagggtagtggccgctattckggtccccccaccagttcccgtctctagaagcaagcaacctgccccacccacggaggcaggcacccagctgccaagcttctgttatgggataggtgggatcgtaaacacagttacctcctcctagccagcatcctgaaacaattctggtgacatttcaccaatggctttactggtgcagagacatagcatggcttgtcccaagtcacagctaagctacagacccaggagtcgaacccagccctctccctccttgcaggatggtgacccttggcgagctttgacctccagactctggaggaa

SEQ ID NO: 167471 - DNA, 601 bp, Human
tcaagatagcacattgcagatagcctatttttttgtttgtttttctttttgcaacagggtctcactcagtctgactacactcactcagtctgagtgcagtggcgagatcttggctcactgcagcctcgccctcctaggctcaagccatcctcccacctcagcctcccaagtagctgggactaccggtatgcaccaccacacagggctaattttttattcttttgtacagatggagtattattaatactatgttgcccaggctggtcttgaactcttggacacaagcaatcctcccaccttwgcctcccaaagtgctgagatgacaggtgtgagtcactgtgctcagcccgtttttgtttttgacaatttggtgatttctggtatattcacagatatgtgcaaccaccatgatagtcaattttaaagcattttcatgacctcaaaaagaaaccctgtgtctttagctatcacccacttccatcattagactattattttttatttgttttttatttattttgagacaggaattcgctctgttgcccaggctggagtgcagtggtgcgatcatggctcactgcacccttgacctcctggtttc

SEQ ID NO: 167472 - DNA, 601 bp, Human
gccaggagggacgtccaaaagcgggaactgacagggggaccacaggactctattatgtcctatcattatttatttatttatttatttattttatttatttttttggagactcgctccaaaaaaggctagatcttggctcactgcaacttccgcctcctggtttcaagagattctcctgtctcagcctcctgagtaggtgggattacaggtgcccaccaccacacccggctaatttctgtatttttagcagagacagagttttgccatgttggccaggctggtctcaaactcctgaccttasgtgatccgcctgccttggcctcccaaagtgctaggattacaggagggagccatgacacctggccatattgttattttttaaataaaagttttattaggggctgggcgtggtggcctataatccaagcactttcggaggctgaggtgtaggaatgcttgagtccaggaattcgaggccagcctgggcaatatagtgagatcctgtctctcttaaaaataataataataataataataataataatttattttagaagagctttggagttacagaaaagttgcaagaggtagcaccgagttt

SEQ ID NO: 167473 - DNA, 601 bp, Human
ttggaagcaacttaagaggccaagaacaggggaacatttagtacatgacggtacacttgtgaaccaggacactctgctaccagaaaaccatgaattacaaaggtggtgcatccatatcatttatgaaattacattaaccttaaaaaaagcagctgcagatgagagtgtgacctataggctgggaccacagcaaagccgaaaggcaggaggcgagcccgtccagagagtggccaggagggacgtccaaaagcgggaactgacagggggaccacaggactctattatgtcctatcattatttwtttatttatttatttattttatttatttttttggagactcgctccaaaaaaggctagatcttggctcactgcaacttccgcctcctggtttcaagagattctcctgtctcagcctcctgagtaggtgggattacaggtgcccaccaccacacccggctaatttctgtatttttagcagagacagagttttgccatgttggccaggctggtctcaaactcctgaccttacgtgatccgcctgccttggcctcccaaagtgctaggattacaggagggagccatgacacctggccatattgt

SEQ ID NO: 167474 - DNA, 601 bp, Human
aagtccttcacagagtgtcaggcacatagtagggccacaataaaactattgttattcatattattgccacattggtacccaaaagaggccctcagaggggaggggtggctaaatctggtcccagaaatgaagccgatcctgcccctggggtttatttttatttatttatttacttatttttgagacagggttttcctctgtcacccaggctggaatgcaatgacacgagcacagctcatgcagcctccaactcctgggctcaagcgatcctcccacctcagactcctgagtagctgggacwacaggcatgcgacaccatgccccagctaatttttttttgtttttagtagagacgaggtcccactatgttgaccaggctggtctccaactcctgggctcaagcaatcctcctgccttggtctcccaaaatgttgggattacaggtgtgcgccactaagcctggttagtcctggggctcagaagctatcagaatagactccaattggctagttcacaccatccctggcacgtccatccttcccacctccacttctccttggaggcagcagcctctgttgtcctctgttcctgaaagctgagc

SEQ ID NO: 167475 - DNA, 601 bp, Human
tgggcagatcacctgaggtcagtttgagaccagcctggccaacatggtgaaaccccatctctactaaaaatacaaaaattaggctgagcatggtggcagatgcctgtggtcccagctacttgagaggctgaggcaggagaatcgcctgaacccaggagacggaggctgcagtgagccaacatgtcgccactgcactccagcctgggcaacagagtgagattccatctaaaaacaaacaaacaaataaatatatgtatgtatgtatgtatgtatgtatgtatgtatgtatgtatgacatgarcaacaagaagtgcccccggcctgagcccaggcccaggtgaaattcatcaggccaaaaaggcccttctggttatgcaaataccgtccttccatgaaccactggcttaaggaagtgtaaacacgccacatagaagtaaacagctgaaaccctttgaaggcagcgaacagtctgtggatggtccgccgagtgctaagtggtaactcatgctttgcaagggggagcagcagcctcgtaaatctcatcccatggagggttgtaggttctcccggctgccccagtcagctctcactcctgctttct

SEQ ID NO: 167476 - DNA, 601 bp, Human
taatgccagcactttgggaggctgaggtgggcagatcacctgaggtcagtttgagaccagcctggccaacatggtgaaaccccatctctactaaaaatacaaaaattaggctgagcatggtggcagatgcctgtggtcccagctacttgagaggctgaggcaggagaatcgcctgaacccaggagacggaggctgcagtgagccaacatgtcgccactgcactccagcctgggcaacagagtgagattccatctaaaaacaaacaaacaaataaatatatgtatgtatgtatgtatgtatttatgtatgtatgtatgtatgacatgaacaacaagaagtgcccccggcctgagcccaggcccaggtgaaattcatcaggccaaaaaggcccttctggttatgcaaataccgtccttccatgaaccactggcttaaggaagtgtaaacacgccacatagaagtaaacagctgaaaccctttgaaggcagcgaacagtctgtggatggtccgccgagtgctaagtggtaactcatgctttgcaagggggagcagcagcctcgtaaatctcatcccatggagggttgtaggttctcccggctgc

SEQ ID NO: 167477 - DNA, 601 bp, Human
tatttttcaattgtgcaatttgtgttttaaaaatatatgacatgaggccgggcatggtggctcacgcctgtaatgccagcactttgggaggctgaggtgggcagatcacctgaggtcagtttgagaccagcctggccaacatggtgaaaccccatctctactaaaaatacaaaaattaggctgagcatggtggcagatgcctgtggtcccagctacttgagaggctgaggcaggagaatcgcctgaacccaggagacggaggctgcagtgagccaacatgtcgccactgcactccagcctrggcaacagagtgagattccatctaaaaacaaacaaacaaataaatatatgtatgtatgtatgtatgtatgtatgtatgtatgtatgtatgacatgaacaacaagaagtgcccccggcctgagcccaggcccaggtgaaattcatcaggccaaaaaggcccttctggttatgcaaataccgtccttccatgaaccactggcttaaggaagtgtaaacacgccacatagaagtaaacagctgaaaccctttgaaggcagcgaacagtctgtggatggtccgccgagtgctaagtggtaactc

SEQ ID NO: 167478 - DNA, 601 bp, Human
tctgtatattggggtcagtacagcccccggctcatggatgaataagcctggccctccatatacgatacctgatcccaccattcacaggctgcatgggagctttttatttttcaattgtgcaatttgtgttttaaaaatatatgacatgaggccgggcatggtggctcacgcctgtaatgccagcactttgggaggctgaggtgggcagatcacctgaggtcagtttgagaccagcctggccaacatggtgaaaccccatctctactaaaaatacaaaaattaggctgagcatggtggcagrtgcctgtggtcccagctacttgagaggctgaggcaggagaatcgcctgaacccaggagacggaggctgcagtgagccaacatgtcgccactgcactccagcctgggcaacagagtgagattccatctaaaaacaaacaaacaaataaatatatgtatgtatgtatgtatgtatgtatgtatgtatgtatgtatgacatgaacaacaagaagtgcccccggcctgagcccaggcccaggtgaaattcatcaggccaaaaaggcccttctggttatgcaaataccgtccttccatgaaccac

SEQ ID NO: 167479 - DNA, 601 bp, Human
cccacatttaaagtggcctccagtcccccaccttctagcttccacctgaacactcatcttggctcaagaactagtcctccctaagcctcagtttcctcatctgtatattggggtcagtacagcccccggctcatggatgaataagcctggccctccatatacgatacctgatcccaccattcacaggctgcatgggagctttttatttttcaattgtgcaatttgtgttttaaaaatatatgacatgaggccgggcatggtggctcacgcctgtaatgccagcactttgggaggctgaggygggcagatcacctgaggtcagtttgagaccagcctggccaacatggtgaaaccccatctctactaaaaatacaaaaattaggctgagcatggtggcagatgcctgtggtcccagctacttgagaggctgaggcaggagaatcgcctgaacccaggagacggaggctgcagtgagccaacatgtcgccactgcactccagcctgggcaacagagtgagattccatctaaaaacaaacaaacaaataaatatatgtatgtatgtatgtatgtatgtatgtatgtatgtatgtatgacatgaa

SEQ ID NO: 167480 - DNA, 601 bp, Human
agtttcagatcttcccagggctcctcactgccctcccattataaaagccccacatttaaagtggcctccagtcccccaccttctagcttccacctgaacactcatcttggctcaagaactagtcctccctaagcctcagtttcctcatctgtatattggggtcagtacagcccccggctcatggatgaataagcctggccctccatatacgatacctgatcccaccattcacaggctgcatgggagctttttatttttcaattgtgcaatttgtgttttaaaaatatatgacatgaggccrggcatggtggctcacgcctgtaatgccagcactttgggaggctgaggtgggcagatcacctgaggtcagtttgagaccagcctggccaacatggtgaaaccccatctctactaaaaatacaaaaattaggctgagcatggtggcagatgcctgtggtcccagctacttgagaggctgaggcaggagaatcgcctgaacccaggagacggaggctgcagtgagccaacatgtcgccactgcactccagcctgggcaacagagtgagattccatctaaaaacaaacaaacaaataaatatat

SEQ ID NO: 167481 - DNA, 601 bp, Human
tacgccaggcaattattatacatggtatcttattgaattttcacaattccatgagatattatcatacacatttttcagatgagaaaactgaggacaaaggaagtgaagtagccagcagatcacaggattcactccacgccagggaactcaccaggtggaggaacagacacacacaggcatgcacgcacacaaacacagatatgcacacaccaacacacacacacgcaggcatacacacacacacaggcatgcacccacacaagtgtgcacacacacacaggaatgtacccacacaggtgcrcacacacaggcatacacacaccctctcacacacatacatgcacatgcacatacaggcatgtgcagacatacacacacagacacacagggatatgtccacacaaacgtatacacacacaggtgcatagaaacacaggtatgcacacacacatacacatgcaggcatgcatacacacagacgcatgcacacacagacacatgcatgcacacacaggtgcacacaggtatgcacacacatacacatccaagcatgcgtacacacatatacacatgcatgcacacacatccaccctcatacaca

SEQ ID NO: 167482 - DNA, 601 bp, Human
tttttgtttttgttttttctgagacggactctcactctgttgcccaggctggagtgcaatggtgcgatcggctcactgcaacctctgcctcccgggttcaagtgattctcctgcctctacctcctgagtagctgggattacagacaaccaccaccacgcctggctaatttttgtatttttagtagagacggggtttcaccatgttggccaggctggtcatgaatgaagacaagttttgtccctgtgacctttctcaagtgcttatagattcatgcctcaaagatgcaaaataaacatccawcgaaacctgtctccacctttctgaggagggtaatatagcagagggtacgggttaggtacaggggctctgtacagagtctagccatctatttgcaaggctggattttaaagtgcatgttctcctgtcttggttttaaatcattcttttctcatttatttatttatcttttgagatgaagtttttgttcttgtcacctaggctggagtgcagtggtgcaatctcagttcactgtaacctccacctcccgggttcaagcgattctcctgcctcagcctctcgagtagctggaattacaggcgc

SEQ ID NO: 167483 - DNA, 601 bp, Human
ggggcaccgtcacctgtggctgaagaaagctctttgttttgtctgggaactcggtgtcgctctctcatagctgccagacgggggacttctcttttcttgccaaagcaggattttcttccaagggcctcatccgacgaagtctcactccaagcggctgaagctgcttgaatggtttggaattatgcaaccagcaagtggaagaccagtttttttgtttttgttttttctgagacggactctcactctgttgcccaggctggagtgcaatggtgcgatcggctcactgcaacctctgcctccygggttcaagtgattctcctgcctctacctcctgagtagctgggattacagacaaccaccaccacgcctggctaatttttgtatttttagtagagacggggtttcaccatgttggccaggctggtcatgaatgaagacaagttttgtccctgtgacctttctcaagtgcttatagattcatgcctcaaagatgcaaaataaacatccaacgaaacctgtctccacctttctgaggagggtaatatagcagagggtacgggttaggtacaggggctctgtacagagtctagccatctatttg

SEQ ID NO: 167484 - DNA, 601 bp, Human
ccagagactgcacagcaacatgtgtcagtctgggggcaccgtcacctgtggctgaagaaagctctttgttttgtctgggaactcggtgtcgctctctcatagctgccagacgggggacttctcttttcttgccaaagcaggattttcttccaagggcctcatccgacgaagtctcactccaagcggctgaagctgcttgaatggtttggaattatgcaaccagcaagtggaagaccagtttttttgtttttgttttttctgagacggactctcactctgttgcccaggctggagtgcaatrgtgcgatcggctcactgcaacctctgcctcccgggttcaagtgattctcctgcctctacctcctgagtagctgggattacagacaaccaccaccacgcctggctaatttttgtatttttagtagagacggggtttcaccatgttggccaggctggtcatgaatgaagacaagttttgtccctgtgacctttctcaagtgcttatagattcatgcctcaaagatgcaaaataaacatccaacgaaacctgtctccacctttctgaggagggtaatatagcagagggtacgggttaggtaca

SEQ ID NO: 167485 - DNA, 601 bp, Human
ttttgaattttctttctttccttttttttcttagacaggtctcactctgtcacccacgctgccaggctggagggcactggtgcaatctcagctcactgcaacctccaccgcctgtgctcaagcaatcctaccacctcagccaccgaagtagccgggactacaggtacacaccaccatgcccgactaatttttttttttttggtagataatggggttttaccatgttgcccaggctggtctcaaactcctgagatgaagtgatccactgacctcggcctcccaaagtgctagaattacaggygtgagccactttgcctggccgggaattttcaatttgctactagccacattgaaaaatgtaagaaagaaaccagtgccatttattttaatagtattttatctaatccaatatatgcaaaatattgtcatttccacaatgtaatcaatgctaaaaggtactgacgaggtcctttacattcatttcttttgaacccagccttagaaacgctgtgtgccctccgggtatacggcacacactgatatggctgggtgcgctttcaggcgctcagtggccacacgtggccggcaacagcgcaggtct

SEQ ID NO: 167486 - DNA, 601 bp, Human
cctcattcctgcttttttttttttccttttttgcctcttccaatgaccaagaaagacaaaactttaaacatttctgaagatacagtgaccatggccatgctctaggcccctttagaacagaccccagattctctgttcggaagaatcctgacatactgcctccaggggtgggctgaagaccttgtattcagacatgagcctgttggctcccttcaccttcagtctggctgacagctggtgcatttggctctgctcccgtcctcacacgagagcccccgccgcgtgactgccaaggtgtacrgcctgggactcgatgcagcccacgccagtgcaaagccgagcagagagaagggatggacggaggacactggaggtccgggctccctctgggccttagtatcaccatggcctcatagacagcagggttggtggtccttagaggtcatctcttgcccctcaattcagaaggggaaactgaggctcggcgagtgacaccatgaggctggttaagcggcagtcatgccccagcccactgctctccacccttgcacctgggtccgctcatctctcccccctgcccatcagcttccctcccctcttt

SEQ ID NO: 167487 - DNA, 601 bp, Human
atcctcaggggaacacagagagaatgtgcaaaattgagtcttccctcattcctgcttttttttttttccttttttgcctcttccaatgaccaagaaagacaaaactttaaacatttctgaagatacagtgaccatggccatgctctaggcccctttagaacagaccccagattctctgttcggaagaatcctgacatactgcctccaggggtgggctgaagaccttgtattcagacatgagcctgttggctcccttcaccttcagtctggctgacagctggtgcatttggctctgctcccstcctcacacgagagcccccgccgcgtgactgccaaggtgtacagcctgggactcgatgcagcccacgccagtgcaaagccgagcagagagaagggatggacggaggacactggaggtccgggctccctctgggccttagtatcaccatggcctcatagacagcagggttggtggtccttagaggtcatctcttgcccctcaattcagaaggggaaactgaggctcggcgagtgacaccatgaggctggttaagcggcagtcatgccccagcccactgctctccacccttgcacctgggtc

SEQ ID NO: 167488 - DNA, 601 bp, Human
aaccctcctggctcagctgatgttctttcctctctgctcggtagaaaatagaatggaaggttattttccctgttgaagggctgtttttatcatcagtacttagagaggtcttaaaagacaagtcgtccagcaatccgattactgccaaaaagcaaagggttagaaagcaagtgtcttaacacactgaactggctcatacctaaaagtcctgtattcctatttcgtttccaatttatcctcaggggaacacagagagaatgtgcaaaattgagtcttccctcattcctgcttttttttttttccttttttgcctcttccaatgaccaagaaagacaaaactttaaacatttctgaagatacagtgaccatggccatgctctaggcccctttagaacagaccccagattctctgttcggaagaatcctgacatactgcctccaggggtgggctgaagaccttgtattcagacatgagcctgttggctcccttcaccttcagtctggctgacagctggtgcatttggctctgctcccgtcctcacacgagagcccccgccgcgtgactgccaaggtgtacagcctgggactcgatgcagcccac

SEQ ID NO: 167489 - DNA, 601 bp, Human
aaaacagacagcagatctagtaaaacataacaataaatgtaaatgaacaaaattatctttaaaaatgctatgtttcaaactacaaaaaaaaaaccctcaaaccttgtactacataccagagacatatttaaaatcaaaagattagcagaaaaatgattccaagttatacaaacaaaagtatatacaaaagcaaccatatgatctctgaaaacatttaaagcaaactgagtctcacaagataaacagggtcatcctgcaacttgataaccctcctggctcagctgatgttctttcctctctsctcggtagaaaatagaatggaaggttattttccctgttgaagggctgtttttatcatcagtacttagagaggtcttaaaagacaagtcgtccagcaatccgattactgccaaaaagcaaagggttagaaagcaagtgtcttaacacactgaactggctcatacctaaaagtcctgtattcctatttcgtttccaatttatcctcaggggaacacagagagaatgtgcaaaattgagtcttccctcattcctgcttttttttttttccttttttgcctcttccaatgaccaagaaagacaa

SEQ ID NO: 167490 - DNA, 601 bp, Human
gcgagcctgtaatcccagctactcaggaggctaaggcaggagaatggcttgaacctgggaggcagaaatggcagtgagccaagatggcgccactgcactccagcctggcaacagagcgagattccatctcaaaaaaagaaaaataagtttgataaggtctaagaaatctcaaatgaaagatacatggagctaggcacaggtcaacctaaaaccacaagtacttaggaaatcaaattataatgaaacaaaaacaagcaaaacagacagcagatctagtaaaacataacaataaatgtaaatkaacaaaattatctttaaaaatgctatgtttcaaactacaaaaaaaaaaccctcaaaccttgtactacataccagagacatatttaaaatcaaaagattagcagaaaaatgattccaagttatacaaacaaaagtatatacaaaagcaaccatatgatctctgaaaacatttaaagcaaactgagtctcacaagataaacagggtcatcctgcaacttgataaccctcctggctcagctgatgttctttcctctctgctcggtagaaaatagaatggaaggttattttccctgttgaaggg

SEQ ID NO: 167491 - DNA, 601 bp, Human
ctcaaccctgagccccacggcatgagggaggggcagagagctttcagaaggaggaagccaacagcttaagatgcttatagaagaaaagtccaaagttcctctgctttgtgatagctatatatggcaatctacagaaataagaacacttgaagttccagtcggttagctattagaagatttagattaagaaaaataagtttgagagccatggatggtggctcatgcctgtaatcccagcactttgggaggctgaggagagcagatcatgaggtcaggagatcgagaccagcctggccaacayggtgaaaaccctaatctactaaaaatataaaaatcagctgggtgtagtggcgcgagcctgtaatcccagctactcaggaggctaaggcaggagaatggcttgaacctgggaggcagaaatggcagtgagccaagatggcgccactgcactccagcctggcaacagagcgagattccatctcaaaaaaagaaaaataagtttgataaggtctaagaaatctcaaatgaaagatacatggagctaggcacaggtcaacctaaaaccacaagtacttaggaaatcaaattataatgaaacaaa

SEQ ID NO: 167492 - DNA, 601 bp, Human
cgggcgtggtggcgggcgcctgcaatcccagctactggggaggctgaggcaggagaatcgcttgaacccgggaggcggacgttgcagtgagccaagatcgcgccactgcactccagcctgggcgacagggtgagatctgtctcaaaataaataaataaacataaaaaggttcattttatgttaaatgaattccaccacaattaaaaaataaaaaacaaaaaagtcgccatattgccaagaatgatgagcccaggagcatcccgaagtcaagctttacaataaaaagacaatgcatttggcrcgcaaagccactgagaacactaacaaagtggagaacgggaggttaatttttatcaagcagctgatgtgtgccaggaacagcctcactcatgttctcgttcagccctcagtatattaactttattttattttactttttgaagataagactcatgggctgggcttggagagatttgcccagaatgacagaacacccttgagatcctttctgttcccaccccactacagtgtgttactaagtgtatgtgatccgtgcaatgaaagaacacaagttggatgtaagagccagaaaggagaattg

SEQ ID NO: 167493 - DNA, 601 bp, Human
tggcggaaccccatctctactaaaactacaaaaatcagccgggcgtggtggcgggcgcctgcaatcccagctactggggaggctgaggcaggagaatcgcttgaacccgggaggcggacgttgcagtgagccaagatcgcgccactgcactccagcctgggcgacagggtgagatctgtctcaaaataaataaataaacataaaaaggttcattttatgttaaatgaattccaccacaattaaaaaataaaaaacaaaaaagtcgccatattgccaagaatgatgagcccaggagcatccygaagtcaagctttacaataaaaagacaatgcatttggcgcgcaaagccactgagaacactaacaaagtggagaacgggaggttaatttttatcaagcagctgatgtgtgccaggaacagcctcactcatgttctcgttcagccctcagtatattaactttattttattttactttttgaagataagactcatgggctgggcttggagagatttgcccagaatgacagaacacccttgagatcctttctgttcccaccccactacagtgtgttactaagtgtatgtgatccgtgcaatgaa

SEQ ID NO: 167494 - DNA, 601 bp, Human
ttgacaaaaaaaagctatcaaaaccacaaataacacgtctaaaggtaagaaaatcatccacattaaaaaaaaagcccataaggaaataacataaacaatgaccaccatttttctttttcttgagagaaaagcctgttgcccaggctggagtgcagtggcgcaatcttggctcacagcaacctctgcccccagggttcaagccattctcatgtctcagcctcccaagtagctcgaactacaggcgtctgccaccacacccagctattttttgtatttttagtagaagcagggtttcgccacrttggccaggctggtctcaaactcctggccttaagtgatccgcccagcttggcctcccaaggtgttggcactacaggcgtgagccaccacgcccggctaaccacaattattaagcacttatgtgtaccagcacagtgccacagtactgagaatgacacacagtagtaaatatgaatcatggaaggtggaagcaacccctatgtccatcaacagaggagtggattatcaaaacacggtccgtccacacaatggaatattcctcagccacagagaggaatgaagcgctgccacacgcaactac

SEQ ID NO: 167495 - DNA, 601 bp, Human
cttgtggcatgaatgagggaaccaggtgacctggcttatcagacacccttaagccatgatgatacacagttactgccatatgtggatcataagactttaacaaacaaaatttcagaacgatgacggacagcttgacaaaaaaaagctatcaaaaccacaaataacacgtctaaaggtaagaaaatcatccacattaaaaaaaaagcccataaggaaataacataaacaatgaccaccatttttctttttcttgagagaaaagcctgttgcccaggctggagtgcagtggcgcaatcttggytcacagcaacctctgcccccagggttcaagccattctcatgtctcagcctcccaagtagctcgaactacaggcgtctgccaccacacccagctattttttgtatttttagtagaagcagggtttcgccacgttggccaggctggtctcaaactcctggccttaagtgatccgcccagcttggcctcccaaggtgttggcactacaggcgtgagccaccacgcccggctaaccacaattattaagcacttatgtgtaccagcacagtgccacagtactgagaatgacacacagtagtaaat

SEQ ID NO: 167496 - DNA, 601 bp, Human
gaaggtgggggctgtggacacagggtggcgggcgctgcctctcatggcttctcttctccctggtgggctggtgggctagtagctgaggccggcggtcctctcccccggggagcaggcagatgactttggcaaggggtggtgtggcgggggctggggttactccgtctgggcgtcgtaattggctccccccgccttcttcagctcgctcttgatgaaatcttcctccagctccttccgatcactgatcacaaactccttagcgaaattctgcaagaacaaaggaaaacacagcgttcctatyaagaaggaaggcacaggatgtgagggtggctcaggcaacacactgggaagcaaagcactgaaaaccctgatgagagatggaaatggaaattcagcagcagagtcagtcaatggaaattcagcagcagagtcaatggaaattgaacagcagagtcatctggcagaaaaaacctgactgggaggagggagtggggcagatctgatgctgcgtcttcccatgtccgtggggatggcccgaggaagctggggcttgaatttgggctgttaccttggccaagtcccttcaattctctgtgcctca

SEQ ID NO: 167497 - DNA, 601 bp, Human
ctcactaggcagacctcgtcgcgtggaagagaaatgccaggaaaaggggtcactgcaggaggcacctcggatctgatggcaggcaggaccttgcatcaaaatgacttttctttagaacaaaaaagagggggagaaaagaaaaagaagatcaaagaaagaggttccatgagcgtcatgagataggacacggcagggttctaagggaagcgggaaggtgggggctgtggacacagggtggcgggcgctgcctctcatggcttctcttctccctggtgggctggtgggctagtagctgaggccrgcggtcctctcccccggggagcaggcagatgactttggcaaggggtggtgtggcgggggctggggttactccgtctgggcgtcgtaattggctccccccgccttcttcagctcgctcttgatgaaatcttcctccagctccttccgatcactgatcacaaactccttagcgaaattctgcaagaacaaaggaaaacacagcgttcctattaagaaggaaggcacaggatgtgagggtggctcaggcaacacactgggaagcaaagcactgaaaaccctgatgagagatggaaatggaaat

SEQ ID NO: 167498 - DNA, 601 bp, Human
ggcccgggctctggaaagcaacgtgaggtcatgcagatctcactaggcagacctcgtcgcgtggaagagaaatgccaggaaaaggggtcactgcaggaggcacctcggatctgatggcaggcaggaccttgcatcaaaatgacttttctttagaacaaaaaagagggggagaaaagaaaaagaagatcaaagaaagaggttccatgagcgtcatgagataggacacggcagggttctaagggaagcgggaaggtgggggctgtggacacagggtggcgggcgctgcctctcatggcttctyttctccctggtgggctggtgggctagtagctgaggccggcggtcctctcccccggggagcaggcagatgactttggcaaggggtggtgtggcgggggctggggttactccgtctgggcgtcgtaattggctccccccgccttcttcagctcgctcttgatgaaatcttcctccagctccttccgatcactgatcacaaactccttagcgaaattctgcaagaacaaaggaaaacacagcgttcctattaagaaggaaggcacaggatgtgagggtggctcaggcaacacactgggaagca

SEQ ID NO: 167499 - DNA, 601 bp, Human
agggtgggaacaggtggtttcagaccgtgcagcaaagccactgccaggtaagttttaaggcaaattttatctcttcttattcagtctgagccggacctaaccttctcaccaccgagcaatcctgcctatgctggacatgcatcttgggcaactccggatggaggtgggatgagggagcccggggcagataccaggaggtctgggccttagtagggaatggacgtgtgtgcttatgaaggctgcaggcaccgggcacagctcctggcccagctgcccctcagtggtacacaggaagcagggyccaggaaaactgagatggcaaaataggcccgggctctggaaagcaacgtgaggtcatgcagatctcactaggcagacctcgtcgcgtggaagagaaatgccaggaaaaggggtcactgcaggaggcacctcggatctgatggcaggcaggaccttgcatcaaaatgacttttctttagaacaaaaaagagggggagaaaagaaaaagaagatcaaagaaagaggttccatgagcgtcatgagataggacacggcagggttctaagggaagcgggaaggtgggggctgtggacacagggtg

SEQ ID NO: 167500 - DNA, 601 bp, Human
agctctccttaaattcccagtccccaccctgggcctctctccctaacgatcttgtcgctttgggagcccctgaagtgaaccctgaaatactccctccgtcaactctgggctcagacctttgcccttctctgtgtcacaaggaaatttcggtcaagagggtgggaacaggtggtttcagaccgtgcagcaaagccactgccaggtaagttttaaggcaaattttatctcttcttattcagtctgagccggacctaaccttctcaccaccgagcaatcctgcctatgctggacatgcatcttrggcaactccggatggaggtgggatgagggagcccggggcagataccaggaggtctgggccttagtagggaatggacgtgtgtgcttatgaaggctgcaggcaccgggcacagctcctggcccagctgcccctcagtggtacacaggaagcagggcccaggaaaactgagatggcaaaataggcccgggctctggaaagcaacgtgaggtcatgcagatctcactaggcagacctcgtcgcgtggaagagaaatgccaggaaaaggggtcactgcaggaggcacctcggatctgatggcag

SEQ ID NO: 167501 - DNA, 601 bp, Human; identical to SEQ ID NO: 40420

SEQ ID NO: 167502 - DNA, 601 bp, Human
gagattgcagtgagttgagatcgcgccattgcactccagcctgggtgacagagtgagactccatctcaaaaaaaaaaaaaagaaaaaagaaaatatgtaggcccaaacatatctacaaaagactcaagaaaataaaagacattaaatatcaactagatagttgacaggtagattcacatccagaatttcctttcaaatttcttttttctttctacatctttaagggaagaaaggcttccatagtgtgtccagatatggttggcaagccgctggaaactcaagtctgcccaaataacaaatctacaccaacagcctagaggagatggaaggagatggtgtagggcaggggcaatggccctcccttcagattagatgacttgcataaaaggtcaggaatcacaaactacatgcctgcagagggccagctgggaacatgaatgaagtacacatgaggtgaagttgcttggactgtgatcaagcatgacaccagcttaattacatttccttttattattaatttttcaagctaatacctgagtacatttttcttttttttaaaattttttttttgagacagggtcccactctgttgcccaggctg

SEQ ID NO: 167503 - DNA, 601 bp, Human
cactgctgcctacacagtgtagacaagcatcatctaacagctggtctccctacctcttctcccaaccttattcccctccaactctacattccagtcagctttaacctcttttagttactcaggccccaggctgcgttggctctgggcctttgcataagccgttccactgcccagactcaggcttagtcagtcccagctgatcttcatctccaccgtctgctcatctttcaggtctcagtttacagggcacttcttctaggtcgtctttctgccccccaccacctgctccccaaataccttytccttcccctgttgtgacacctgtggcaatttattttgatttttgtttgtttgtttctcctctattagacctgggctctatgaaaacagggagagcgttttgctcactgtcatatccagcatgtagagacctgcctggcacacagggaacactctttaaatagatgttgaataaatgttgggagggagggaatgagaatggatccaggtaacttatgaacggattgtttgactatggaccctgagtctcatgacaggaggaaagaaaggagatttcacaattctttagcagtaggagttg

SEQ ID NO: 167504 - DNA, 601 bp, Human
aaaacagggagagcgttttgctcactgtcatatccagcatgtagagacctgcctggcacacagggaacactctttaaatagatgttgaataaatgttgggagggagggaatgagaatggatccaggtaacttatgaacggattgtttgactatggaccctgagtctcatgacaggaggaaagaaaggagatttcacaattctttagcagtaggagttgttgttttaaaatttgcctctgtgggcccttacttgtaagcaaggcatacttgtatctcagaaattatttcatcttacattatrtttcattaaaggtttatcaactgccagatctgaatcctttaagcagctttagcttattcctctgtgtcttccacactaatatcatattttgtgcaaaattttttcaattataaacatttattgagcacttatctagtagttctgggggtacaaagatgatttgattattatcttaatttcaaagatctccctgtctaatagaggagaaaatgaattaaaccacatccgccaggcatggtggctcacacctgtaatcccagcactttgaaaggctgaggtgggaggatcacttgagctcac

SEQ ID NO: 167505 - DNA, 601 bp, Human
tatcttaatttcaaagatctccctgtctaatagaggagaaaatgaattaaaccacatccgccaggcatggtggctcacacctgtaatcccagcactttgaaaggctgaggtgggaggatcacttgagctcacaagtttcagatcagcctgggcaacgtagcgggacatcatctctacaaaaagttagctgggcatggtactcctgtagtcccagttacttgagaggctgaaatgggaaaatcacttgagcccaggaggttgacgctgcagtaagccatgatcacgccactgcactccagcmtgggagacagagcaggaccctgtctctaaagaaaaattaaaaaattgaaccctatcatactgtgtataagtgccctgataattataaatacgggctcctatgggagctgtagaagggagcagctaactttgcagagggagggaagataacagaaaagaagtgctacctacactgagtcttgaaggataagcaggagtgttccaggtgaccagggggtgagaaaccatgaaacaacctgggcaaaagtaatgagacgtgagcatacaggtaccttcagggattttccatagatcaatgtgg

SEQ ID NO: 167506 - DNA, 601 bp, Human
ataaataaataaaataaataaaaaattgacaatgatttcccctaggcattagctttagttgtgaggaaggcctgggtgaggacttgtttattttcattgtaaacacttttgtactatttgatttattgttaccaggtgcatgagtcttttgattaaaatatttttttaaattttaaatgcatctatcccggtgatatttcttgtctttatggagatatcatacacaaacatctgaaaaacaaagcatatcagatgaattaggtgtagcctccccaaggtaataccctgggacatttagtcmccttcctacccagcactttgggaggccgaggcgggcggatcccgaggtcgggagattgagaccatcctggctaacactgtgaaaccccgtctctactaaaaatacaaaaaattaactgggcatggtggcgggcgcctgtggtcccagctaccgggaggctgaggcaggagaatggcatgaacccgggaggcggaggttgcagtgagccaagatcgcgccactgcaccccagcctgggcgacagagccagactctgtctcaaaaaaaaaaaaaaaaaaaaaaaaatgtatatatatatata

SEQ ID NO: 167507 - DNA, 601 bp, Human
atgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtaaaaataaaggggggattctccaaaaaaattaatctgaaggagttaaatgttgacacaggttttcaaatctctttctttggcaaaacgtattgggtaactaatacttcaggagatttagttatttgcctgcggraactgatcttatttcatagcatgtgatcccatttgggtttctccaagctatgcatattttccgccagttggtatagaacagataaagaggttaaccaagaactacagaagtagttatgatgatgaatgagatttggcactgaatgggtagttggaattttttttcatgcttgttgtattttgattatattacatccagagtccatatagactgtataattgattataaatggaacacaggagaagaccagtgaacaatgaggaggttctatttatataaatgttttaaccgttatcttcc

SEQ ID NO: 167508 - DNA, 601 bp, Human
acacagatgggattgactctttcctggacaaagtggatgaagtatcaactgaacctatcccagagtcatggaggtctgaagtcactttttccactcctgccttatacatttatacttctggaaccacaggtaaaaataaaggggggattctccaaaaaaattaatctgaaggagttaaatgttgacacaggttttcaaatctctttctttggcaaaacgtattgggtaactaatacttcaggagatttagttatttgcctgcggaaactgatcttatttcatagcatgtgatcccatttgsgtttctccaagctatgcatattttccgccagttggtatagaacagataaagaggttaaccaagaactacagaagtagttatgatgatgaatgagatttggcactgaatgggtagttggaattttttttcatgcttgttgtattttgattatattacatccagagtccatatagactgtataattgattataaatggaacacaggagaagaccagtgaacaatgaggaggttctatttatataaatgttttaaccgttatcttcccatgcaacactgatttggagctgtttggtgctgtgg

SEQ ID NO: 167509 - DNA, 601 bp, Human
atggcatgcatgaaccagggaggcggagcttgcagtgagccgagattgcgccactgcactccagcctgggcgacagagcgagactctgtcttaaaaaaaaaaaaaaagaaagaaaaaaaaagaaaaccccttttagggagaaaaaagagaatgagcatcctctgatttaatctcgtaagtcagaatttatatttaattggaagacaattagaagggtgtttattttacttttttcattttctctgaatcaaatatttgctaggccaagcacagtggctcacatctacaatctcagaacttkgggaggccaaggcaggaggattacttgagcccaggagtttgagaccaggctgggcaacatagcgagaccacatctttacaaaaacattaaaaaattagctggcatagtggtacaccttgtagtcctagctacttgggagactgaggtgggaggatcacttgagcccaggagtctgaggctacagtgacgtgccactacaccccatgctgggtgacagagcaaggcactgtctgtagaaaaaaaatagtgctaagttactcttgtaaacattaattaaaagaatttgtttaaacagttgga

SEQ ID NO: 167510 - DNA, 601 bp, Human
gtttttcacctttcagactggcaaaggccccaacatttaagagcacacattgacaaggctaggaggaaacaggcacactcatgtattgctgataggagaatgaatggggacagcccttataactggcaatgtggaagttatctatcaaaattacaaagactcttactctttttttgagacagaaactcattctgttgcccaggctggagtacagtggcaggatcagggctcactgtagcctcaacctcctgggctcaggcgatcatcccacccaagtagctaggactacaggtgcataccrccacacccagctaatttgttttactttttgtagaggaggggtctcactatgttgcccagactggtgctgaactcctgggctcaagcgatcctcctgcctcagcctcccaaattgctgggattacaggactggccaacttttatcttttgacacaacaatctcacttcagtgaatttatccaaaagatatggtgtcattcatagtgtgaattgccatgtggacgagcttcttcactgcagcatcatttataacagcaaatagtataaataaattataatacacttataaaaggacttgaag

SEQ ID NO: 167511 - DNA, 601 bp, Human
aacagcaaatagtataaataaattataatacacttataaaaggacttgaaggagctgagaaagagaataaataaatgaataaataagggaaatctttatgtacaaacatgaacaaatctccagtaaacattgttaagcagcagagacaaaaaacatgcaaaagagtgtgcatatttcttttttttttttgagatggagtcttgctctgtcacccaggctggagtgcagtggcgctatctcggctcactgcaacctttgcctcccaggttcatgccattctcctacctcagcctcctgagtmgctaggactataggcacccaccaccacgcccggctaattttttgtatttttagtagagacggggtttcaccatgttagccaggatggtcttgatctcctgaccttgtgatccgcccgcctcagcctcccaaagtgttaggattacaggcgtgagccaccgcgcctggccaagtgtgcatattttttaatggaaaaggcaagaacatataagcaaatgttcatatttgctttgtttgtataaaataactctagtacgtaagaaatctctctgactctcagccttcacatctgtggattgga

SEQ ID NO: 167512 - DNA, 601 bp, Human
aggtagggcctttgggaagtaattgggtcatgagagtagtgccttcatgaaaggtagtgcccttatcagaacaggagacagccagcttctttcctgactctgttctgttccatgtaaggacacagggagatgatgaccatccccaaaccaggaaaaatgccctcaccagacaccagacaccttgatcgggacttcccagcctccagaactgcaagagataaatgttgtttaagccacccatctgtactattttgttatagcagctcaaacacacacacatacacacacacacacacaatcyaaaaatttgaaatccaaaatgctccaaaatctgtaactttttaagcaccaggacaccacaagtggaaaatactacacataagtacttaacacaaactttgttttatgcacaaagttatttaaaatattgcatgaatgggccaggcacagtggcttatgcctgtaatcccagcactttgggaggttgaggtgggcgaatcacttgaggtcaggagtttgagactagcctggtcaacgtggcaaaaccccatcccttcttaaaaaatacaaaaattagccaggcatgatggtgtccacctgt

SEQ ID NO: 167513 - DNA, 601 bp, Human
acatacacacacacacacacaatccaaaaatttgaaatccaaaatgctccaaaatctgtaactttttaagcaccaggacaccacaagtggaaaatactacacataagtacttaacacaaactttgttttatgcacaaagttatttaaaatattgcatgaatgggccaggcacagtggcttatgcctgtaatcccagcactttgggaggttgaggtgggcgaatcacttgaggtcaggagtttgagactagcctggtcaacgtggcaaaaccccatcccttcttaaaaaatacaaaaattarccaggcatgatggtgtccacctgtaatcccagctacttagaggctgaggcacgagaacccacaaggcagaggttgcagtgagccaagatttcaccactgaactccagcctgggcaatagagtgagacccgggccaggtacggtggctcacgcctgtaatctcagcactttgggaggccaagggggacagatcacgaggtcaggagattgagaccatcctggctaacacagtgaaaccccttctctactaaaaatacaaaaaatttgccaggtgtggtggcacgcgcctgtaatcccagct

SEQ ID NO: 167514 - DNA, 601 bp, Human
cccttcttaaaaaatacaaaaattagccaggcatgatggtgtccacctgtaatcccagctacttagaggctgaggcacgagaacccacaaggcagaggttgcagtgagccaagatttcaccactgaactccagcctgggcaatagagtgagacccgggccaggtacggtggctcacgcctgtaatctcagcactttgggaggccaagggggacagatcacgaggtcaggagattgagaccatcctggctaacacagtgaaaccccttctctactaaaaatacaaaaaatttgccaggtgtkgtggcacgcgcctgtaatcccagctactcaggaggctgaggcaggagaatcacttgaacctggggggcgggtgttgcagtgagtcgagatggcaccactgcactccagcctgggtgacagagcgagactctgtctcaaaaaaagaaaaaaaaatagagcaagactctgtctcaaatatatatatataaaatacatatatatgtatgtgtgtgtgtatatatataatatatatgtatgtgtgtgtatatatatgtatgtgtgtatatatatatacttgagacagagtctcactctatttat

SEQ ID NO: 167515 - DNA, 601 bp, Human
caactcaccacaggtaacactccccccgttttactatcattttgaaatgggtaagatggaaattcaagtcactttgggttgtgctaggcttcaactgatttgcatatatcagttttgagtttaggatacaattatcatgataaagtacttggcactatacctaccatatagaggggacttagtaggtgggagttaatattattattatgatgatgattatttcctgcctttttacttgttttcacatcttactccccacctagcatatcctgcatttccccctctgcttactaaaagccaktgtcaaagcccagttcaaatgatacctcatacattaaacctatttgggtcactccaacaaaagtcattactcttctcccctacgtcattttatttctaccctctgtggcccttgtcatgttgcaggagtttgtgttcatgtctcccatccttccttggctgtaatatctttgatggctggaaccacatcttgtctccttgttttctgttataccgaaggcatacaggaaacttttacttaatgctgtttaacaaataaatctctgtgtgactttgaaaccagccagccaagtctgtcacc

SEQ ID NO: 167516 - DNA, 601 bp, Human
acaggcctcttctgctaataatcaaacatatcatctgcccctcactccagcttgtcactgcatttcatggcacctgtcactcctgacatagtaaaggtttatgtgattattgtctgccccccctcgccccaattaaatgaaagccgcatatgagcaggggctctgtccactaccagatctacggcaccaagatctgtaaatgacacatcataggcatcaacagattttgtggactgaacctctaaatccttgcccctgaaaaatgtgtagttgagttgagggagctaaaatgtttccccaraatgtttgggcttagcacatattattctgattttttggcatattcaatagattctcgaggatcatcattagcagtgagttgggttagggtattttccacagcagttctgttcatgtcattattgaatttttttcacattaatattccacgtggcctccaagatagcatgtctctctattaaaatccagaaatccatatgggacccttctgctgggcttttcttctctaccttaaaggcactcctttgtcagttagaaaatctcctggggagtgtgtgttgtttctgtatgttctaatggg

SEQ ID NO: 167517 - DNA, 601 bp, Human
acacatcataggcatcaacagattttgtggactgaacctctaaatccttgcccctgaaaaatgtgtagttgagttgagggagctaaaatgtttccccaaaatgtttgggcttagcacatattattctgattttttggcatattcaatagattctcgaggatcatcattagcagtgagttgggttagggtattttccacagcagttctgttcatgtcattattgaatttttttcacattaatattccacgtggcctccaagatagcatgtctctctattaaaatccagaaatccatatgggrcccttctgctgggcttttcttctctaccttaaaggcactcctttgtcagttagaaaatctcctggggagtgtgtgttgtttctgtatgttctaatgggagcttcctttggactggacgaaaataaatatgtttgtgtgtagctgtcttcaggcccacacatatccacatatacacatgcacacatacacacatgcatgcactctcccagtttttctcttactgttgtctcaaatactggaaaacaaagacaatttcactggggttttacaacttcaaaatatactatgatttaatgcata

SEQ ID NO: 167518 - DNA, 601 bp, Human
ggtgggctttgaagagtacggagaagttctgcagccaggcaagaaaagaagggcttctggctagcaggaaaatcacgtgagcagtgagatgaaggacccagcacactgggaactgcaagcagtctggcaggaggtgaagctgaggggctgggtcaggtggcaagggctttactctgctgagactcaaatgtgaacatgacaagccatgactaaagggccttacatggaagagcaatgtgggagatggcatttttagacagtccttttggctacgatgtgagaatacacagaaggatgaagrgcctcttctgtaaagcaaacaggtggagccttgtccaggcagaagtgtaacatattaattattaagaacagggactctggagtttttctaaggtgataaagaccttcttccctttcacctcttggaagtcaccccaaaacaaggcgatgagaaaaacacacacaagcaccatcatctcagaaactaagagacattgcaaccatgaactacatagtataggaagctaaaagataacagtgactgacatagtaggctgagaagggtgaaacttaagaggcaagtcccaacaggaaggaagcc

SEQ ID NO: 167519 - DNA, 601 bp, Human
atgctctggaaagtctcagcaatagaattgaacaagtagaagaaagaaattcagagctcgaagtcaaggtctttgaattaacccaataaataaagacaaagaaaaaataataaggaaatatgaacaaagcctccaagaagtctaggattaaaagaccaaacctaagaatacttgatgttcctgaggaagaagacaattctaaacacttgaaaaacatatttgggtgaataattgaggaaaacttccaagccttgctagacctagacatgcaaatacatgaagcacaaagaacacctgggawattcatcacataaagatctttgcctaggcacattgtcatcaggttatccaaagttaagaccaaggaaagaatcttaagagctgtgagacagaaacacctggtgacctacaaaggaaaacctattagattaacagatttctcagcagaaaccctacaagctagaagggattggggccctatcttcaaccacctcaaacaaaacaagtgtaagccaagaattttgtatccagcaaaactaagcatcatatatgaagaaaagatacagtcgttttcagacaaacaaatgctgagagaattcgc

SEQ ID NO: 167520 - DNA, 601 bp, Human
acattctattcaacagcgcataactttctaactttcaccaagatagaccacatggtggcccataaaatgaacttcaataaatttaagaaaattgaaattatatccagcactgtctcagaccacagtggaataaaactggaaattaactccaaaggaaccttcaaaaccatgcaaatacagggaaattaaataacctgctcctgaatgagcattgggtcaaaaacaaaatcaagacagaaatgaaaaaattcttcaaactgaacgacaataatgacacaacccatcaaaacctctgggatamaacaaaggcggtgctaagaggaatcttcatagccctaaacgcctgtaacaaaaacactgaaagagcacaaacagacaatctaaggtcacacctcaagaaactagagaaacaagaacaaaccaaacccaaacccagcagaagaagggaaataaccaagatcagagcagaactaaatgaaattgaaacaaacaaacaaacaaaaaaaaagataaatgaaacaaaaagctggttctttgaaaagataaaattgatagaccattagtaagattaaccaagaaaagaagagaaaaaatccaaata

SEQ ID NO: 167521 - DNA, 601 bp, Human
agatagaccacatggtggcccataaaatgaacttcaataaatttaagaaaattgaaattatatccagcactgtctcagaccacagtggaataaaactggaaattaactccaaaggaaccttcaaaaccatgcaaatacagggaaattaaataacctgctcctgaatgagcattgggtcaaaaacaaaatcaagacagaaatgaaaaaattcttcaaactgaacgacaataatgacacaacccatcaaaacctctgggatacaacaaaggcggtgctaagaggaatcttcatagccctaaaygcctgtaacaaaaacactgaaagagcacaaacagacaatctaaggtcacacctcaagaaactagagaaacaagaacaaaccaaacccaaacccagcagaagaagggaaataaccaagatcagagcagaactaaatgaaattgaaacaaacaaacaaacaaaaaaaaagataaatgaaacaaaaagctggttctttgaaaagataaaattgatagaccattagtaagattaaccaagaaaagaagagaaaaaatccaaataacctcactaagaaacaaaacaggagatattacaactaaca

SEQ ID NO: 167522 - DNA, 601 bp, Human
gtactggtataaaaacaggcatgtagaccattgccacagaatagagaacccagaaataaagctaaatacttacagtcaactgatctttgacaaagtaaacaaaatcataaagggggcaaagtacaccctattcaacaaatggtgctcagataattgccaagccatgtgtagaataaaactggattctcatctctcaccttatacaaaactcaactcaagatggattaagaacttaaacctgacacgcgaaactataaaaattctagaacataacattggaaaaacccttctagacattgayttaggcaaggatttcatgaccaagaacccgaaagcaaatgcaataaaaacaaagataaatagctaggacctaattaaactaaagaacgtttgcacagcaaaaggaacagtcagcagagtaaacagacaacccacggagtgggagaaaatcttcacaatctatacacctgacaaaggaataatatccagaatctacaacaaactcaaatcagtaagagaaaaacaaacaatcccatcaaaaagtgggctaaggacatgaatagacaattctcaaaagaagatatacaaatggccaataaac

SEQ ID NO: 167523 - DNA, 601 bp, Human
ggggaagagtgggagggggacgagggataaaagactacaaatatggtgcagtgtatactgctcaggtgatgggtgccccaaaatctcacaaatcaccactgaagaccttactcatgtaaccaaataccatcggtacccccaagaacttatggaaaaataaaaataaataaataaaatctgtgtaagaagtagctggacctgctattcccctcttccactgtgtgggagacaggaggatttttctctggagagctaaagaagctttgactgaaggaccccaagaacagaggagagcagggaygaggcactgaaaacagagattaagaaagtatctacgtactaaccagggagaccccaccagctcctttcccctgcacagatactggaactccagtagccaggttatgcttgcaggcaggatattgaaggagtgtaattcttaggaagaactaaactttcccggaaaagacattggacatgggctcactgcctcgtcaaccagcagtgcagcccagctagcagtagccccctcaccctgcccccacagaactgcctaatcatctttctgttgcattactcttaaatctgaacaaacatgaag

SEQ ID NO: 167524 - DNA, 601 bp, Human
tcagatatacaatattcagatattccaagtctccacaaaaaaatagtaaaaataaaattaaaaaaacttaccatgtacatactccccttcgggaatttactaaagaaaatattccatccaaacagaatgaaaaaaaagcagaggaaaacacaggatcaaggaaagagagacaaagggaccccccaggcttagaaaataactagtccagactggagcagaggagacaaagaagcataatggaaaacaggaaattccatgagcagatagatttcaccatgaggaaaattttagaggctgttggaggataaggggaaacttaccaatagaaactaaggaaatgaagcaaattggaagaaaggcaattaattccaggaaaaataaaaatttgttcatagtgtattacttggctcctcagtgttgtattatgggcagaataatgtgaacactgaatattggtttaaccaaaaattgtgatactggaaaaatgggagagagaataggaaagaactgaatcctcatctaccacaataggaaatctgaaattgacgaaacaagagaaagaagtataagcatttaatttagaatttaatttagaaatatg

SEQ ID NO: 167525 - DNA, 601 bp, Human
catacaaaataaaggcaattattaatatgtaagcataggctccagagatgtttcagtttggtctccttcttctcccccaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaagtaagtacattgaaaaatgaragcatacgtagccagttttcagaatacagagacttcttaaaagccaagtcatgatgatgttatcagaagtcaggcagcatcagagccatggcccattcctatcaccaagagaagttttgctcattctctgtgatgatgacttcaaaaaatcagatcctccaattaaaagcatctcaacttctattaagaacaatccattgtgcccttgccatctgcaacttaggtgaagtcttcctgatgccatttatacttgcatgtgataaaacacctgaaggttacaagttccgtaagctaatcgta

SEQ ID NO: 167526 - DNA, 601 bp, Human
tgcaattgatgtagaaaagaacatttattactacctataaattttttacattcctgcaaataagatctacatttgttgaccataaacaccacttgtttttttaacaagtactagctgtctgctaatactaaagcatatgattgtttgcttcatcacatagacttgaatataaatttgaaatagacacagtaatcatggctaataattatatccaaatactgtcatgtttgcatttttcttccaacaaggaaaataatatatttattattgctcttactgaattgctgataattaaattctyatgctttgaattatatgttaaatatgatagagttttcataattttatagtcatgggcatgaaataattatggcttcgattctaaaatatattagataacatttccttagaaacatgaaaaatctaatagtgtcatattaatataaggttatacaagattttaaaaacccatttgtgatacatccaccaaaagacacaagaatgttcataacagctttatttataataggccaaaactagaaataatccaaatacccattaacaggaaaatagataaataaatcgtggtatgtttatacaa

SEQ ID NO: 167527 - DNA, 601 bp, Human
ttatgcctcaaacaagataccccggccaggactaagttggggagtttgaggggccaagatgaggaacacgagatcaggatcatgcagaaatctaaaggaaacaccagctctccgacattgcaacctgggccagaaaccaccagtgacctctgctaactttgtcctttcttccaggtggaaaggggaaaatgtggccaccactgaagttgctgatacagttggactggttgattttgtccaagaagtaaatgtttatggagtgcatgtgccaggtatatacaagatatgatctgtacctaaacccatagagtaactgaacataattttggcctcaaggcgaagtttgtcattgctttctcccgccatccagagttaaacagttctttcagctgccagggagtaaggagcttatgtctggcttatgttccactataaaagccaactcagtgcatctgaacatggccttctcttcatttcagctcccagccattcttgggctctcaggcaaacaaagtctcaaatatgggagctccatgccacatttggcacacctcgagaaaagtcgtgtcatgcttaagagctgggaaatgatgtcctagcc

SEQ ID NO: 167528 - DNA, 601 bp, Human
ggtatgattgcaccactgtactccagcctgggcatcagagcaaggcccagtctaaaaaaaaatatatcagaaaacagctagaagaaatccaatcctaatccctttctccttacaatgacaggccagttcattcagcaagagacttagcacataactcacaaagtctgtttggtgagtcctgacagatagcgcaaatagaaatgctctgaccctgtttgttgtttccagttttaaagaacacagaaatccacagaagttctacacctttctgtggtgtgaaatttaattggacattagccagctggaattgcctaagacttaactatcaccgctaggaggattttttttcttcctccaacattaaccctttggttggtttaatactctcacttttagactttgagctctgtgattctgtagctgaagacttgacaaaggaggtcttaagattccagatattgtgtgtataggattattcctgttgatgttcatagggcaccaacatttgctttgcaaccagatggtaaagtggcatgaaaatgaaatatcctcagatattttgattaacacataattgaaggaaaaatcagtcttcaatcta

SEQ ID NO: 167529 - DNA, 601 bp, Human; identical to SEQ ID NO: 29163

SEQ ID NO: 167530 - DNA, 601 bp, Human; identical to SEQ ID NO: 29164

SEQ ID NO: 167531 - DNA, 601 bp, Human; identical to SEQ ID NO: 29165

SEQ ID NO: 167532 - DNA, 601 bp, Human; identical to SEQ ID NO: 29166

SEQ ID NO: 167533 - DNA, 601 bp, Human; identical to SEQ ID NO: 29167

SEQ ID NO: 167534 - DNA, 601 bp, Human; identical to SEQ ID NO: 29168

SEQ ID NO: 167535 - DNA, 601 bp, Human; identical to SEQ ID NO: 29169

SEQ ID NO: 167536 - DNA, 601 bp, Human
agttataccaggtggccatattttggggtgaaatattttggttttctttaaacctaacatagatagagggaaattttttccctcccatacatgtagcatgagcatgtggtgggacaggggttgtagatggagtgaatatagaaattgggaggtcaattagacagttatggaaagggatttaagttatatttttactgacaataaatatatatgggagaggtaagcaggctctgtttgtcataagaaatatatccagatagttgcagacaataagagtgtggggaggtaggtgctcctaacwtcccagacctcaaaggcactctcttgtgacagtaaaatactaaccctacatgaaagtaggccctaaaatctttgaagcatttgtggatagaaactgaagaattcaaggataatgcaaattaaaaataagaggcttaattctccctgccaaaagtaagtgacttctcttcctctttcagaatttctttctctgtccttttcaaatgcatgtaaatgtttacactggttaaataaccaaaacagcatggtactggtaccaaaatagatatatagaccaatggaatggaacagaggtctcaga

SEQ ID NO: 167537 - DNA, 601 bp, Human
ggaagaacaactgttcttactggtgggttggtttggtctttaggtggatagggaaaagtttcttctgttgatctttaaaggcctttaattcaaaatactagttataccaggtggccatattttggggtgaaatattttggttttctttaaacctaacatagatagagggaaattttttccctcccatacatgtagcatgagcatgtggtgggacaggggttgtagatggagtgaatatagaaattgggaggtcaattagacagttatggaaagggatttaagttatatttttactgacaakaaatatatatgggagaggtaagcaggctctgtttgtcataagaaatatatccagatagttgcagacaataagagtgtggggaggtaggtgctcctaacttcccagacctcaaaggcactctcttgtgacagtaaaatactaaccctacatgaaagtaggccctaaaatctttgaagcatttgtggatagaaactgaagaattcaaggataatgcaaattaaaaataagaggcttaattctccctgccaaaagtaagtgacttctcttcctctttcagaatttctttctctgtccttttca

SEQ ID NO: 167538 - DNA, 601 bp, Human
ttcctaaagtagagagaagggaagaacaactgttcttactggtgggttggtttggtctttaggtggatagggaaaagtttcttctgttgatctttaaaggcctttaattcaaaatactagttataccaggtggccatattttggggtgaaatattttggttttctttaaacctaacatagatagagggaaattttttccctcccatacatgtagcatgagcatgtggtgggacaggggttgtagatggagtgaatatagaaattgggaggtcaattagacagttatggaaagggatttaarttatatttttactgacaataaatatatatgggagaggtaagcaggctctgtttgtcataagaaatatatccagatagttgcagacaataagagtgtggggaggtaggtgctcctaacttcccagacctcaaaggcactctcttgtgacagtaaaatactaaccctacatgaaagtaggccctaaaatctttgaagcatttgtggatagaaactgaagaattcaaggataatgcaaattaaaaataagaggcttaattctccctgccaaaagtaagtgacttctcttcctctttcagaatt

SEQ ID NO: 167539 - DNA, 601 bp, Human
ttcagtagtagtttgaaaaacatttgtagacattggagggaaaatatgaaactaaaggagctgggatcgagggttagagaggaatgaaagaccccagttcgtggaatctccagggagctaagataaactgataccatttataaagtttcaactaattcaccttctttctcacctgaagaaaagagcaagcgcacagggttacttcgtggggagccccgggcctggcatctgtacagtccagattcccgaacctcgagggtgtttcctggggtcagggtcaacttttctccccagtagtgcygatgataccatgttgttttctctgttgcatagaactgaaatccattgcaagtcagagtcactctctctcctttgaagaatgtggtccatggaggatggacggaaatcacaggtttgtgtgcagctgctgaggaggaaagagtaataggtctgaggtggaggtgcctgcagtcccagctgcagtggcttgtgtgggttacagtggaggacatggcttgggagatccctaagatgcccccggatgacttctgtttacccaggttgcaggtgagctgtgctcacctcctgcagggtgcagtgg

SEQ ID NO: 167540 - DNA, 601 bp, Human
gttttcttctttcttccacaggatgtagtttcctgatccaagctcacgaaactcctcctaaatcagtgtaacatgcttcaggtacaattcctaaataaatcccagactcaactattttatcattcaaagtcagattccaaagataaggagtctaatacggagaataaaagctgagagaaggtgtgatcaaaatctctgacatgatagagtacagcagaacttaacaccaacctgctcaccgagtctcagagcaggagctatgaaagaagtggcacttagagaactacatgaggatctcttyctggacattggagtgtgatttgtagcaggattcttgtcagagacacagtctaggttgaagggacagtggatgtggtcctttatgggaattccatgctgttcatattctaataattctaatttgaggttagctatatctcttctttcttagatgactgtgttgaatgcctactcctgtagtccgtgcccttggaagtgaccaaaatcattatccatcaggtaaaactggacaggaggagctgtgggagcttgatgccaatcagagggaaaactaggaatgaggaagggacgcataacaacg

SEQ ID NO: 167541 - DNA, 601 bp, Human
tttaagaaaaaatcagggaggtaaggagagtgaattgaggagttttattgtatagaaaagcagggaaatctagctttccagtaacttaataaaagctagattcttcctttctttcctctttcctttctttcctttcctttctttcctttctttccttcctttccttcctttccctctttctttctttctctttcctcctttccttccttccttctctctttctttctctctctctttctttctttctttctttctttctttctttctttctttctttctttctttcttttttctttctttctttcctttttcagagagacaggaatacaactaaacctgagattgaggaggaattgaagcccagtaaagaccacttccttagtgccaaggtagctgagtgagaacatagcttggcccagtgtggcttctcagcgatggaggaagagatgtatatgagctaaacctgtgatatcccaaagtaaggcttctctcctcaatggacaaaagtgggctctgtatctgctctccctgcttcttgtgagtttcctgacccacatacaatttggctgctgagaatccctcaggattctattatagtaat

SEQ ID NO: 167542 - DNA, 601 bp, Human
cccagaaattgagcaggaaaatgtttcaagaaggagggagggatcaattgtatcaaaagctggaggtaggtcaaatcaaatgggaacagttttccactggccttagaaatatggagatcattagtaattttggtggagtgaggcaagcctggtggtgatgggtttaagaaaaaatcagggaggtaaggagagtgaattgaggagttttattgtatagaaaagcagggaaatctagctttccagtaacttaataaaagctagattcttcctttctttcctctttcctttctttcctttcctttctttcctttctttccttcctttccttcctttccctctttctttctttctctttcctcctttccttccttccttctctctttctttctctctctctttctttctttctttctttctttctttctttctttctttctttctttctttcttttttctttctttctttcctttttcagagagacaggaatacaactaaacctgagattgaggaggaattgaagcccagtaaagaccacttccttagtgccaaggtagctgagtgagaacatagcttggcccagtgtggcttctcagcgatgga

SEQ ID NO: 167543 - DNA, 601 bp, Human
tgctgaatagatagaatactaacaggttatgtcccagaaattgagcaggaaaatgtttcaagaaggagggagggatcaattgtatcaaaagctggaggtaggtcaaatcaaatgggaacagttttccactggccttagaaatatggagatcattagtaattttggtggagtgaggcaagcctggtggtgatgggtttaagaaaaaatcagggaggtaaggagagtgaattgaggagttttattgtatagaaaagcagggaaatctagctttccagtaacttaataaaagctagattcttcytttctttcctctttcctttctttcctttcctttctttcctttctttccttcctttccttcctttccctctttctttctttctctttcctcctttccttccttccttctctctttctttctctctctctttctttctttctttctttctttctttctttctttctttctttctttctttcttttttctttctttctttcctttttcagagagacaggaatacaactaaacctgagattgaggaggaattgaagcccagtaaagaccacttccttagtgccaaggtagctgagtgagaacat

SEQ ID NO: 167544 - DNA, 601 bp, Human
tatctcctcagagattataatctttgaacttcctgaggtaaacttttcagaataagagccttcctgcagaagaaacaccctctaccatcagtgttactctggatttcagggcattcaggagtctttcgagggagcccttggcagcttgcagttttgctaatcccttcttcctctcccctaatctgattcttgaaatgccattgagccctggaattcaagaccagactgggcaacgtagtgagaacctttctctatgaaaaataaattaaaaaaaaaatagctggccatggtggcacatgcytgtagtcccagctatttgagaggctgaggtgggaggatcgcttgaacccagaaggtcaaggctgcagtgagccaagatcacgccactgaactccactctggacaacagagagagaccccatcttaaaaaaaaaaaaaagtcattgaaatgacattagctcagtctcagtccttctctgctgggaattacacccagtgatgttcccagactgagatgcagattgctgtggtacttagttctggggaaacacctcagtctcttaacctggtgggccctgcttgatcataagacttgcctcaa

SEQ ID NO: 167545 - DNA, 601 bp, Human
ctgctttccagggctgtcatgagaataaaatgaaatgatacatgtgaagtggccagttcactgcctggatcaggagaagctgatccattctgatgatcttaacccccaaaaggaagaggaataatttatacttaccaacagattcactgttatctcctcagagattataatctttgaacttcctgaggtaaacttttcagaataagagccttcctgcagaagaaacaccctctaccatcagtgttactctggatttcagggcattcaggagtctttcgagggagcccttggcagcttgcarttttgctaatcccttcttcctctcccctaatctgattcttgaaatgccattgagccctggaattcaagaccagactgggcaacgtagtgagaacctttctctatgaaaaataaattaaaaaaaaaatagctggccatggtggcacatgcctgtagtcccagctatttgagaggctgaggtgggaggatcgcttgaacccagaaggtcaaggctgcagtgagccaagatcacgccactgaactccactctggacaacagagagagaccccatcttaaaaaaaaaaaaaagtcattgaaatg

SEQ ID NO: 167546 - DNA, 601 bp, Human
agcaggtagccttctgtaagccagaaagagagccctcacaagaatccaaattatattagtgcactaatcccagacttccagcctccagaactatgaggaaatagatttctgttttttaagctccccagtccctggtgtttggttatggcagttcaagctgcctgagacagcccaccttagcccagtgcatgaggctactgcagagtttctctctttgctatatattctcctatttctaagcacggggattttgcataaagtccatgattaaaaaatatttaggagggaatccctattccakcaaacatcactggatccttgacgtttgtttaatctttgagatcatctgtttccttaacagatgttgacacctgctttccagggctgtcatgagaataaaatgaaatgatacatgtgaagtggccagttcactgcctggatcaggagaagctgatccattctgatgatcttaacccccaaaaggaagaggaataatttatacttaccaacagattcactgttatctcctcagagattataatctttgaacttcctgaggtaaacttttcagaataagagccttcctgcagaagaaacaccc

SEQ ID NO: 167547 - DNA, 601 bp, Human
aggaaattcaggctgctctctgattagcttagaggacacctccataggttaagcctgctcccacacagccctaccccagacatcctcagtccatgctatggattgatttgtgcccttctcccccagattcatacgctgaagctctaaccccaatgtgatggtatttggagacagggcctttgagaggtaatcagatttagatgaaatcatgagggtggggccccaaagataggattagtgcccttctaagaagaaacaccagaaaggttgtgctgctctctctctctgccatgtaaggacwcagcaagcaggtagccttctgtaagccagaaagagagccctcacaagaatccaaattatattagtgcactaatcccagacttccagcctccagaactatgaggaaatagatttctgttttttaagctccccagtccctggtgtttggttatggcagttcaagctgcctgagacagcccaccttagcccagtgcatgaggctactgcagagtttctctctttgctatatattctcctatttctaagcacggggattttgcataaagtccatgattaaaaaatatttaggagggaatcccta

SEQ ID NO: 167548 - DNA, 601 bp, Human
gcaccagttgaaccaacagtaactctgagattgctccgcattgggacaccacgatgaaatggcatcagcctccttcctcatagaagcctgtgcctgtgtgctctgaagggcaggagagaaaaaaacggatggaaaagtacacataatcaataaattgttaggggcttttgatatttccatggggtccgttctcctatcctttcatccacggaaaaggaggtttcattcaatttacttatttatacaacaaatatttactgaggctgccctgtgctgggcattgacctaacccttgaagacmcaagagtgaacaagacgttaaagtcccggctcttgagtttataacccagggaggggagacaagccataaacaaataaataaatttataccgtgccctgtagtgatgcgctaaagagcaaaaagcatgagagagggacagagagtggagagtggggcgtggtactttcccatatgtattcttggtccccaggtaaaccaaattcagacctcagacacaggtaccacagaattgacagagaacatgcaggtagtagaacaacagcaacactgatcatgatttccgtttattttcatctatga

SEQ ID NO: 167549 - DNA, 601 bp, Human
tcgtctcccaagaaaccaactcctgcaaaataaagcaaagacgcatttttgtcagcagagggagctctttctcaatgacttcatgtaacaggagctatctaagagaggtaatcaagacagtcaattcaaacacctgcccagtcctgggttttcatgaaaatgaggtgaaaaaaagattgtacaaagcatataactttttgaggccaggactgcacactcctgagttaagtatgtaattgtttgagaatttattaagactcaagtctgtgttgaaatccctcaggaaacattacatataacmaaagtgtcacttggagagtagtgagctgtgggtgaacttcgaggaacatctgtggccatgcccagaggagcactgggctctgactcagccccactaaggagaattggtcagaggtccaaagctccctacctccagttcaatgcaggacacacagaaggtgctgtcaggaatctggaaagttgaattgaattaagagacagagttgaaggatgtgggtaattattctagagctgaaaaaggttctgctcctgtcttctacaccaggtttcttggcatctaaagccagcctgaggtgggctg

SEQ ID NO: 167550 - DNA, 601 bp, Human
tgcatattgtgtactcgggaaactaaaaaggaatggcagaaactgaggtctcacctggtttcgtctcccaagaaaccaactcctgcaaaataaagcaaagacgcatttttgtcagcagagggagctctttctcaatgacttcatgtaacaggagctatctaagagaggtaatcaagacagtcaattcaaacacctgcccagtcctgggttttcatgaaaatgaggtgaaaaaaagattgtacaaagcatataactttttgaggccaggactgcacactcctgagttaagtatgtaattgtytgagaatttattaagactcaagtctgtgttgaaatccctcaggaaacattacatataaccaaagtgtcacttggagagtagtgagctgtgggtgaacttcgaggaacatctgtggccatgcccagaggagcactgggctctgactcagccccactaaggagaattggtcagaggtccaaagctccctacctccagttcaatgcaggacacacagaaggtgctgtcaggaatctggaaagttgaattgaattaagagacagagttgaaggatgtgggtaattattctagagctgaaaaagg

SEQ ID NO: 167551 - DNA, 601 bp, Human
agaaaatctagactctagtcattgtatgcataattatagtaacacattgtctaacttaattatagtacaagaaatattctgtactttataacctttggtattatccatttagatgagtaggttaagatcaaataagaaatctattattttgcatgtattgcaaactattagctgacaagcaaagttctaggaagcttcatttttgacaaattcatggagtgtgaaaatggaagtatctagccacagggccaaagaggtataacttgacctaatttcataaccccacagttttgcatattgygtactcgggaaactaaaaaggaatggcagaaactgaggtctcacctggtttcgtctcccaagaaaccaactcctgcaaaataaagcaaagacgcatttttgtcagcagagggagctctttctcaatgacttcatgtaacaggagctatctaagagaggtaatcaagacagtcaattcaaacacctgcccagtcctgggttttcatgaaaatgaggtgaaaaaaagattgtacaaagcatataactttttgaggccaggactgcacactcctgagttaagtatgtaattgtttgagaattt

SEQ ID NO: 167552 - DNA, 601 bp, Human
aagcctggcaggtcaagactgcaggaaactgagatgatgccattgcactccagcctgggtgacagagccagatcctgtctcaaatatatacttaatggcttcttcatcatcaggaagtagtgattaaatgtctttactttactgttggcctggtgcagtggctcacacctgtaatcccagcactttgggaggccgaggcgggcagatcacttgaagccaggagtttgagaccagcccagccaacatggtgaaacctggtctctactaaaaatacaaaaattagctagatgtggtggctcaygcctgtaatcccagctactttggaagctgaggcacaagactcacttgaacctgggaggcggaggttgccgtgagctaagatcgtgccactgcactccagcctgggtgacaataaatacatacatacatacatacatacatacatacatacataaaaaatgtctttacattgtaatgtctgtacaatccaagaaggaattagacataatccacactcttattccttacctaagactgagacactgacatagaaggaggaagatgacagtattttccaaatggaagttaagcacataacgtt

SEQ ID NO: 167553 - DNA, 601 bp, Human
tgacatgcacctgtagtcctagatacttgggaggctgaggtgggaggattgcttaagcctggcaggtcaagactgcaggaaactgagatgatgccattgcactccagcctgggtgacagagccagatcctgtctcaaatatatacttaatggcttcttcatcatcaggaagtagtgattaaatgtctttactttactgttggcctggtgcagtggctcacacctgtaatcccagcactttgggaggccgaggcgggcagatcacttgaagccaggagtttgagaccagcccagccaacatkgtgaaacctggtctctactaaaaatacaaaaattagctagatgtggtggctcacgcctgtaatcccagctactttggaagctgaggcacaagactcacttgaacctgggaggcggaggttgccgtgagctaagatcgtgccactgcactccagcctgggtgacaataaatacatacatacatacatacatacatacatacatacataaaaaatgtctttacattgtaatgtctgtacaatccaagaaggaattagacataatccacactcttattccttacctaagactgagacactgac

SEQ ID NO: 167554 - DNA, 601 bp, Human
acaaggttagggagtctctgacatcatcgtaacaatcatcgtctcatagtcagaatgattactcttgtttggttaaaaaatactggctttccagcctgggcaacatagtgagaccttgtctctacacagaataaaataaagttggccaggcatggtgacatgcacctgtagtcctagatacttgggaggctgaggtgggaggattgcttaagcctggcaggtcaagactgcaggaaactgagatgatgccattgcactccagcctgggtgacagagccagatcctgtctcaaatatatacwtaatggcttcttcatcatcaggaagtagtgattaaatgtctttactttactgttggcctggtgcagtggctcacacctgtaatcccagcactttgggaggccgaggcgggcagatcacttgaagccaggagtttgagaccagcccagccaacatggtgaaacctggtctctactaaaaatacaaaaattagctagatgtggtggctcacgcctgtaatcccagctactttggaagctgaggcacaagactcacttgaacctgggaggcggaggttgccgtgagctaagatcgtgccactg

SEQ ID NO: 167555 - DNA, 601 bp, Human
agtattaaagtgctacagatgcctcttcctaagcatcatctccactcttcttggacacataatggaacaattatctgggaatatctggatttgggacactttagggagtccaggggcatttcccagggctgaaagcgcattatctttccatggctgaggccaggaacagcttcctagaagggaatcctcaccatcaacatacaacgactgaagctccacctgggcagggcagatggaatgggaggactctcctgggcctggagcgggagggagcctgtgagacacagaaacacataataawccctggaacactgtaacatgcgggagagtgagatacccagggagagcggcagaggagaaagaggatttggagaaagtcagcagccagtagggaactggaaagcctgaatggtttaatcagagtttcaataggtctatatagagtgagactgttctttttaaaaaaaccctggagctgtggtatggacaggctgcctggaaacaaggttagggagtctctgacatcatcgtaacaatcatcgtctcatagtcagaatgattactcttgtttggttaaaaaatactggctttccagcctggg

SEQ ID NO: 167556 - DNA, 601 bp, Human
gtctcagagtaaaaggtagaattatcagagcagcagagcaattttatggagagagagagcctgaaaaacagatacactctggggcacttgaggtttctctctgtttcttactgtattgttaccatattcttaccccaaacctttaggggttacagatatttttaataatatgatggaagctatgtactctccccagaataatggtcatatgtacaaaactttgcatatgatttcaggggcttcatgtaaaccttaaggaacaggtgaagaaaccattctacaaatcattaataattcaagwgtctgaaatgtaactagtccatcaacagaatgcttggcttaaatggtgttttgataaatatgtcaaggaaagagtatgaagaaaagcaaaattatcaagacagctttataagataagatgtactcaatcaacccaagaaaggtagtggccattctaatgctgccattcaaaggggatcctgattaatggaggtggctcagggaacaaagtgaaagacaaaacaagtgatcaggtgatatatgttggtcaaatatagtaataggctgtgcatgcagaaaatatagcaagacagaagacttg

SEQ ID NO: 167557 - DNA, 601 bp, Human
actaatattttaagttcaaatttagttttggagagttggtacttaagtttttaattttatatttgtgtctcttttctctaatgttgcaaatctttgtcactaatgacattaacataattatcatttgcttttggaagcgcagcctagagcttgcatctccagctcttctgatgtcctcttttaaattcctctctctgtaaaccattccagatgggttctttaatctgcaactgaatcctgacagtgtaagctgtgcaggcagaagtgaaggggcttttcattgtttgcacagtgcctgtgyagccactcacagttaaacaaactgatgcaagtgagtctccagtgagacaatggttgtagatgtattaagcagagatccaggtcacccagtctttttcatctctgcaaatcccaattcaccaaaatttgtgcttctgtttttcataacagtccttctctctctttatcccccttctctaaagcagaccctagggaatgcattaggtcaggcccacagcaaatactacagggtcttctcttaactgtggatcctggtcattttagtgaagtctttcagaggccattccatcccaacatcaga

SEQ ID NO: 167558 - DNA, 601 bp, Human
ctgaaagtgaatatccttttgcttttataaaaacatcactacaataaactatcacttatatccaaaacacacaacaatttcttaatattagtatacaaatttttcttagtatttcgtaggtagttttattttttcttaatttgagtcaggatccaaacaagacccacatattccttttggtcgatatgtctcgtctcatttaatttatatgtcttctatttttctttttctctttttttgggggtgatacatgtgacaaattcatacactcatataatttgtaaagatcaaatcagcgtarttgggatatctgtcaccttaaatattcgtcttttctttatgttgaaaatattctaattacttttcttcatttttcttttcttctctctccctttcttcctccctctcttctttttatttcatttttttcccatttatttgttatagaagccaggtgatttgccctatagaactttttctcagtttatgttttgctggttgcaatcccataatgttatttaaacaaattccttttctccatgcattttctataaaacaagtattcagttagaaagacttgaatggattcagttttaacact

SEQ ID NO: 167559 - DNA, 601 bp, Human
tatacctacccacttcctacccaccctcacctcatcgggttatttcaaaccaaatcacatcatttcatctactaatttcatgtacgccgaatttacgttaataagctttaatctaatacttcagtataagcgctgaaagtgaatatccttttgcttttataaaaacatcactacaataaactatcacttatatccaaaacacacaacaatttcttaatattagtatacaaatttttcttagtatttcgtaggtagttttattttttcttaatttgagtcaggatccaaacaagacccacayattccttttggtcgatatgtctcgtctcatttaatttatatgtcttctatttttctttttctctttttttgggggtgatacatgtgacaaattcatacactcatataatttgtaaagatcaaatcagcgtaattgggatatctgtcaccttaaatattcgtcttttctttatgttgaaaatattctaattacttttcttcatttttcttttcttctctctccctttcttcctccctctcttctttttatttcatttttttcccatttatttgttatagaagccaggtgatttgccctata

SEQ ID NO: 167560 - DNA, 601 bp, Human
agttccctatgaccaactgacagaggaggaaaaaacagtctatcctggtttaaatatgccctcacatcagctgagggtgacaattgcagcacctcaaccacattcaggaatccctggaggattgtgacaaagatgggtattcccagtggtccactttgcctggaagatgagatgtccagaggtgaggctttactctgattcatgagcagtggctagtgtttggagctgtatggtcaggaatttggagagaataaaactgcaagattaggcaagaatcatattgttggacctctttgaatgratccagagtatgagaatatttgtgtcttatgagaatactcacccaaggccttactgaggaagatctcaggaatcaggaggctgtgatcatctgctctggctgaatgtcaggcagcctctttctccagttactccagcaattgctcaaagggctcattaatgaagcggccttggtggaaggtgcagagtttatggaaggattcagtaacataaggatgtactcacccaggccagtctgaccactgctaagtgcccaattgacatacacagaggccaaacctgagcctctgatggagagtca

SEQ ID NO: 167561 - DNA, 601 bp, Human
attctgctgctcttttacctctctgtttcaaccagcaactatgacctggtggtgagttccctatgaccaactgacagaggaggaaaaaacagtctatcctggtttaaatatgccctcacatcagctgagggtgacaattgcagcacctcaaccacattcaggaatccctggaggattgtgacaaagatgggtattcccagtggtccactttgcctggaagatgagatgtccagaggtgaggctttactctgattcatgagcagtggctagtgtttggagctgtatggtcaggaatttggaragaataaaactgcaagattaggcaagaatcatattgttggacctctttgaatgaatccagagtatgagaatatttgtgtcttatgagaatactcacccaaggccttactgaggaagatctcaggaatcaggaggctgtgatcatctgctctggctgaatgtcaggcagcctctttctccagttactccagcaattgctcaaagggctcattaatgaagcggccttggtggaaggtgcagagtttatggaaggattcagtaacataaggatgtactcacccaggccagtctgaccactgct

SEQ ID NO: 167562 - DNA, 601 bp, Human
catcattaagtggaagtgatttgcaggaggtctcactccagaatggtctgaaagcaatggtaagttgaataaacaatgaatagctcatattctgctgctcttttacctctctgtttcaaccagcaactatgacctggtggtgagttccctatgaccaactgacagaggaggaaaaaacagtctatcctggtttaaatatgccctcacatcagctgagggtgacaattgcagcacctcaaccacattcaggaatccctggaggattgtgacaaagatgggtattcccagtggtccactttgmctggaagatgagatgtccagaggtgaggctttactctgattcatgagcagtggctagtgtttggagctgtatggtcaggaatttggagagaataaaactgcaagattaggcaagaatcatattgttggacctctttgaatgaatccagagtatgagaatatttgtgtcttatgagaatactcacccaaggccttactgaggaagatctcaggaatcaggaggctgtgatcatctgctctggctgaatgtcaggcagcctctttctccagttactccagcaattgctcaaagggctcatta

SEQ ID NO: 167563 - DNA, 601 bp, Human
aaaaattcataatatattgaggattattccatcattaagtggaagtgatttgcaggaggtctcactccagaatggtctgaaagcaatggtaagttgaataaacaatgaatagctcatattctgctgctcttttacctctctgtttcaaccagcaactatgacctggtggtgagttccctatgaccaactgacagaggaggaaaaaacagtctatcctggtttaaatatgccctcacatcagctgagggtgacaattgcagcacctcaaccacattcaggaatccctggaggattgtgacaragatgggtattcccagtggtccactttgcctggaagatgagatgtccagaggtgaggctttactctgattcatgagcagtggctagtgtttggagctgtatggtcaggaatttggagagaataaaactgcaagattaggcaagaatcatattgttggacctctttgaatgaatccagagtatgagaatatttgtgtcttatgagaatactcacccaaggccttactgaggaagatctcaggaatcaggaggctgtgatcatctgctctggctgaatgtcaggcagcctctttctccagtt

SEQ ID NO: 167564 - DNA, 601 bp, Human
gggtggactctgttgtctgccactgaaccctgactggtacagcaactggcacaaaaatgggtgaatatgattctcttctatgattccaagcaggcttccagtttactttcatttgtgtgcgtatggtctgctcacctattttgttcccatgacccaaagttcttttctttttttttttttgagaaggagtctcgctctgtcacccaggctggagtgcagtggcacgatcttggctcactacaagctctgcctcccgggttcacgccattctcctgcctcagcctccccagtagctggaacyacaacaattttttgtattttttagtagagacggggtttcaccgtgttagccaggattgtctcgatctgctgaccttgtgatccgcccacctcggcctcccaaagcgctgggattacaggcatgagccaccgctcctggccgcaaagttgttttcagtcatagtattgtcattaccattttctcattattgtagccatgccttcttttgtctctgctactctgagactccatcattatcagggagcctacttgtgaggcaatgtcttcacctttgtccttgacctatttctgttatacttt

SEQ ID NO: 167565 - DNA, 601 bp, Human
tgggtgcttatatgagaaaggcaccggcacttacactcattgctttatataatcctcataattcacaaatgttacttaagtgcttaccatatattggtttctgtaggatgcagtgggtatacattagtgaacaagacagataaaagttcctgtcttcataaagcataaataataggtgaaatgatcagataaagaagtgagaaaaaaattagaatattaggtggtgaaaagtgcattggagaaacatgaagtagagtaggatgaaggaggctgataagggttggggcatgttgctattctraacatgtggcaacagaagacctcctaaaaaagacagcatttgaacaggcactgaaggttatgaggtcgcagacagtggctgccaggggaagagcattacagccagagagaatggcaagttcaaaagcttggaagaagaaatgtgctcatagcagctgtacaaggtaggtgttatcttcattttgcacagaaggaaataaaaccccgaaaatgtaagtaacttgtctaagggcttatactaataagtgtgacattgtggacttgaactaaattctcttgaatttaaaaatctatattctgt

SEQ ID NO: 167566 - DNA, 601 bp, Human
tgtggagcagcagagccttgcccttcaccctgggaacaagtgatgggatgttttgttttagagagctcctaagatttctaggatcgtcagttaaaactgctagtgttaccttccctaacacacagacttagtgcctattagttctaatgttactttcatattatatggaagttatgtctttatgcatctatctcttccagtacgttactggggaaatttcacaaagagagacacttttccccctaacctgtatgttggtcaagagagacacatttttctgatcaaagattgtgtttggtayaccaagtgttcaataaatgttttttgacctagaaacatatcagtagtaaataccaatactaataattaacatgtattgggtgcttatatgagaaaggcaccggcacttacactcattgctttatataatcctcataattcacaaatgttacttaagtgcttaccatatattggtttctgtaggatgcagtgggtatacattagtgaacaagacagataaaagttcctgtcttcataaagcataaataataggtgaaatgatcagataaagaagtgagaaaaaaattagaatattaggtgg

SEQ ID NO: 167567 - DNA, 601 bp, Human
gctagactattttcccaccccttgagataggcaaggaactgtgattgaattctggcagatgaaatgtgggaaggatgaatgcatgccactttcaggaatggcctctagagtctcctggatcatctgccacacactccctctttttgcagagaatttggaagccctgaatatggtggtacgatgagatgtaaggagcctaggatcctgaatgaccatgtggagcagcagagccttgcccttcaccctgggaacaagtgatgggatgttttgttttagagagctcctaagatttctaggatcrtcagttaaaactgctagtgttaccttccctaacacacagacttagtgcctattagttctaatgttactttcatattatatggaagttatgtctttatgcatctatctcttccagtacgttactggggaaatttcacaaagagagacacttttccccctaacctgtatgttggtcaagagagacacatttttctgatcaaagattgtgtttggtataccaagtgttcaataaatgttttttgacctagaaacatatcagtagtaaataccaatactaataattaacatgtattgggtgctt

SEQ ID NO: 167568 - DNA, 601 bp, Human
tatctgtgtgcttatcctccagtaaaatttccctgaatgtttccctttgccgagtatggcagttactttccaggatgataagcagatctgtatcctctgcttcttgggccatagctagactattttcccaccccttgagataggcaaggaactgtgattgaattctggcagatgaaatgtgggaaggatgaatgcatgccactttcaggaatggcctctagagtctcctggatcatctgccacacactccctctttttgcagagaatttggaagccctgaatatggtggtacgatgagatrtaaggagcctaggatcctgaatgaccatgtggagcagcagagccttgcccttcaccctgggaacaagtgatgggatgttttgttttagagagctcctaagatttctaggatcgtcagttaaaactgctagtgttaccttccctaacacacagacttagtgcctattagttctaatgttactttcatattatatggaagttatgtctttatgcatctatctcttccagtacgttactggggaaatttcacaaagagagacacttttccccctaacctgtatgttggtcaagagagacacat

SEQ ID NO: 167569 - DNA, 601 bp, Human
cgagatcacgccactgcactccagcctgggtgacagagcaagactctgtctcaaaaaaaaaaaaaaaaagatttcacgcatttaatcctcacgataagtttataggttcaagtttattatattttactgttattcccattatttaagtattaaaaatgggttggagagtttgagtgacttaacaaagcctactaattcttacctgaatttgaactcagcttttcatgactccacatgtcactgtcttaatatctgtgtgcttatcctccagtaaaatttccctgaatgtttccctttgccragtatggcagttactttccaggatgataagcagatctgtatcctctgcttcttgggccatagctagactattttcccaccccttgagataggcaaggaactgtgattgaattctggcagatgaaatgtgggaaggatgaatgcatgccactttcaggaatggcctctagagtctcctggatcatctgccacacactccctctttttgcagagaatttggaagccctgaatatggtggtacgatgagatgtaaggagcctaggatcctgaatgaccatgtggagcagcagagccttgccct

SEQ ID NO: 167570 - DNA, 601 bp, Human
ccattctcctaccccagcctcctgagtagctgggactacaggtgcctgccaccacgccagctaattttttgtatttttagtagagatggggtttcaccatgttagccagaattgtctcgatctcctgacctcgtgatccgcgcaccttggcctcccaaagtgctgagattacaagcatgagccaccgcgcctagcctgggtgggggctgtttttaaatcttatctcaagttcatgtcggctttggagatttcattaaacacgacaagcgagaatttgggatgaagctgatgtgcactgaargctgatggtgtgcacacgggaatcatagattatatggcactggtcacagagattacataggtcaactttccaccttgactcaagaataaaggcaagaaattgtcaaaggcaattttttgtttttagttaagacacaaagtgatattctgggagaaagaaagccaatatgagtctcaaagtttctagaaattgttttgggaaaagatttggaaaattaaatcatggggcataaaatgcaatattaatagaaaaagaatgaaacttcaatatgaccaaggagcttttagattatgctgcagt

SEQ ID NO: 167571 - DNA, 601 bp, Human
ctgcctcctgggttcaagccattctcctaccccagcctcctgagtagctgggactacaggtgcctgccaccacgccagctaattttttgtatttttagtagagatggggtttcaccatgttagccagaattgtctcgatctcctgacctcgtgatccgcgcaccttggcctcccaaagtgctgagattacaagcatgagccaccgcgcctagcctgggtgggggctgtttttaaatcttatctcaagttcatgtcggctttggagatttcattaaacacgacaagcgagaatttgggatgragctgatgtgcactgaaagctgatggtgtgcacacgggaatcatagattatatggcactggtcacagagattacataggtcaactttccaccttgactcaagaataaaggcaagaaattgtcaaaggcaattttttgtttttagttaagacacaaagtgatattctgggagaaagaaagccaatatgagtctcaaagtttctagaaattgttttgggaaaagatttggaaaattaaatcatggggcataaaatgcaatattaatagaaaaagaatgaaacttcaatatgaccaaggagct

SEQ ID NO: 167572 - DNA, 601 bp, Human
agctctgcctcctgggttcaagccattctcctaccccagcctcctgagtagctgggactacaggtgcctgccaccacgccagctaattttttgtatttttagtagagatggggtttcaccatgttagccagaattgtctcgatctcctgacctcgtgatccgcgcaccttggcctcccaaagtgctgagattacaagcatgagccaccgcgcctagcctgggtgggggctgtttttaaatcttatctcaagttcatgtcggctttggagatttcattaaacacgacaagcgagaatttggkatgaagctgatgtgcactgaaagctgatggtgtgcacacgggaatcatagattatatggcactggtcacagagattacataggtcaactttccaccttgactcaagaataaaggcaagaaattgtcaaaggcaattttttgtttttagttaagacacaaagtgatattctgggagaaagaaagccaatatgagtctcaaagtttctagaaattgttttgggaaaagatttggaaaattaaatcatggggcataaaatgcaatattaatagaaaaagaatgaaacttcaatatgaccaagg

SEQ ID NO: 167573 - DNA, 601 bp, Human
ctttggcttttttaagagataatagaaatgtgttctcagagaaggaaggccctatgcagatgaacttccttccttttgtaatgaaaaacctcattattaaaccagaaaatagaagccaactggtttgaggctttccccttgtcccctcagcttatgtaaatacttgaggtgttatttttccatggctctgggaagtccgatgacccaacatacttttgcataaacataaatgatatatttatcttgaggttcctctttctgcaagtttagaactaacatttgggtgggggctgtgggtttyttttttttttttttgagatggagtctcactccgtcgcccagtccagagtgcagtggcacaatctgggctcactgcaagctctgcctcctgggttcaagccattctcctaccccagcctcctgagtagctgggactacaggtgcctgccaccacgccagctaattttttgtatttttagtagagatggggtttcaccatgttagccagaattgtctcgatctcctgacctcgtgatccgcgcaccttggcctcccaaagtgctgagattacaagcatgagccaccgcgcctagcctgggtg

SEQ ID NO: 167574 - DNA, 601 bp, Human
atgactttggcttttttaagagataatagaaatgtgttctcagagaaggaaggccctatgcagatgaacttccttccttttgtaatgaaaaacctcattattaaaccagaaaatagaagccaactggtttgaggctttccccttgtcccctcagcttatgtaaatacttgaggtgttatttttccatggctctgggaagtccgatgacccaacatacttttgcataaacataaatgatatatttatcttgaggttcctctttctgcaagtttagaactaacatttgggtgggggctgtgggtttcttttttttttttttgagatggagtctcactccgtcgcccagtccagagtgcagtggcacaatctgggctcactgcaagctctgcctcctgggttcaagccattctcctaccccagcctcctgagtagctgggactacaggtgcctgccaccacgccagctaattttttgtatttttagtagagatggggtttcaccatgttagccagaattgtctcgatctcctgacctcgtgatccgcgcaccttggcctcccaaagtgctgagattacaagcatgagccaccgcgcctagcctg

SEQ ID NO: 167575 - DNA, 601 bp, Human
aaatgcttttatagtgcaaaatataaagatgaacagtaaaaattcacactgataatttaaaatgtcattttttttcttcttttagaatgacattaaatagcaaataaaaagcatctcatgacaagttaagggagagaccatggaataaaggaaaaagtgcctttaatggcaccttttttcttgctttttgaacaagggccttgcattttctttttgcgctcagccccacaaatcatgtagccagttttgcatgtaactctgttctcttttctgcagtccctgggcaactgccaggggatgrctttggcttttttaagagataatagaaatgtgttctcagagaaggaaggccctatgcagatgaacttccttccttttgtaatgaaaaacctcattattaaaccagaaaatagaagccaactggtttgaggctttccccttgtcccctcagcttatgtaaatacttgaggtgttatttttccatggctctgggaagtccgatgacccaacatacttttgcataaacataaatgatatatttatcttgaggttcctctttctgcaagtttagaactaacatttgggtgggggctgtgggttt

SEQ ID NO: 167576 - DNA, 601 bp, Human
ccgtctcaaaaataaatacataaataataaatacgagcataggttttggaattggacagacgtgaaactgaatcttagctctgtcactgtctgtgtgactgggaaaatttttgcaaaattctgaccccagttttttcgtttataaagcaggtgttggttatacttgccttatagttgtcgtcaggattaaatgagatgtttgtaaagtatattacaagcacatagcagaagctgcataaatagcagttataaagtgtatcagcctaccaccctgaactcttgccttagttcttctttccaktcacacaattactatttcatcaaggctgttcttagtccagggctttcaggctcagtagcctcctaagcccagcacagtcatggtcagaaattccaatgacaggttgaaatagttgcaaataatttattaaaagagagtaagaacttgtttggggcctgtttaattctagaagatcaattccctattggagagccctcctaccagcctcttgtgacttgatgaaaatatccaaccacaggtggcttccttggatatgtccggtgtggtcacacagggcccagcactcagaagggccctgag

SEQ ID NO: 167577 - DNA, 601 bp, Human
ggtggcatgtgcctgtagttccagctacttgggaggctgagctgggaggatctcttgagctcaggaagtggaagttgcagtgagccgatattgtgccactgcactccagcctgggtgacagagtgagaccccgtctcaaaaataaatacataaataataaatacgagcataggttttggaattggacagacgtgaaactgaatcttagctctgtcactgtctgtgtgactgggaaaatttttgcaaaattctgaccccagttttttcgtttataaagcaggtgttggttatacttgccttmtagttgtcgtcaggattaaatgagatgtttgtaaagtatattacaagcacatagcagaagctgcataaatagcagttataaagtgtatcagcctaccaccctgaactcttgccttagttcttctttccagtcacacaattactatttcatcaaggctgttcttagtccagggctttcaggctcagtagcctcctaagcccagcacagtcatggtcagaaattccaatgacaggttgaaatagttgcaaataatttattaaaagagagtaagaacttgtttggggcctgtttaattctaga

SEQ ID NO: 167578 - DNA, 601 bp, Human
cccatgcctgtaatcctagcactttgggaggttgaggtgggtggattgcctgagcccaggagttcaagatcagcctgggcaatatggcaaaaacccatccctacaaaaagtaaaaaaataaaaaattagccaggtgtggtggcatgtgcctgtagttccagctacttgggaggctgagctgggaggatctcttgagctcaggaagtggaagttgcagtgagccgatattgtgccactgcactccagcctgggtgacagagtgagaccccgtctcaaaaataaatacataaataataaatamgagcataggttttggaattggacagacgtgaaactgaatcttagctctgtcactgtctgtgtgactgggaaaatttttgcaaaattctgaccccagttttttcgtttataaagcaggtgttggttatacttgccttatagttgtcgtcaggattaaatgagatgtttgtaaagtatattacaagcacatagcagaagctgcataaatagcagttataaagtgtatcagcctaccaccctgaactcttgccttagttcttctttccagtcacacaattactatttcatcaaggctgttctt

SEQ ID NO: 167579 - DNA, 601 bp, Human
gaacaaaagctctgcagccttcaaactctttgctagttctccagtatgtgcccattcccacacctaaatcaacccgtggatacttcctgttattttgtttgtattgacttttttcttcctttttaatagctacctgctaatatttaggaaaaagaataattgaaacagggaggtatcattagatttgttaagcaaatctcctcccatcttaggatacatgctgggcctgccaaggtgactctcatctaaaatctctgcacaaagactcttctcttctttgtggctcttctcccactcagcygtctcaatacagcattggccttgtttattcagacgctgatccttggcaatggagaaagcttgttatatggaaagaacataggttttgggctgggcatgttggcccatgcctgtaatcctagcactttgggaggttgaggtgggtggattgcctgagcccaggagttcaagatcagcctgggcaatatggcaaaaacccatccctacaaaaagtaaaaaaataaaaaattagccaggtgtggtggcatgtgcctgtagttccagctacttgggaggctgagctgggaggatctcttgagct

SEQ ID NO: 167580 - DNA, 601 bp, Human
tgcttgagcctgggaggttgaggctgcagggagctgagattgtaccacagtactccagcctgagcaacagagggaaatcctatctcaaaaaggggaagaagaaaaaagaatctactggaatatttcacaattttctgagtgtactacctataccaacctgagtgtgttaaataagggcaacagctagagatgaggaaagaaaatgtctcgatgtccaccataagcagctgctcagacttcctgggcatgccactcatgcttttgggttacattgcattcttgctgctaattttgcaactayattcaaaaggaatatttggtcagattaaattggccccttgactttgtccctgaatgctggccatcctctttttgtgtgctgtggctttgcttacttgaacagggttctaggaacaaaagctctgcagccttcaaactctttgctagttctccagtatgtgcccattcccacacctaaatcaacccgtggatacttcctgttattttgtttgtattgacttttttcttcctttttaatagctacctgctaatatttaggaaaaagaataattgaaacagggaggtatcattagatttgtta

SEQ ID NO: 167581 - DNA, 601 bp, Human
aaatgaattcatataatttgttcccttttgtatctggcttctttcaatgagtataatgtttctgaggctcatccatataatagcatacatcactactttgtgaatttgtattttgcagtttaaatcttctagagcagtataatcaggtttagtaagaatctattggagggcaggcacagtggctcatgcctgtaatcccagcactttgggaggtataggcaggaggatcgtctgagcccaggaatttgagatgagcctgggcgatatagtgagaccctgtctctacaaaagatacaaaaastagccaggcatggaggtgcctgcctgtagtcccagctaattgggaagctgaggcagaaggattgcttgagcctgggaggttgaggctgcagggagctgagattgtaccacagtactccagcctgagcaacagagggaaatcctatctcaaaaaggggaagaagaaaaaagaatctactggaatatttcacaattttctgagtgtactacctataccaacctgagtgtgttaaataagggcaacagctagagatgaggaaagaaaatgtctcgatgtccaccataagcagctgctcagact

SEQ ID NO: 167582 - DNA, 601 bp, Human
tgtggtaatgcatgcttattaaaaatccctgggtgactgcctatgtatttaacagctctattgatgtacaatatttaatgatagtattcactcgttttatcaccatcatctaattttagaacattttcactacctcagaaagaaacctggcatccatttgcagtcactctcaattcccaccaacaacccaggcaactaactgattaccaccatttgactttctttctctataaagttgcctattttgaacacagaaatgaattcatataatttgttcccttttgtatctggcttctttcamtgagtataatgtttctgaggctcatccatataatagcatacatcactactttgtgaatttgtattttgcagtttaaatcttctagagcagtataatcaggtttagtaagaatctattggagggcaggcacagtggctcatgcctgtaatcccagcactttgggaggtataggcaggaggatcgtctgagcccaggaatttgagatgagcctgggcgatatagtgagaccctgtctctacaaaagatacaaaaagtagccaggcatggaggtgcctgcctgtagtcccagctaattgggaa

SEQ ID NO: 167583 - DNA, 601 bp, Human
ttggatggttactgtaacacagcatcacaccagatactttgtaaatattaccttatttaacctttgaatcaacagggaaaaaacacagaaaatattctttcaggcaggtatttttatcgtcattttatagatgggaaaaactgaagttcaaagaaattgcatactttactttcaagcatcttgtaagccaaaaggcacaattagtggtagacagctgtctgagcatgagcctaaaaaattcaataaagagcttcaacagtcacaggtatctgaacaggaatctagatgcaagatcttcctwcagccagctgtagcagcagcaggggccatggtttaatggttacctctcaagagcaattactaggagcctattttggtgacaggaaatggaaacttagagttctgaagtttataaataagcactgtactatttacaacacagaaagataaaaattaaaggttcttggagggcgtatttaaacaggcagtgtggaattaaccacagtaatctcatgatcactgagtgggcttggagtagctctcgggctctgtcagtcagtttggagagtgggcagagcctctcaggagctcctggagggat

SEQ ID NO: 167584 - DNA, 601 bp, Human
tctcaactgaaggagatccttacccttatctcaataatggttgccatatattggatggttactgtaacacagcatcacaccagatactttgtaaatattaccttatttaacctttgaatcaacagggaaaaaacacagaaaatattctttcaggcaggtatttttatcgtcattttatagatgggaaaaactgaagttcaaagaaattgcatactttactttcaagcatcttgtaagccaaaaggcacaattagtggtagacagctgtctgagcatgagcctaaaaaattcaataaagagmttcaacagtcacaggtatctgaacaggaatctagatgcaagatcttccttcagccagctgtagcagcagcaggggccatggtttaatggttacctctcaagagcaattactaggagcctattttggtgacaggaaatggaaacttagagttctgaagtttataaataagcactgtactatttacaacacagaaagataaaaattaaaggttcttggagggcgtatttaaacaggcagtgtggaattaaccacagtaatctcatgatcactgagtgggcttggagtagctctcgggctctg

SEQ ID NO: 167585 - DNA, 601 bp, Human
gcctgcgtttcctgccacctcatttcttcccttggtttggtttgaatttcaatttcactgtgattagaagctgctctccagcatttataagttgaggaatgtgggttttcaaaagtttcactgaagatggagtttctttttttgtttgtttgttttttgtttgttttttggtcatttgtggttggtttcagtaagtaaaatgtggtagatatgcctttttctcaactgaaggagatccttacccttatctcaataatggttgccatatattggatggttactgtaacacagcatcacaccrgatactttgtaaatattaccttatttaacctttgaatcaacagggaaaaaacacagaaaatattctttcaggcaggtatttttatcgtcattttatagatgggaaaaactgaagttcaaagaaattgcatactttactttcaagcatcttgtaagccaaaaggcacaattagtggtagacagctgtctgagcatgagcctaaaaaattcaataaagagcttcaacagtcacaggtatctgaacaggaatctagatgcaagatcttccttcagccagctgtagcagcagcaggggccatgg

SEQ ID NO: 167586 - DNA, 601 bp, Human
gattgtgggacaagctggggtgtgagctgaggcagcagacagctcagacataggtattttgcttcagagcatttcctcgccatctctgccatgttttctttcttgagaatcaagaggtggtccacctggcttagcatgacatcctgtagttcacagattttttccatgtggtgatttagcatgtacttctcttcagcgaataatgttcacacctgcagagccagtactgtgtaccatctctcctcacatctgcaaagtgccttattctgatcggatgtccctgcttttttgagtgttctgtgggacttgaggatgctcctacagtctccatactcccaacaccttgtcttctgagtatgggtttactggtttggagcttcaggactttgccccttactgttggaaaacttggagcttttcccgtagatgtgtattggagcctgcgtttcctgccacctcatttcttcccttggtttggtttgaatttcaatttcactgtgattagaagctgctctccagcatttataagttgaggaatgtgggttttcaaaagtttcactgaagatggagtttctttttttgtttgtttgttttttgtttg

SEQ ID NO: 167587 - DNA, 601 bp, Human
cttatctctcaacaagggccacactttcccaactctctattgactgaagagcagattgtgggacaagctggggtgtgagctgaggcagcagacagctcagacataggtattttgcttcagagcatttcctcgccatctctgccatgttttctttcttgagaatcaagaggtggtccacctggcttagcatgacatcctgtagttcacagattttttccatgtggtgatttagcatgtacttctcttcagcgaataatgttcacacctgcagagccagtactgtgtaccatctctcctcacrtctgcaaagtgccttattctgatcggatgtccctgcttttttgagtgttctgtgggacttgaggatgctcctacagtctccatactcccaacaccttgtcttctgagtatgggtttactggtttggagcttcaggactttgccccttactgttggaaaacttggagcttttcccgtagatgtgtattggagcctgcgtttcctgccacctcatttcttcccttggtttggtttgaatttcaatttcactgtgattagaagctgctctccagcatttataagttgaggaatgtgggttttc

SEQ ID NO: 167588 - DNA, 601 bp, Human
ttcattctgtctacatgcctgaatcccatgctagtgacagtctgattatggcttatctctcaacaagggccacactttcccaactctctattgactgaagagcagattgtgggacaagctggggtgtgagctgaggcagcagacagctcagacataggtattttgcttcagagcatttcctcgccatctctgccatgttttctttcttgagaatcaagaggtggtccacctggcttagcatgacatcctgtagttcacagattttttccatgtggtgatttagcatgtacttctcttcagsgaataatgttcacacctgcagagccagtactgtgtaccatctctcctcacatctgcaaagtgccttattctgatcggatgtccctgcttttttgagtgttctgtgggacttgaggatgctcctacagtctccatactcccaacaccttgtcttctgagtatgggtttactggtttggagcttcaggactttgccccttactgttggaaaacttggagcttttcccgtagatgtgtattggagcctgcgtttcctgccacctcatttcttcccttggtttggtttgaatttcaatttcact

SEQ ID NO: 167589 - DNA, 601 bp, Human
ttttaaaatttctctgatgtcatggagaagaggttgtctgattttttttggatggctgggtggcgttgtgcttcttctgcctatactgttttactgcctatgctttttcattctgtctacatgcctgaatcccatgctagtgacagtctgattatggcttatctctcaacaagggccacactttcccaactctctattgactgaagagcagattgtgggacaagctggggtgtgagctgaggcagcagacagctcagacataggtattttgcttcagagcatttcctcgccatctctgccatgttttctttcttgagaatcaagaggtggtccacctggcttagcatgacatcctgtagttcacagattttttccatgtggtgatttagcatgtacttctcttcagcgaataatgttcacacctgcagagccagtactgtgtaccatctctcctcacatctgcaaagtgccttattctgatcggatgtccctgcttttttgagtgttctgtgggacttgaggatgctcctacagtctccatactcccaacaccttgtcttctgagtatgggtttactggtttggagcttcaggactttgcc

SEQ ID NO: 167590 - DNA, 601 bp, Human
atccaccttggcctcccaaagtccaccaaattctgttttaaaaaatctctgaagtatagtaactttatccaaatatgtcatgttgctaattctgtatcagttttctggatgctttcttctattatatctttaaatatttttcatttgcatttattctgttggcttcagaataccacttatgggaatattggatatcttttatctgtcactcatatcaattattttctctgtcataatttaaacctttgttctttcctattttattttgtttagttttatcaaatccatctttcattactayattttcagcaatttttattcattttttgttttctgattttaatatggctgattttcctcttctgttttttgagctttgttaatttaccctcaatattcttctgtttctgctacattttttcaagcccaaagtgtcattatatgaaaaaaagactttatttttaaaatttctctgatgtcatggagaagaggttgtctgattttttttggatggctgggtggcgttgtgcttcttctgcctatactgttttactgcctatgctttttcattctgtctacatgcctgaatcccatgctagtg

SEQ ID NO: 167591 - DNA, 601 bp, Human
ggttgtccaccaaattcttcaatttttttttttttttgagatggagcctctttttgtcacccaggctggagtgcagtggcaccatctcagctcactgcaacctctacctcccaggttcaagtgattttcctgcttcagcctgccgagtagctgggattgcacgcatgtgccaccatgctcagctgattttgtatttttagtagagacggggattcaccatgttggccaggctggtcttcagctcacgactttaggtgatctatccaccttggcctcccaaagtccaccaaattctgttttwaaaaatctctgaagtatagtaactttatccaaatatgtcatgttgctaattctgtatcagttttctggatgctttcttctattatatctttaaatatttttcatttgcatttattctgttggcttcagaataccacttatgggaatattggatatcttttatctgtcactcatatcaattattttctctgtcataatttaaacctttgttctttcctattttattttgtttagttttatcaaatccatctttcattactatattttcagcaatttttattcattttttgttttctgattt

SEQ ID NO: 167592 - DNA, 601 bp, Human
gaacgcagctacgagtttgaagacagctttttcccctcctccacataacttgatttttttctggttgtccaccaaattcttcaatttttttttttttttgagatggagcctctttttgtcacccaggctggagtgcagtggcaccatctcagctcactgcaacctctacctcccaggttcaagtgattttcctgcttcagcctgccgagtagctgggattgcacgcatgtgccaccatgctcagctgattttgtatttttagtagagacggggattcaccatgttggccaggctggtcttsagctcacgactttaggtgatctatccaccttggcctcccaaagtccaccaaattctgttttaaaaaatctctgaagtatagtaactttatccaaatatgtcatgttgctaattctgtatcagttttctggatgctttcttctattatatctttaaatatttttcatttgcatttattctgttggcttcagaataccacttatgggaatattggatatcttttatctgtcactcatatcaattattttctctgtcataatttaaacctttgttctttcctattttattttgtttagtttta

SEQ ID NO: 167593 - DNA, 601 bp, Human
ttagactattgtcttctagttttgaacgcagctacgagtttgaagacagctttttcccctcctccacataacttgatttttttctggttgtccaccaaattcttcaatttttttttttttttgagatggagcctctttttgtcacccaggctggagtgcagtggcaccatctcagctcactgcaacctctacctcccaggttcaagtgattttcctgcttcagcctgccgagtagctgggattgcacgcatgtgccaccatgctcagctgattttgtatttttagtagagacggggattcrccatgttggccaggctggtcttcagctcacgactttaggtgatctatccaccttggcctcccaaagtccaccaaattctgttttaaaaaatctctgaagtatagtaactttatccaaatatgtcatgttgctaattctgtatcagttttctggatgctttcttctattatatctttaaatatttttcatttgcatttattctgttggcttcagaataccacttatgggaatattggatatcttttatctgtcactcatatcaattattttctctgtcataatttaaacctttgttctttc

SEQ ID NO: 167594 - DNA, 601 bp, Human
attagactattgtcttctagttttgaacgcagctacgagtttgaagacagctttttcccctcctccacataacttgatttttttctggttgtccaccaaattcttcaatttttttttttttttgagatggagcctctttttgtcacccaggctggagtgcagtggcaccatctcagctcactgcaacctctacctcccaggttcaagtgattttcctgcttcagcctgccgagtagctgggattgcacgcatgtgccaccatgctcagctgattttgtatttttagtagagacggggattyaccatgttggccaggctggtcttcagctcacgactttaggtgatctatccaccttggcctcccaaagtccaccaaattctgttttaaaaaatctctgaagtatagtaactttatccaaatatgtcatgttgctaattctgtatcagttttctggatgctttcttctattatatctttaaatatttttcatttgcatttattctgttggcttcagaataccacttatgggaatattggatatcttttatctgtcactcatatcaattattttctctgtcataatttaaacctttgttcttt

SEQ ID NO: 167595 - DNA, 601 bp, Human
attcatgttatcaaactttttcttttaaatgttttattttctttcaatcctttgtatttttaaagagggtacagcactgttcatgttttgaaggagttatagtttgttcttagttcagtggttaaccttgtaactgtagtattcttatagctatctttcttgatttgacaatatctacttatttcctattaaaaaagaaaggaatcggcctgctattactttgtcccatatgttttcatatcctccacctcctgattttattattaatagtataatttctatattctcagggtttataacrtttacactgtgttctataaccataattctcataattgcctgattttagtgttatatttaattgaattcaatagtcctcataggttttaagtcatgttttgtcttaaagtgccacagtcatggagttcttgcatgttagaaagtatgtttttgctttattcctgaaatatatctggatttaaaattcttgggttaatctttcttctcttgagggtctttaaacattagactattgtcttctagttttgaacgcagctacgagtttgaagacagctttttcccctcctccacataacttgat

SEQ ID NO: 167596 - DNA, 601 bp, Human
attaggtatatctcctaatgctatccctccctcctccccccacccaacaacaggccccggtgtgtgatgttccccttcctgtgtccatgtgttctcattgttcgactcccacctgtgagtgagagcatgtggtgtttggttttttgtccttgggatagtttgctgagaatgatggtttccagcttcatccatatccctacaaaggacatgaactcatcattttttatggctgcatagtattccatggtgtatatgtgccacattttcttaatccagtctatcattgttggacatttgggtyggttccaagtctttgctactgtgaatagtgccgcaataaacatacgtgtgcatgtgtctttatagcagcatgatttataatcctttgggtatatactcagtaatgggatggctgggtcaaatggtatttctagttctagatccctgaggaatcaccacactgacttccacaatggttggtctgatttaatactttattattttagctgaattagacttgtttgatattaacgtcatgattcttgttcttatttgtttgcatggctgtacacttttgtcaccattttatcatgtctcaggc

SEQ ID NO: 167597 - DNA, 601 bp, Human
tatacatgtgccatgttggtgtgctgcacccattaactcgtcatttaacattaggtatatctcctaatgctatccctccctcctccccccacccaacaacaggccccggtgtgtgatgttccccttcctgtgtccatgtgttctcattgttcgactcccacctgtgagtgagagcatgtggtgtttggttttttgtccttgggatagtttgctgagaatgatggtttccagcttcatccatatccctacaaaggacatgaactcatcattttttatggctgcatagtattccatggtgtayatgtgccacattttcttaatccagtctatcattgttggacatttgggtcggttccaagtctttgctactgtgaatagtgccgcaataaacatacgtgtgcatgtgtctttatagcagcatgatttataatcctttgggtatatactcagtaatgggatggctgggtcaaatggtatttctagttctagatccctgaggaatcaccacactgacttccacaatggttggtctgatttaatactttattattttagctgaattagacttgtttgatattaacgtcatgattcttgttcttat

SEQ ID NO: 167598 - DNA, 601 bp, Human
tttttttatactttaagttttagggtacatgtgcacaatgtgcatgttatttacatatgtatacatgtgccatgttggtgtgctgcacccattaactcgtcatttaacattaggtatatctcctaatgctatccctccctcctccccccacccaacaacaggccccggtgtgtgatgttccccttcctgtgtccatgtgttctcattgttcgactcccacctgtgagtgagagcatgtggtgtttggttttttgtccttgggatagtttgctgagaatgatggtttccagcttcatccatrtccctacaaaggacatgaactcatcattttttatggctgcatagtattccatggtgtatatgtgccacattttcttaatccagtctatcattgttggacatttgggtcggttccaagtctttgctactgtgaatagtgccgcaataaacatacgtgtgcatgtgtctttatagcagcatgatttataatcctttgggtatatactcagtaatgggatggctgggtcaaatggtatttctagttctagatccctgaggaatcaccacactgacttccacaatggttggtctgatttaatac

SEQ ID NO: 167599 - DNA, 601 bp, Human
actatgttatactgataggtttcttaaataggattgttccttggaaactttaaaattctactatgataatttatctgtttaaattatcttttttttatactttaagttttagggtacatgtgcacaatgtgcatgttatttacatatgtatacatgtgccatgttggtgtgctgcacccattaactcgtcatttaacattaggtatatctcctaatgctatccctccctcctccccccacccaacaacaggccccggtgtgtgatgttccccttcctgtgtccatgtgttctcattgttcractcccacctgtgagtgagagcatgtggtgtttggttttttgtccttgggatagtttgctgagaatgatggtttccagcttcatccatatccctacaaaggacatgaactcatcattttttatggctgcatagtattccatggtgtatatgtgccacattttcttaatccagtctatcattgttggacatttgggtcggttccaagtctttgctactgtgaatagtgccgcaataaacatacgtgtgcatgtgtctttatagcagcatgatttataatcctttgggtatatactcagtaa

SEQ ID NO: 167600 - DNA, 601 bp, Human
gtgctgagatcgcgccactgcactccagcctaggtgggagagagagactccatctcaaaaaaaaaaaaaattccttctagttttaatttttgtgtgcctcaggaccatttaagtaaattgcaattattcactctttgaaagttagaaagatttatctttgaaactatgttatactgataggtttcttaaataggattgttccttggaaactttaaaattctactatgataatttatctgtttaaattatcttttttttatactttaagttttagggtacatgtgcacaatgtgcatgttakttacatatgtatacatgtgccatgttggtgtgctgcacccattaactcgtcatttaacattaggtatatctcctaatgctatccctccctcctccccccacccaacaacaggccccggtgtgtgatgttccccttcctgtgtccatgtgttctcattgttcgactcccacctgtgagtgagagcatgtggtgtttggttttttgtccttgggatagtttgctgagaatgatggtttccagcttcatccatatccctacaaaggacatgaactcatcattttttatggctgcatagtattc

SEQ ID NO: 167601 - DNA, 601 bp, Human
agttatttccaggctgacatatacaagagcagacatgaaatgcccctgtatcacttctcttgctattggcaccaaacagcctatgtgattcagacagtgcaggtacaaaatggtgaagcctctatgagcctggatctgttgccaattcatgttggacatgtaacttgagttaaaataagctattatgtgttgagtcactcaatttttagggttgtttcaaactgtcttcttctcactaaaacacactaccagaacaattctaaattaccattttttcaagccttactggaaactattttgrtgctcttcattaaatgcaaatctaacttttggcttgagatacataattgttattatattaagaaaaaggtctggccaggcacggtggctcacatctgtaatcccagcactttgggaggccgaggcaggtgtatcacgaggtcaggagatcaagatcatcctggctaacacgatgaaaccccatctctactaaaaatacaaaaacttagctgtgcatggtggcatgtgtctgtagtcccagctactcgggaggccgaggcaggagaatcgcttgaacccaggaggcgaatgttgcagtgtg

SEQ ID NO: 167602 - DNA, 601 bp, Human
gcaatagataactgagatgggcttattccatcatgtttaggaatgttcttttttatcactaagtgataatccagttatctctagtaatgtttgttttaaaatttatttttcttattaggtcaaacttgtaaatcatgatattcaaatccacatcttttctaattttaatctatctcaactcttgatttcttttatagcataacttttgcatgctttaattttatctcgttctttgcaatttttatagttgtatgttttatttctcttgaaataaagacatttactgctcacagaatacccrtatgctccacattgttcagctctcatatagtagaggaccatgtgactagatgtgtcctatagtctgtgagaggaagtagtatgagttatttccaggctgacatatacaagagcagacatgaaatgcccctgtatcacttctcttgctattggcaccaaacagcctatgtgattcagacagtgcaggtacaaaatggtgaagcctctatgagcctggatctgttgccaattcatgttggacatgtaacttgagttaaaataagctattatgtgttgagtcactcaatttttagggttgttt

SEQ ID NO: 167603 - DNA, 601 bp, Human
tcgccattattaaatatctctctttatctctgtttcttgcctgaaagccacactgggagagtctcatctacatttggacttgattcagttgattggatgctatacttaaaaacccgaatctgatgctgtgtttgctgtaatgttactaatgacgttcagctaatctgagtatctcgttgagcatggtccatttattgaaccattgttgttttaagtcacaaggttttggctttttttttttaatgcagcaatagataactgagatgggcttattccatcatgtttaggaatgttcttttttatcactaagtgataatccagttatctctagtaatgtttgttttaaaatttatttttcttattaggtcaaacttgtaaatcatgatattcaaatccacatcttttctaattttaatctatctcaactcttgatttcttttatagcataacttttgcatgctttaattttatctcgttctttgcaatttttatagttgtatgttttatttctcttgaaataaagacatttactgctcacagaatacccgtatgctccacattgttcagctctcatatagtagaggaccatgtgactagatgt

SEQ ID NO: 167604 - DNA, 601 bp, Human
ttattttatgaagcgcttacacatttagaattgttacctcttcctgataatttgacacactcgccattattaaatatctctctttatctctgtttcttgcctgaaagccacactgggagagtctcatctacatttggacttgattcagttgattggatgctatacttaaaaacccgaatctgatgctgtgtttgctgtaatgttactaatgacgttcagctaatctgagtatctcgttgagcatggtccatttattgaaccattgttgttttaagtcacaaggttttggctttttttttttaatgcagcaatagataactgagatgggcttattccatcatgtttaggaatgttcttttttatcactaagtgataatccagttatctctagtaatgtttgttttaaaatttatttttcttattaggtcaaacttgtaaatcatgatattcaaatccacatcttttctaattttaatctatctcaactcttgatttcttttatagcataacttttgcatgctttaattttatctcgttctttgcaatttttatagttgtatgttttatttctcttgaaataaagacatttactgctcacaga

SEQ ID NO: 167605 - DNA, 601 bp, Human
tatttttttgagacagagttttgctcttgtcccccaggctggagtgcactggtgcgatcttggctcattgcaacctccacctcccaggttcaagcgattctcctgccttagcgtcccaagtagctgggattataggtgtctgccaccatgcccaggtaatttttgtatttttagtagagatgaggtttcaccatgttggccaggctggtctcaaactcctgacctcaagttatctgcccgccttggcctccaaaagtgctaggattacaagcgtgagccaccatgcccggccttactgacyttttaatatctactaaaattgcggaatttacttattaattttaatagtttatctttaggttattttagatttcatgcaaacacaatcatataatgatagttttattcattatttttaatacttaaacttccttttctctcacttattgcactgactaggaactcaaacatgatactaaagagaagtggtaatatcaggtgtcctgtcttagtctcacagaaaaagctcttaatatttcaatattaaatataatattttctgtaattttttttggtaaatactatgtatcagattaaatac

SEQ ID NO: 167606 - DNA, 601 bp, Human
tttcagtctttcttttcctgttttgtagttattttaaaccctgaatataaaccttttgttggatatatgtattgcaaatgtcttccttcaatctgtggcttgcttctttgctcattgatagtgccttttgatgaacaaccattctaactttgacatagtccagtttatcagtcttctcctttgtggttagagatttttgcatcccttctaagaaagttagtctactccaagatcataaagatactctcccaggttatcttctagaaactttattttttaccatttattttatatttataakagcattgcaattgatttttgtgtacagtttgagtgtttatattcacttttaacttaaatacagataatttatcctgccctatttattgaaagttgattttttccacagtacagtgcaatttcacctttgttataaaacaaaaagccatgtaggtctatttttggaaactcctttcttgtccattagtctattttgtctatcctcatgccaataccacactcttctaattattgtggctttataataactcttattaactgatagtttaagtcataaaatgctgttcttcttcaaaattgt

SEQ ID NO: 167607 - DNA, 601 bp, Human
atgcgcacataattctgttgggtatatatctgggagtggaagtcctggctcataaggtatgcatatattcagtttaggaagtattaccaaattattttccaaagtggttgtgccaattcccaccacacccaccaaccaatgtatgagagttatcattgttctaaaattcttgctgatattggtattgtcatctagtaaaatctggccgttctgctagaattatctcaatgtggttttaatttgtatgtctctggtgaatttgagaatgagcattttttcatagtctaattggtgatgtagmtatcctttttatgtgcaatctctgttcaaatatttcctcatttttctcttaactttcagtctttcttttcctgttttgtagttattttaaaccctgaatataaaccttttgttggatatatgtattgcaaatgtcttccttcaatctgtggcttgcttctttgctcattgatagtgccttttgatgaacaaccattctaactttgacatagtccagtttatcagtcttctcctttgtggttagagatttttgcatcccttctaagaaagttagtctactccaagatcataaagatactct

SEQ ID NO: 167608 - DNA, 601 bp, Human
catcaccttaggtatattatgtcacatctgacccactgcaccctgaggcaagaaaaccatacaggggttacaggggtgaatagagattaagaggagaacttcaaagggaacacagaatctttacctacttttggtgctaaaacaaatagtgctgctatgaacattcttgtatacatttattggggcatatgcgcacataattctgttgggtatatatctgggagtggaagtcctggctcataaggtatgcatatattcagtttaggaagtattaccaaattattttccaaagtggttgtgmcaattcccaccacacccaccaaccaatgtatgagagttatcattgttctaaaattcttgctgatattggtattgtcatctagtaaaatctggccgttctgctagaattatctcaatgtggttttaatttgtatgtctctggtgaatttgagaatgagcattttttcatagtctaattggtgatgtagatatcctttttatgtgcaatctctgttcaaatatttcctcatttttctcttaactttcagtctttcttttcctgttttgtagttattttaaaccctgaatataaaccttttgt

SEQ ID NO: 167609 - DNA, 601 bp, Human
gactgtttaagaatattctgattcatccgtatggtgacaagcaatcattaaagaataaggtaaatctgaacatgccaagaagggaagaccaccttgtttgatgtgaagagaataaaagtgagatatagattggttttgtagtattatcccattgggtaaatataaaaaataggatatatgtgtacatcaactcttttaagtatactttcttcttttcctggaaagtacacacaaaaatattgattatgtttgaggagcaataggtgggaagaacacaatttattttatgtatttctgtacygtttgattttttaaaaaattaccaggtgaatgtatagctcttatgattttctaaaagtcaagtttccatcctggtatactggtcaacagaggttcctaagacattagctgccacgaggagtgccagtttctttctttcaaatattttctcaccctttctctctgggcccataccttggtcttcctaagggggcatttaattttatatctacaaatgcacatcaccttaggtatattatgtcacatctgacccactgcaccctgaggcaagaaaaccatacaggggttacaggggtgaata

SEQ ID NO: 167610 - DNA, 601 bp, Human
tatgctggggaccaggatctggccttgtcatacaaggaataaatacatctcctctgcagagaggagagtgggctcttctatgagtaagacaatatgaacaaacaaacatgaaacattctctggactttaagaagtactttttaaagaaaaaaataaatgaaattttaattgttgtggttattgtggtttcctactctgtaagattgaaaattccttccagctgtggccattttcttcagcctcaagagaaagccctgagctacagagtaaagttcaaaaatacagtctcctaatgtaggaragagtctctcagcaggggctgagccccaagaaaggaccaggcctgcggtggagagagaagctgtcccgatcccacccagggcccatggtgagcccttttactcacccaggaccagtaatatcacccacagcagcatgaagacctggaccaccaagggctgagatcaaaagagaagtttcctcaattccaaaacaggtttggacttgatcttacagtcaggacactgcacaccagctccaaggagcacatctgagaagctgtgctctcaaaaagagcagaatgcattagtgaattgaaaaa

SEQ ID NO: 167611 - DNA, 601 bp, Human
tcaccattcacctgaatattttggcttccttcatctttgcattgttttaaatgaagctaatatttttgtgagtggtttctatatggtctgcatttacgtaggttatttcatataaccatgtcaataatcctgtgaggtaagcactaggattaactgcattttgtagaccaggaatctggtagccagtaggtggcaagatgaagtttgaacctagatcctgtttgaccccagagcccatgttataaactttgccctctcatgctcaggacctggccattacccacattgtgtggggccacaytgagatgtattcctacttcaggaattatagtccatgcaccttccaactgtgaggtcctcttttcttatatcacgcctgctccatttctgctcctctagctcctactcacctctaagtttcatgaagtctttactagctattttgaatacagtttattatctgcctacagcattcattggtaactttgcctggacaattatttaactgggagcttgttgcatagctgcttgaaagtacattggccttgctgggagcccttctatgtcatgactttccagaacatagacgtagtgtctccta

SEQ ID NO: 167612 - DNA, 601 bp, Human
tttttgtcagagtatttatccaaattatcttcattatctgcttgtttattttcccttctctataatgcaagctctatgagacctaggactttccttatgttcaccatatatcctccaggacctataacggtgaatggcatataaaagatattcctttaatattcactaaatatatttgtgttgtataatgaattaattaaagaactaggttaataatataggaatagaaggatagagatttgagaaatgggtaatgaagagagagaggacacaaaactggcaggtttatcaattgagtagrtattctgcatatgggttgatttatttattcaacagatttttggaatgccaatcatactccagagcaaggcaatagaaatccaggagtgtgtgagagacaaatcatccctgtccacatgaggctattggagacttatccaaacttaagtgttttactgagaacaacaaattattcaccattcacctgaatattttggcttccttcatctttgcattgttttaaatgaagctaatatttttgtgagtggtttctatatggtctgcatttacgtaggttatttcatataaccatgtcaataat

SEQ ID NO: 167613 - DNA, 601 bp, Human
tgctcagcccaagagatggtaatgtgtaatttttgtcagagtatttatccaaattatcttcattatctgcttgtttattttcccttctctataatgcaagctctatgagacctaggactttccttatgttcaccatatatcctccaggacctataacggtgaatggcatataaaagatattcctttaatattcactaaatatatttgtgttgtataatgaattaattaaagaactaggttaataatataggaatagaaggatagagatttgagaaatgggtaatgaagagagagaggacasaaaactggcaggtttatcaattgagtaggtattctgcatatgggttgatttatttattcaacagatttttggaatgccaatcatactccagagcaaggcaatagaaatccaggagtgtgtgagagacaaatcatccctgtccacatgaggctattggagacttatccaaacttaagtgttttactgagaacaacaaattattcaccattcacctgaatattttggcttccttcatctttgcattgttttaaatgaagctaatatttttgtgagtggtttctatatggtctgcatttacgt

SEQ ID NO: 167614 - DNA, 601 bp, Human
gtgtgtgtagagtgtgtgtttgtgtgtacatgtgttgaacaggatgggtggatccttgaaggtacctgaaggagatgatacttcacaaaactgtgagtgagaacatgagtctgcaggtggatgttagcatttgtgtgtggtaagaggcgatttctacctttcaaggtagaaagggcacagaagtggagaaatgacattggtgctcaggaactgggagtgttgggggaaataagaccagagaagcatgcagggcctgagtaagtggttctaattttattataaaagtgataaggagtcatgraatggtttcaaggaggagattgacaaggttagaatttcagactttgatggagcactctgtcagtggacagaatttaatgggacaatatgaagcagggagactgattagaaggcagggcaaggaaatggacatgaattaagcctcccttgggcaccagactccaggctatactcttttcatgagatcattgaatccaagggctcattatcatcatgcctaatttttaaacaatcaactgatgctcagattatttagacctgatgctcagcccaagagatggtaatgtgtaatttttgtcag

SEQ ID NO: 167615 - DNA, 601 bp, Human
tggggtttctcttagtatttctttcccaaggtaccgatggtaccattttgttttctgtggtgagtagaagcgaaatcccttgcaagtgagggtcactctctctccttggaagactgtggtccatggaggctggaggaaaataatgggcctgggtgtccttgctgaagaggaaagagaaaaggagtctgaggtggaggcgcctgcagacccagcctcagggcctcctgctgcatagcctgaaggacctgggtttggaggatctgaaagaggtcctctgggagggtcactgatagctcaaagytccctgtcagccagtggccctcacctcacccaagggagaaattgcccaggggatggcaatgagcaaaatgatttcaggagggtgacaccagcaggattcgccatcaaatatcacagttaggtagccttacatggaagtgggtcccagagaaaatcaatgctgcgctgccatttcatcatgttcatacactcataagaaactccaaaggttatgttaaaatcacaattttgcactttccctaagagaataaatcatattatcttaagatttgtccctgagaaaaccttgagagctcaactt

SEQ ID NO: 167616 - DNA, 601 bp, Human
tttggagaaaagcacacttcaagcagcagcacatccaaaagcaggcaaagaaaggaatgccattgatccctagcttccttcagcccaaaacactactatacttcctctgctccttgcaggaatgtgtcctgtggtttagtggtattccagtccacccttttcctcctgttctatctctatgaccccaaggaatctccttttgaccaactcacttcacaaaataatgaaggctttaccttggacttggattttgactgtattggaagaaacagggcaacaactttccttatatccagtacarcgatatgcaccattgtccttgagacatgcatgaggaatatggaagtcagttcttttattaaggaatgccaggacattatcattcttgtaaatagtattattcagtgttacttccgcctttgcccggcacctcagaaccacagagtctccttcaaacacagaaagtggagcttgcaggatcagcgaagctatgagaaacacaatagagttatttggttcatcctactgtttcccctttcttttcattgtttttccaagtagattttattttaaaaaaatgggttgggaaaaagaactctta

SEQ ID NO: 167617 - DNA, 601 bp, Human
aagagaaccctgcgagagaaaagaaagaattgtatttaatggcattgaaagaaaaaaaattagacctttcttttcttggattttcctgggtctaagctcttctaagatgttcacaagagtagaggtctctttgcttgcacaactcccattctcacaggtacgagttttttctacagagactggtgacccacgctgatatgcagccctgtcccacttttccagccctctctgcagcaaatctcaggttccaccaacacttactctgcacctgtatccaggatctcgggctgtcagatatgaygctgtgaggcattgttgctgccttacaccagtagaaccctgaatctttactccacatggcagtaatctggaaattcggggagagactccagcctaatcccagggtctggtcatctctgaagaagcggaaccggagcgggacatctgacctctctagagagagctgggtctcacaggtcagggtcactgggttcccgctgatgggctggaaggagctggctctcagcactggacgtgtaaatggctctagagagaagaatcacaacagtcccagagcaatgaggctggaactgctttggag

SEQ ID NO: 167618 - DNA, 601 bp, Human
agctttgaaggaaggatggtgctgtatactagtaagggaggtgatgtaatctggggtgcatatttgtactcataactagggaatggtaaacctccagagtcacatatttggagtaactataatgttgcaacctgtctttgtatcctacagaaattttcactttggttattgtcaataagtaatgttaattgggacaacagatacctctgtaccccagagtcagagagctatgccacagcccatggcttatccctatgggcctagaagaaaaaaaaatgatgtcagggaagagaaccctgcragagaaaagaaagaattgtatttaatggcattgaaagaaaaaaaattagacctttcttttcttggattttcctgggtctaagctcttctaagatgttcacaagagtagaggtctctttgcttgcacaactcccattctcacaggtacgagttttttctacagagactggtgacccacgctgatatgcagccctgtcccacttttccagccctctctgcagcaaatctcaggttccaccaacacttactctgcacctgtatccaggatctcgggctgtcagatatgacgctgtgaggcatt

SEQ ID NO: 167619 - DNA, 601 bp, Human
ccctcatcactgtaactaccataatagctttgaaggaaggatggtgctgtatactagtaagggaggtgatgtaatctggggtgcatatttgtactcataactagggaatggtaaacctccagagtcacatatttggagtaactataatgttgcaacctgtctttgtatcctacagaaattttcactttggttattgtcaataagtaatgttaattgggacaacagatacctctgtaccccagagtcagagagctatgccacagcccatggcttatccctatgggcctagaagaaaaaaaaatgatgtcagggaagagaaccctgcgagagaaaagaaagaattgtatttaatggcattgaaagaaaaaaaattagacctttcttttcttggattttcctgggtctaagctcttctaagatgttcacaagagtagaggtctctttgcttgcacaactcccattctcacaggtacgagttttttctacagagactggtgacccacgctgatatgcagccctgtcccacttttccagccctctctgcagcaaatctcaggttccaccaacacttactctgcacctgtatccaggatctcgggct

SEQ ID NO: 167620 - DNA, 601 bp, Human
taagtgagcccggagtttgccatgagtggagggatgacacagggctctacagaagctgtttttccctcatcactgtaactaccataatagctttgaaggaaggatggtgctgtatactagtaagggaggtgatgtaatctggggtgcatatttgtactcataactagggaatggtaaacctccagagtcacatatttggagtaactataatgttgcaacctgtctttgtatcctacagaaattttcactttggttattgtcaataagtaatgttaattgggacaacagatacctctgtacmccagagtcagagagctatgccacagcccatggcttatccctatgggcctagaagaaaaaaaaatgatgtcagggaagagaaccctgcgagagaaaagaaagaattgtatttaatggcattgaaagaaaaaaaattagacctttcttttcttggattttcctgggtctaagctcttctaagatgttcacaagagtagaggtctctttgcttgcacaactcccattctcacaggtacgagttttttctacagagactggtgacccacgctgatatgcagccctgtcccacttttccagccct

SEQ ID NO: 167621 - DNA, 601 bp, Human
cccagactgaccttctttatttacaggtgagaaaactgagtcaaggagagactaggagacctgcctgtgtaggctgttttcagggccagccagggccagagttggtgtcctgactcctagtctggtgatgatcaccttgcctccttataagtgagcccggagtttgccatgagtggagggatgacacagggctctacagaagctgtttttccctcatcactgtaactaccataatagctttgaaggaaggatggtgctgtatactagtaagggaggtgatgtaatctggggtgcatatttrtactcataactagggaatggtaaacctccagagtcacatatttggagtaactataatgttgcaacctgtctttgtatcctacagaaattttcactttggttattgtcaataagtaatgttaattgggacaacagatacctctgtaccccagagtcagagagctatgccacagcccatggcttatccctatgggcctagaagaaaaaaaaatgatgtcagggaagagaaccctgcgagagaaaagaaagaattgtatttaatggcattgaaagaaaaaaaattagacctttcttttcttgg

SEQ ID NO: 167622 - DNA, 601 bp, Human
ttgaataggactttaaacatctctgagcatgtttgatcatgatgtcactgtctccactttctttgggccactgaatgtcagggacactgttctctttctacgtcatttgatgtctcccgctgggttccctggtcctctcctttataatctcacacatccatgtgggagggactggattcttgcttgtcttccaagctggtattattgttttacaggaaaggaaactgatgccgcttccaggaccaaccaagactggactctctgtcaccagtatagacccaaatcacactgtctccttcarcattggacctggcattcagccatgcatggatggttcgaaactgagatccaaagctcaaaggaaacctttttgatgtcataactatttggcagctacctgaatagctctgagggcattaagccaagcaagtagaggtgaagctatctcctggcctgcccccagcccaccattgcccgtgcctttcttacctactgcccatcaactctaaaaaaggcttgagcaagaaggacatgctgggttaactatgatccagcgacttgtctttgtgtcttacatgtctttgcctttggtttattgatt

SEQ ID NO: 167623 - DNA, 601 bp, Human
accaggtgcttctatcctcaggttgatgtttaatctcttacttgactgcatttgctattagcccctacgaactgtgtggggaaggccaggttagtgtagtcgtagatgcatctttagatgtcagtacagtctggtccatggaatatatgcaatcagcatttattaggtgaagaagtgagtcattgaataggactttaaacatctctgagcatgtttgatcatgatgtcactgtctccactttctttgggccactgaatgtcagggacactgttctctttctacgtcatttgatgtctcccsctgggttccctggtcctctcctttataatctcacacatccatgtgggagggactggattcttgcttgtcttccaagctggtattattgttttacaggaaaggaaactgatgccgcttccaggaccaaccaagactggactctctgtcaccagtatagacccaaatcacactgtctccttcaacattggacctggcattcagccatgcatggatggttcgaaactgagatccaaagctcaaaggaaacctttttgatgtcataactatttggcagctacctgaatagctctgagggcatta

SEQ ID NO: 167624 - DNA, 601 bp, Human
gattggcatgcctttccatctgctcctgcagccaccaggtgcttctatcctcaggttgatgtttaatctcttacttgactgcatttgctattagcccctacgaactgtgtggggaaggccaggttagtgtagtcgtagatgcatctttagatgtcagtacagtctggtccatggaatatatgcaatcagcatttattaggtgaagaagtgagtcattgaataggactttaaacatctctgagcatgtttgatcatgatgtcactgtctccactttctttgggccactgaatgtcagggacwctgttctctttctacgtcatttgatgtctcccgctgggttccctggtcctctcctttataatctcacacatccatgtgggagggactggattcttgcttgtcttccaagctggtattattgttttacaggaaaggaaactgatgccgcttccaggaccaaccaagactggactctctgtcaccagtatagacccaaatcacactgtctccttcaacattggacctggcattcagccatgcatggatggttcgaaactgagatccaaagctcaaaggaaacctttttgatgtcataactat

SEQ ID NO: 167625 - DNA, 601 bp, Human
gttcagtctgtgctgcagtcgtcaagaaccgactgcccctccagttcctggaacatgccttccctccctcaccacaatcctcttctcctgaaatgttcccactcatcctcaggtctcaactcacacatgagttcttccaagaaattttttctcacttcccaactcagattggcatgcctttccatctgctcctgcagccaccaggtgcttctatcctcaggttgatgtttaatctcttacttgactgcatttgctattagcccctacgaactgtgtggggaaggccaggttagtgtagtcktagatgcatctttagatgtcagtacagtctggtccatggaatatatgcaatcagcatttattaggtgaagaagtgagtcattgaataggactttaaacatctctgagcatgtttgatcatgatgtcactgtctccactttctttgggccactgaatgtcagggacactgttctctttctacgtcatttgatgtctcccgctgggttccctggtcctctcctttataatctcacacatccatgtgggagggactggattcttgcttgtcttccaagctggtattattgttttacaggaaag

SEQ ID NO: 167626 - DNA, 601 bp, Human
acatttctgtgctcctgagaactgagtctgagtctatatctactaagaataatttagtaaacaaaaatcaggcatctggcagatctacaggacaagtggagagcacaagaaaagcaattggctgctcagaatttgaggagcagggaaaagaaagctgctacatcattaggcaggggtgggaaggcacccagactgcaatgggatgaggctcaaggggcagacagctggttcagtgagctagagagtggaggaggatattaggttgtttcaagaaagaaacagaggatactagaaggtacaygctgacttctgaagggttgggtaagagaggactcttggccaggggtgggtgattggcaggaacccagggcttaccagtgatggagaggctcaccgccttactgcgctgggggccaaagccattgtcagctgtgcagtagtagttccctgaatgctctgcagtcagagagaagctgatggccactcctcctgcagagttggccgacctacgctccagggcagcatcctcatgatgaaactggtacaggatggggagtgaacctctctgggcttcacagtgaagtgtcaccttggctccctc

SEQ ID NO: 167627 - DNA, 601 bp, Human
tacctactgcccaatcaaccctaaaaaaggcttgagcaagggagacatgttgggttaactgtgatccagcgacttgtctttgtgtcttacatgactttgcatctggttattcattgatgtctgatgttaactggacaggggacatttctgtgctcctgagaactgagtctgagtctatatctactaagaataatttagtaaacaaaaatcaggcatctggcagatctacaggacaagtggagagcacaagaaaagcaattggctgctcagaatttgaggagcagggaaaagaaagctgctrcatcattaggcaggggtgggaaggcacccagactgcaatgggatgaggctcaaggggcagacagctggttcagtgagctagagagtggaggaggatattaggttgtttcaagaaagaaacagaggatactagaaggtacatgctgacttctgaagggttgggtaagagaggactcttggccaggggtgggtgattggcaggaacccagggcttaccagtgatggagaggctcaccgccttactgcgctgggggccaaagccattgtcagctgtgcagtagtagttccctgaatgctctgc

SEQ ID NO: 167628 - DNA, 601 bp, Human
gtgaagaggcagcagtcaaacccaggtattctggttctagtctgtgttcttctgccaaagggtactttgtggctaaattcactggatgtgactcagttttttttttttttttttttttttttgagatggagtctcactgtgtcacccagcctggaattcagtggcatgatctcagctcactgcaaactttgcctcccgaattcaagcaattctcctgcatcagcctcctgagtagctggcgttacaggcgaccgccaccacacctggctaatttttgtatttttagtagacacaggatttyactatgttggccaggctggtctcaaactcctgacctcaggtgatccacctgcctcagcctcccaaagtgctggaattacaggcatgagccacctctcctggccatgactcagtttttatctttcatcatctcttagctttgccttatccaaactggctcactatcatctgcttagaacatgttctacccttggtgacagtggggcacactctcacagtgagtgccttttcccttggccagagtccttccttctcatgtcccatttcctctactgggactagactgggggttctgtccaac

SEQ ID NO: 167629 - DNA, 601 bp, Human
acatctgcctctgtcctagacataaagtccttacctcttttggcttcttccaaactacattttggtgtgtttaactatctccatataagaaaaactatcagacaattcaaaaacaactttatttgtatttgaagttcctcacagttggttcctccacttttctgtggacagacttctggaagaagtgacctacatttatcatctctacttctttatctcatatctcatatgcatattctgtccattacaactcagtttttacccccaataatctactaaagctgatttttcatgtttatgwatgtagtaatgatgataatgataaatataaaaaagatatttgttataatgagattatagtgcctttaagttctggtgtgtgtatatttgtcagatgtaatttgtgaatatctatatgtataaagacactaagttaatcatcaaaacaattcaatgaggtaggtattattgttgtccctatgtcacagatgaaaatactgaggccccgagtggttgagtcacacagctagtaagtgaagaggcagcagtcaaacccaggtattctggttctagtctgtgttcttctgccaaagggtacttt

SEQ ID NO: 167630 - DNA, 601 bp, Human
tatctgttcatctttccaggagaccaatactctcttcttctctcatggctcctcttgtagtgtgacctgcctcctttttgcagaggagatgatgctttcaaggaaaaaattccttgtcttgccaccaccagactcacttgcaccgctcctcacttcttcctgcaaccatgcaggcttccctgcaaccatggaagagccatgcctggcctgcccaagggggattttcctatgtctcttgaccttgtgcacatctgcctctgtcctagacataaagtccttacctcttttggcttcttccaawctacattttggtgtgtttaactatctccatataagaaaaactatcagacaattcaaaaacaactttatttgtatttgaagttcctcacagttggttcctccacttttctgtggacagacttctggaagaagtgacctacatttatcatctctacttctttatctcatatctcatatgcatattctgtccattacaactcagtttttacccccaataatctactaaagctgatttttcatgtttatgaatgtagtaatgatgataatgataaatataaaaaagatatttgttataatgaga

SEQ ID NO: 167631 - DNA, 601 bp, Human
cagtacaggatctctagacttcacctacctggagggcagccaagcaacttctcaggtttctgtgaccagccctccatgctggtctttccctatctgttcatctttccaggagaccaatactctcttcttctctcatggctcctcttgtagtgtgacctgcctcctttttgcagaggagatgatgctttcaaggaaaaaattccttgtcttgccaccaccagactcacttgcaccgctcctcacttcttcctgcaaccatgcaggcttccctgcaaccatggaagagccatgcctggcctgyccaagggggattttcctatgtctcttgaccttgtgcacatctgcctctgtcctagacataaagtccttacctcttttggcttcttccaaactacattttggtgtgtttaactatctccatataagaaaaactatcagacaattcaaaaacaactttatttgtatttgaagttcctcacagttggttcctccacttttctgtggacagacttctggaagaagtgacctacatttatcatctctacttctttatctcatatctcatatgcatattctgtccattacaactcagtttttaccc

SEQ ID NO: 167632 - DNA, 601 bp, Human
atgggatcacaataacatactggtctacaacctgctttttccccttagctatatattatgggcatctttctgtggtattacttaaaaatttacatcactaacttttaaaactcatctttattaaagcataatttacacacaataaagtataacttttacatttacaacttgataattttggaaatatattacctgattttattttattttattttgagtcagagtttcactcttgttgcccaggctggagtgcaatggcgcgatcttggctcagcacaacctccgccatccgggttgaagygattctcctgcctcagcctcctgaatagctgggattacaggcatgcacgaccatacccggctaattttgtattttcagtagagacagggtttctccatcaggctggtcttgaactcccaacctcaggtgatctgcccgcctcggcctcccaaagtgctgggattacaggcgagagccaccatgccccacttacctgattattcttaacaatgacaaagtattccattgtatagatatgctataatacatttaagcattttcccattaatggatgtttgggatgttgttgtttcttaaatg

SEQ ID NO: 167633 - DNA, 601 bp, Human
gtgtgtgtacactatggaatactactcagccataaaaaggaacaaaataatggcattcacagcaacctagatggagttggagaccattattctaagtaactcaggaatggaaaaccaaacattgtatgttctcacttatcagtgggagctaagctatgaggacgcaaaggcctaagcataatataatagattctggggattcagtggaagagtgagagtggggtgatggataaagtactacacactgggttcagtgtacactgctctggcaacgagtgcaccaaaatctcggaaattactrctaaagaagttactcatgtaaccaaacaccacctggtccccaaaactactgaaatttttttaaaaatgaaaaacccagctattcatttaataaaatcaaactttacagaattatctaagtaaaaataaaaagttttaccattttctttattttttcagaaattacttctgttgagtatttggtgacactttctagatcttttctatgtataagtacactcatagacacataaataaatacattaaaatcacacacgtgcatgggatcacaataacatactggtctacaacctgctttttc

SEQ ID NO: 167634 - DNA, 601 bp, Human
tgtggtgtaaagggaacagttttacactgctggtgggaatgtaaactattacaaccactatgaaaacagtatggagattccttaaagaactaaaagtagaactaccatttcatccagcaatcccactactgggtatctacccagaggaaaagaagtcattatatgaaaaagacacttgcacaaacgtgtttatagcagcacaactcatgattgcaaaactatggaaccagcccaaatgcccatcaattaaggggtggataaagaaaatgtgatacatacgcacgtgtgtgtgtgtgtgtggacactatggaatactactcagccataaaaaggaacaaaataatggcattcacagcaacctagatggagttggagaccattattctaagtaactcaggaatggaaaaccaaacattgtatgttctcacttatcagtgggagctaagctatgaggacgcaaaggcctaagcataatataatagattctggggattcagtggaagagtgagagtggggtgatggataaagtactacacactgggttcagtgtacactgctctggcaacgagtgcaccaaaatctcggaaattactgctaaaga

SEQ ID NO: 167635 - DNA, 601 bp, Human
aatagatgttggcatgaatgtggtgtaaagggaacagttttacactgctggtgggaatgtaaactattacaaccactatgaaaacagtatggagattccttaaagaactaaaagtagaactaccatttcatccagcaatcccactactgggtatctacccagaggaaaagaagtcattatatgaaaaagacacttgcacaaacgtgtttatagcagcacaactcatgattgcaaaactatggaaccagcccaaatgcccatcaattaaggggtggataaagaaaatgtgatacatacgcaygtgtgtgtgtgtgtgtgtacactatggaatactactcagccataaaaaggaacaaaataatggcattcacagcaacctagatggagttggagaccattattctaagtaactcaggaatggaaaaccaaacattgtatgttctcacttatcagtgggagctaagctatgaggacgcaaaggcctaagcataatataatagattctggggattcagtggaagagtgagagtggggtgatggataaagtactacacactgggttcagtgtacactgctctggcaacgagtgcaccaaaatctc

SEQ ID NO: 167636 - DNA, 601 bp, Human
acatccaaattggtaaagaggaagaagtcaaattgttgctgttcactgatgacatgattgtatacctaggaaaccctaaagactcatccaaaaagctcctagatctgataaatgagttcagtaaagtttcaggatacaaaatcaatgtacacaaatcagtaacactgctatacaccaatagtgaccaagctgagaatcaaataaaaaattcaaacttgtttatgacacctacaaaaataaaatacttagaaatacaccttcacaagtaagtgaaagatatctataagaaaaactacaaaamactggtgtaagaaatcgcagatgacacaatcaaatggaaacacatcccattctcatggatgggtagaatcaatattgtgaaaatggccatctaccaaaagcaatctataacttcaatgcaattcccatcaaaataccaccataattcttcacagaactagaaaaaacaatcctaatattcatatggaacaaaaaaaagagcctacatagccaaagcaagactaagcaaaaagaacaaatctggaggcatcacattacctgactttgaacgatactacaaggctatagttaccagaacagc

SEQ ID NO: 167637 - DNA, 601 bp, Human
agaacaatcagacaagagaaagaaataaaggacatccaaattggtaaagaggaagaagtcaaattgttgctgttcactgatgacatgattgtatacctaggaaaccctaaagactcatccaaaaagctcctagatctgataaatgagttcagtaaagtttcaggatacaaaatcaatgtacacaaatcagtaacactgctatacaccaatagtgaccaagctgagaatcaaataaaaaattcaaacttgtttatgacacctacaaaaataaaatacttagaaatacaccttcacaagtaartgaaagatatctataagaaaaactacaaaacactggtgtaagaaatcgcagatgacacaatcaaatggaaacacatcccattctcatggatgggtagaatcaatattgtgaaaatggccatctaccaaaagcaatctataacttcaatgcaattcccatcaaaataccaccataattcttcacagaactagaaaaaacaatcctaatattcatatggaacaaaaaaaagagcctacatagccaaagcaagactaagcaaaaagaacaaatctggaggcatcacattacctgactttgaac

SEQ ID NO: 167638 - DNA, 601 bp, Human
gatgcatggaagatcttgatgttgctgaatggaacaggagcaggtaaggaggcagaagaattatgtcttctaacaagggtcttgggtgggaacccaacccactctgggacaggggcaggagaggctagagagaaatgtgtgagccaataagagaattgtgttggcctttttattgattggcagacagagaaaaccacaactaaatctcttccaaggtgaagcacacagaactttataactttctttcttactatcactgttggccagaatatagtttgtattttgaaagcctttactcctrtgttaggggaattttggtcgtgatggctggactgctgctagcaggaaaagtacagcaagggaagggaaggtgcaagttcctgaacgtgtaggatacaaaactcagagatggaggctgtgtaggcaccaagcctgacaggatgtcacacagcaaatgactctagaaactgtacctctgatcttggctactggtaaagttaggggagatggtctttttatttttgtgctgctggttaggtcaacttacctataacactgagtgatattgtgtcactgtgctgggccactaggccattgttgg

SEQ ID NO: 167639 - DNA, 601 bp, Human
acagatgagttattgggtggatacagagctagacactcaatttggtggtgggagtggagggggttattgtctagtggagtagggaattagtgggaggtattaatgacctgggagttctgttgaggtctgagaacaatagtgacaggaggagctgacgcaagcagaaggccagggggtggttgtcagataataagggcttaaaattgtccttttggagatgaagtagtgtatgtatgtgggagtggctgactggtgtggagaggacaggccatggtgttaaggggattatacatgtgaccaygagagtcatgaaatgatggcagattatggagtatggagaaagactgaaagtacagtgccaaagccttcactgagagtgggcataactaggagtctgcctgtgacaaggatgcatggaagatcttgatgttgctgaatggaacaggagcaggtaaggaggcagaagaattatgtcttctaacaagggtcttgggtgggaacccaacccactctgggacaggggcaggagaggctagagagaaatgtgtgagccaataagagaattgtgttggcctttttattgattggcagacagagaaaa

SEQ ID NO: 167640 - DNA, 601 bp, Human
tgtggtggaatggaagtggaattgagggatagatgagtggcactgcagtagtcaaaatgatggtggacttgtctagatagaggtggtagagatagagacccaagaaatatttaggaagtcaaatcaacaggacttaatgattaactggctgtgaggggtgaggaagagaaatgttgaggaagactcctctgttcctgctttgtgtatctgttgagaagagatgtgtttcacagaggtaggaacccttgaaagaggaagggaatgtcagcagttcagttttagaaatgctcagattgatgtrcttttgagatatttgagtgaaggtatgtcatgtgcagatgctcaagtgggaggtcccttttagagatagaagtttaggaatcattatttatagatgacaaggccatttatacatgacatacccaggatcatccagacaaaggatttagataagagaagagggcataagtcaaagttctggaacatgccagtgcttaaaggttttctataaaaggaggagccagtaaagaagactgagaagaagtggccagggagagaagagagccagaagaagatagattcactgaagggagggtttcaa

SEQ ID NO: 167641 - DNA, 601 bp, Human
ccccaccacagcctgggccctgggagccctgaaggtgaggatgggacgagatactggaactgagggaggaaaaacgttatgtatcagctgcttctgctaaaatatattccttcatgctaaagacatttcaaatggaagaatgtttttctcagtttttaatgcccttgtgacattactcaaaactcagcaatattttcagatctccagaaagaacaacatttgtgtagtgctataaacagcttggaatagtggaatatacaaactcaaatgtgtttgaagaatgtgaaaacaaagattaaamtgaaactcaggtgtcttagaggtaaaaagacagttggagagaggagaaatcagttcaacagaaaatgaagaacaggagagacttgctgcttacatcaccagggatgtaattgcatctgggctgcatcagaaatagggcccacaagagaatgagtattgtcaagttatttgctcatttttacattcatttatccatcaaaaattaattgaacaaaaattttttaaaaattgagcaaaaataaaaattaattgagcatttaataagtcccaagaatggcatgacatgctagggaatcagtga

SEQ ID NO: 167642 - DNA, 601 bp, Human
ggaaatgtaaggaacatttacatccccagtaatgaaagagactcaagagtagaggcttcttagaagtcaatgagagaagaatccggacaagaaacagcttaatcctttctacggcagagaaacatatgctcagaattctttggtttcattttcatgtaataatttcagttcagaatatagtttatgttctaaaaaagtcttatttgcatttttagtgaggtgctttgatcatcttcaagaagactgctgggaaacatcagattcctggaaccataccacaaaggatccgagactttcacasggaggttctgcaggcaggaagtgtgctgggatgccacacaagcaaacagccctgaggagctctgtggctccattttcagctgcagggagaacaggcacagtcagttctcagatgtgctgctggtgggcagggcccactcacctgcaactttcagtgtcaccatctcactgcgctgggcctccagaccattgtctgcctcacaggagtagattccagaatgttctgtagtcagagagaggttgaaggaggcccctcctccagagggggctgagatcttacccagggtgacatcttcatgat

SEQ ID NO: 167643 - DNA, 601 bp, Human; identical to SEQ ID NO: 167536

SEQ ID NO: 167644 - DNA, 601 bp, Human; identical to SEQ ID NO: 167537

SEQ ID NO: 167645 - DNA, 601 bp, Human; identical to SEQ ID NO: 167538

SEQ ID NO: 167646 - DNA, 601 bp, Human; identical to SEQ ID NO: 167539

SEQ ID NO: 167647 - DNA, 601 bp, Human; identical to SEQ ID NO: 167540

SEQ ID NO: 167648 - DNA, 601 bp, Human; identical to SEQ ID NO: 167541

SEQ ID NO: 167649 - DNA, 601 bp, Human; identical to SEQ ID NO: 167542

SEQ ID NO: 167650 - DNA, 601 bp, Human; identical to SEQ ID NO: 167543

SEQ ID NO: 167651 - DNA, 601 bp, Human; identical to SEQ ID NO: 167544

SEQ ID NO: 167652 - DNA, 601 bp, Human; identical to SEQ ID NO: 167545

SEQ ID NO: 167653 - DNA, 601 bp, Human; identical to SEQ ID NO: 167546

SEQ ID NO: 167654 - DNA, 601 bp, Human; identical to SEQ ID NO: 167547

SEQ ID NO: 167655 - DNA, 601 bp, Human; identical to SEQ ID NO: 167548

SEQ ID NO: 167656 - DNA, 601 bp, Human; identical to SEQ ID NO: 167549

SEQ ID NO: 167657 - DNA, 601 bp, Human; identical to SEQ ID NO: 167550

SEQ ID NO: 167658 - DNA, 601 bp, Human; identical to SEQ ID NO: 167551

SEQ ID NO: 167659 - DNA, 601 bp, Human; identical to SEQ ID NO: 167552

SEQ ID NO: 167660 - DNA, 601 bp, Human; identical to SEQ ID NO: 167553

SEQ ID NO: 167661 - DNA, 601 bp, Human; identical to SEQ ID NO: 167554

SEQ ID NO: 167662 - DNA, 601 bp, Human; identical to SEQ ID NO: 167555

SEQ ID NO: 167663 - DNA, 601 bp, Human; identical to SEQ ID NO: 167556

SEQ ID NO: 167664 - DNA, 601 bp, Human; identical to SEQ ID NO: 167557

SEQ ID NO: 167665 - DNA, 601 bp, Human; identical to SEQ ID NO: 167558

SEQ ID NO: 167666 - DNA, 601 bp, Human; identical to SEQ ID NO: 167559

SEQ ID NO: 167667 - DNA, 601 bp, Human; identical to SEQ ID NO: 167560

SEQ ID NO: 167668 - DNA, 601 bp, Human; identical to SEQ ID NO: 167561

SEQ ID NO: 167669 - DNA, 601 bp, Human; identical to SEQ ID NO: 167562

SEQ ID NO: 167670 - DNA, 601 bp, Human; identical to SEQ ID NO: 167563

SEQ ID NO: 167671 - DNA, 601 bp, Human; identical to SEQ ID NO: 167564

SEQ ID NO: 167672 - DNA, 601 bp, Human; identical to SEQ ID NO: 167565

SEQ ID NO: 167673 - DNA, 601 bp, Human; identical to SEQ ID NO: 167566

SEQ ID NO: 167674 - DNA, 601 bp, Human; identical to SEQ ID NO: 167567

SEQ ID NO: 167675 - DNA, 601 bp, Human; identical to SEQ ID NO: 167568

SEQ ID NO: 167676 - DNA, 601 bp, Human; identical to SEQ ID NO: 167569

SEQ ID NO: 167677 - DNA, 601 bp, Human; identical to SEQ ID NO: 167570

SEQ ID NO: 167678 - DNA, 601 bp, Human; identical to SEQ ID NO: 167571

SEQ ID NO: 167679 - DNA, 601 bp, Human; identical to SEQ ID NO: 167572

SEQ ID NO: 167680 - DNA, 601 bp, Human; identical to SEQ ID NO: 167573

SEQ ID NO: 167681 - DNA, 601 bp, Human; identical to SEQ ID NO: 167574

SEQ ID NO: 167682 - DNA, 601 bp, Human; identical to SEQ ID NO: 167575

SEQ ID NO: 167683 - DNA, 601 bp, Human; identical to SEQ ID NO: 167576

SEQ ID NO: 167684 - DNA, 601 bp, Human; identical to SEQ ID NO: 167577

SEQ ID NO: 167685 - DNA, 601 bp, Human; identical to SEQ ID NO: 167578

SEQ ID NO: 167686 - DNA, 601 bp, Human; identical to SEQ ID NO: 167579

SEQ ID NO: 167687 - DNA, 601 bp, Human; identical to SEQ ID NO: 167580

SEQ ID NO: 167688 - DNA, 601 bp, Human; identical to SEQ ID NO: 167581

SEQ ID NO: 167689 - DNA, 601 bp, Human; identical to SEQ ID NO: 167582

SEQ ID NO: 167690 - DNA, 601 bp, Human; identical to SEQ ID NO: 167583

SEQ ID NO: 167691 - DNA, 601 bp, Human; identical to SEQ ID NO: 167584

SEQ ID NO: 167692 - DNA, 601 bp, Human; identical to SEQ ID NO: 167585

SEQ ID NO: 167693 - DNA, 601 bp, Human; identical to SEQ ID NO: 167586

SEQ ID NO: 167694 - DNA, 601 bp, Human; identical to SEQ ID NO: 167587

SEQ ID NO: 167695 - DNA, 601 bp, Human; identical to SEQ ID NO: 167588

SEQ ID NO: 167696 - DNA, 601 bp, Human; identical to SEQ ID NO: 167589

SEQ ID NO: 167697 - DNA, 601 bp, Human; identical to SEQ ID NO: 167590

SEQ ID NO: 167698 - DNA, 601 bp, Human; identical to SEQ ID NO: 167591

SEQ ID NO: 167699 - DNA, 601 bp, Human; identical to SEQ ID NO: 167592

SEQ ID NO: 167700 - DNA, 601 bp, Human; identical to SEQ ID NO: 167593

SEQ ID NO: 167701 - DNA, 601 bp, Human; identical to SEQ ID NO: 167594

SEQ ID NO: 167702 - DNA, 601 bp, Human; identical to SEQ ID NO: 167595

SEQ ID NO: 167703 - DNA, 601 bp, Human; identical to SEQ ID NO: 167596

SEQ ID NO: 167704 - DNA, 601 bp, Human; identical to SEQ ID NO: 167597

SEQ ID NO: 167705 - DNA, 601 bp, Human; identical to SEQ ID NO: 167598

SEQ ID NO: 167706 - DNA, 601 bp, Human; identical to SEQ ID NO: 167599

SEQ ID NO: 167707 - DNA, 601 bp, Human; identical to SEQ ID NO: 167600

SEQ ID NO: 167708 - DNA, 601 bp, Human; identical to SEQ ID NO: 167601

SEQ ID NO: 167709 - DNA, 601 bp, Human; identical to SEQ ID NO: 167602

SEQ ID NO: 167710 - DNA, 601 bp, Human; identical to SEQ ID NO: 167603

SEQ ID NO: 167711 - DNA, 601 bp, Human; identical to SEQ ID NO: 167604

SEQ ID NO: 167712 - DNA, 601 bp, Human; identical to SEQ ID NO: 167605

SEQ ID NO: 167713 - DNA, 601 bp, Human; identical to SEQ ID NO: 167606

SEQ ID NO: 167714 - DNA, 601 bp, Human; identical to SEQ ID NO: 167607

SEQ ID NO: 167715 - DNA, 601 bp, Human; identical to SEQ ID NO: 167608

SEQ ID NO: 167716 - DNA, 601 bp, Human; identical to SEQ ID NO: 167609

SEQ ID NO: 167717 - DNA, 601 bp, Human; identical to SEQ ID NO: 167610

SEQ ID NO: 167718 - DNA, 601 bp, Human; identical to SEQ ID NO: 167611

SEQ ID NO: 167719 - DNA, 601 bp, Human; identical to SEQ ID NO: 167612

SEQ ID NO: 167720 - DNA, 601 bp, Human; identical to SEQ ID NO: 167613

SEQ ID NO: 167721 - DNA, 601 bp, Human; identical to SEQ ID NO: 167614

SEQ ID NO: 167722 - DNA, 601 bp, Human; identical to SEQ ID NO: 167615

SEQ ID NO: 167723 - DNA, 601 bp, Human; identical to SEQ ID NO: 167616

SEQ ID NO: 167724 - DNA, 601 bp, Human; identical to SEQ ID NO: 167617

SEQ ID NO: 167725 - DNA, 601 bp, Human; identical to SEQ ID NO: 167618

SEQ ID NO: 167726 - DNA, 601 bp, Human; identical to SEQ ID NO: 167619

SEQ ID NO: 167727 - DNA, 601 bp, Human; identical to SEQ ID NO: 167620

SEQ ID NO: 167728 - DNA, 601 bp, Human; identical to SEQ ID NO: 167621

SEQ ID NO: 167729 - DNA, 601 bp, Human; identical to SEQ ID NO: 167622

SEQ ID NO: 167730 - DNA, 601 bp, Human; identical to SEQ ID NO: 167623

SEQ ID NO: 167731 - DNA, 601 bp, Human; identical to SEQ ID NO: 167624

SEQ ID NO: 167732 - DNA, 601 bp, Human; identical to SEQ ID NO: 167625

SEQ ID NO: 167733 - DNA, 601 bp, Human; identical to SEQ ID NO: 167626

SEQ ID NO: 167734 - DNA, 601 bp, Human; identical to SEQ ID NO: 167627

SEQ ID NO: 167735 - DNA, 601 bp, Human; identical to SEQ ID NO: 167628

SEQ ID NO: 167736 - DNA, 601 bp, Human; identical to SEQ ID NO: 167629

SEQ ID NO: 167737 - DNA, 601 bp, Human; identical to SEQ ID NO: 167630

SEQ ID NO: 167738 - DNA, 601 bp, Human; identical to SEQ ID NO: 167631

SEQ ID NO: 167739 - DNA, 601 bp, Human; identical to SEQ ID NO: 167632

SEQ ID NO: 167740 - DNA, 601 bp, Human; identical to SEQ ID NO: 167633

SEQ ID NO: 167741 - DNA, 601 bp, Human; identical to SEQ ID NO: 167634

SEQ ID NO: 167742 - DNA, 601 bp, Human; identical to SEQ ID NO: 167635

SEQ ID NO: 167743 - DNA, 601 bp, Human; identical to SEQ ID NO: 167636

SEQ ID NO: 167744 - DNA, 601 bp, Human; identical to SEQ ID NO: 167637

SEQ ID NO: 167745 - DNA, 601 bp, Human; identical to SEQ ID NO: 167638

SEQ ID NO: 167746 - DNA, 601 bp, Human; identical to SEQ ID NO: 167639

SEQ ID NO: 167747 - DNA, 601 bp, Human; identical to SEQ ID NO: 167640

SEQ ID NO: 167748 - DNA, 601 bp, Human; identical to SEQ ID NO: 167641

SEQ ID NO: 167749 - DNA, 601 bp, Human; identical to SEQ ID NO: 167642

SEQ ID NO: 167750 - DNA, 601 bp, Human
gggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtaaggggaccatcgagggggtgttattcagcaagggggtcttgtgagggtgtgacagaggccaagggggcatcctgacccccgactttctttaagcgacttagaatcaagggccggctgagttccacgggcacatcatgctstctccctcctggtctcggtcatgccttcagaccctgtgtcaggaggagcaacgggaaggaaggatgtggggcatgcatggggctcactttccttctctcgactctcttggggaaggtgaaccaaaacagagacctctttttgtgggtctgagcatccagcatagctcccctgaggtgggctgggggtttgccctcaattttatgttgggtaagactgatgaatgagaccaatggggtgggagagacagatgaatggagctgagtgtattttaggaagtaaggccacaggttaagtctcag

SEQ ID NO: 167751 - DNA, 601 bp, Human
ggggaaggtgaaccaaaacagagacctctttttgtgggtctgagcatccagcatagctcccctgaggtgggctgggggtttgccctcaattttatgttgggtaagactgatgaatgagaccaatggggtgggagagacagatgaatggagctgagtgtattttaggaagtaaggccacaggttaagtctcaggtgctgcttaattcctaagtacttccttcccaatgcccactccctgagggtcctaaggtgaatctcaaagaccctcagggagtaagcactggaaagggactctaccacyggagaccctcagggaataagcactggaaagggactctaccaccggagaccctcagggaataagcactggaaagggactctaccaccggagaccctcagggaataagcactggaaagggactctaccaccggggcttggtaccttctgagatatcagcctttttttggtggtctgaaaggtagaattgaatctatagctccaatgtgtaggtgattagtattctatatcagaggcagagtcttaaaaaataaagttaaggccgggcgcagtgactcacacctgtaatcccagaactctggg

SEQ ID NO: 167752 - DNA, 601 bp, Human
tcctcagcagatgagcagaccctcagctggagtgcagtcagaggtgactcttgtgcctggcagcatcaagcaagggtgacgtaaccccagcagccatgagtccagccatcactgcttatcacattctgctggaaatgcatctgggtctatttctcccctctatgtctgtacatcctgaggtcggaaagggactctctcaccaacttgtcctccctggcgcagggcctgacacttcctaggttctcaactcattgtttgaataaatacatgagatctggagtttggaaggtcagacagcccrtgcaatgctgtggtcaggccacactattagccttctttggggaagctggtggatctcccagtcttcatgggccattctattctaagagttgtgaggttgcgagtggctcaagttgaggatttgaggtctggggtaaagctaggtcagagacaggccatggttccctacaactagaagtgctctgtttaaatagaaatgagggcttgttggccgggcgcagtggctcatgccagtaatcccaacactttgggaggccgaggcaggcagatcacttgaaatcaggagtttgagaccagcctg

SEQ ID NO: 167753 - DNA, 601 bp, Human
gaagctggtggatctcccagtcttcatgggccattctattctaagagttgtgaggttgcgagtggctcaagttgaggatttgaggtctggggtaaagctaggtcagagacaggccatggttccctacaactagaagtgctctgtttaaatagaaatgagggcttgttggccgggcgcagtggctcatgccagtaatcccaacactttgggaggccgaggcaggcagatcacttgaaatcaggagtttgagaccagcctggccaacatggtgaaaccccatctctgctaaaaatacaaaagytagctgggcgtggtggcagctgcctgtaatcccagctactcgggaggctgaggcaggagaatcgcttgaacccaggaggcggaggttgcagtgagctgagatctcgccactgcactccagcctgggtgacaagagtgaaactccatctcaaaaaaaagaaaaaaaaaaaaaagagatgagggcttgttaaaacctttgcacagaagtggaggggcagtaatcgttcaagaccgtggtcatctcttttcttttgggacatctcgtaatagaacatctgatattggcaaggatgtgaaaact

SEQ ID NO: 167754 - DNA, 601 bp, Human
actttgaaactgttgacccttgaccactggttgggacaggcagtgcaagggctgattctgcagaaaactaaggcaagaagtctgctttcccaacctcttgcctcaccctggcacaggtgacagggtcctagcactttgtccggcctatctttttacagacccccttatcagatccagtggacttctgacactgcttcttcttaccccagttctgtcataatatacttggtcagcagcaggcctgggatgccctttgggggtgttactgacacaagttgtcccggggtcgggatttggactrtgactcacttgaagcccagtggtggatcaaggttgactctatcgacctgagctcctgtgggatttgtcacttctggggtcacatcctgtgggtgactcaactatcctatgctatcttaatggactgacttaagaggctcttggtatttgacttaacatgagatctcctgataaatgctactcagctcaactggccaatgtctggccccacccaggctctctggagtatgtgaaggcaatggctccagaggtgcagtgtctacactgggccccacacaccatctcattcatccttggagac

SEQ ID NO: 167755 - DNA, 601 bp, Human
actgacctcttcctccttcaaaaccatgagctcactgcacacactgaagcattctgtaagagtttctaggactagatagacccataagtacccagatggcaggaactatatcggccaagtgttcatccctcagcacatggcacagtgctgaacacacaggtccacagtttttgtttactttactgaaaataaacgtataggctgggtacagtggctcacacttgtaatcccagcactttgggaggccaaggcaggtagatcacttgaagtcagagttcgagaccagcctggccaacatggkgaaaccccctctactaaaaatacaaaaattagccggatgtgatgatgcatgcttgttgtaatcccagctactcgggaggctgaggcaggagaatcgcttgagccctggaggcggaggttgcagtgagccaagatcgtaccactgcactccagcctgggtgacagagtgagactgtctcaaaaaaaaaaaaaaaaaaagaggccgggtgcggtggctcacacctgtaatcccagcactttgggaggtcgaggtgggtggatcacgaggtcaggagtttgagaccagactggccaatatggt

SEQ ID NO: 167756 - DNA, 601 bp, Human
aggtgcatcccatagagcactggtctcaaaagcatcatggctgcctggggaattggctttatcttctactggaccagaagttctgagcatgctttcctgtgctaaacacactgcctggcacacagtaggtgcttgaatacccaaatggatacattatgagggaacccgccctcacttaggtcggactgcttagcgttgcccttctcatggcatgaagcccctggctgtggcattcctgaggaagactccgccgaccctgtcctgctgtgtgcatagaagcatgttctgttccttgtgggaytgaacactgcaaactttccttcagcagactctcctcgctagttgcctttctctcaaattgtgccaatggtgagtaaaaggtgaaggtggcttggtaacagcagcttcccactgtgtctcaggtgccatgctaggtgcagtggaatccacaggtgaggatggtcactatgtgcatgagtgctcacagcactgggaggcctattgacacacagatccatgagtcccaggaagcctcactgggacccaaacccgaggaaagggcttattctgctccacctcttctatctcttctgagctctgg

SEQ ID NO: 167757 - DNA, 601 bp, Human
ctgtcttacacattgggactgttagatgctgtctagcaattgggcttggaagagagatatgagaggttattatcacttatcttttaaaaaattacgtaagcaatcgaattgaatctttccatggtgtggaaactactacttagctaccacctggtgttttaacagggctccctttggtaatgctgtctccctgctctgtccaccacctctcggcggagatgataagaaggaccttccccactgggtgccatggctcatgcctgtaatcccagaactttaggaggctgaggcaggtggatcrcttcagcccaggagttcaagcccaggctgggcaacttagggagaccccatctctacaaaaaacttaaaaacaaaaaacaaaaaacaaaagccgagtgtggttgtgcacacctgtagtctcagatacttgtaaggctgaggtgggaggatcacttaagcctgggaagttaacactgcagtgagctgagcatgttaggatggggctgcgatagcgccactgcattccagcctgagcaacaaagcgagactctgtcccaaaataaatatataaataaataaaataaggcccttcccatctgcc

SEQ ID NO: 167758 - DNA, 601 bp, Human
gtgggattatatggagctgttcattttattcttttttttttgtaagtgtgcatatttcagattaaacagtacacatcaagtgttaccttcccactgagactacgctacgcctccctaattaaaactcatccaccaggcgcggtggttcatgcctgtaatcccagcactttgggaggcttgaggcaggtggatcacttgagaccaggagctcaagaccagcctggacaacatggcgaaatcctgtctctactaaaaatacaaaaattagccaggcacacacctgtaatcccagctacttggkaggctgaggcatgagaatcgcttgaacccaggaggcagaggttgcagtgagccgagatcacaccactgcattccagcctgggcaacagagcaagactctgtctcagaaaaaaaaacaaaaaacaaaaatctcatccccctgctgtacccccagttctctttccctactcttgttgtttttgttgttccgtagtcctaagtaacctagttattgctcaggcttgttgtcaaactccccaatataatgcaatctcacgagggcagggttttccctgctatatccccagcacctggaacaatg

SEQ ID NO: 167759 - DNA, 601 bp, Human
tcggccttccaaagtgctgggattacaggcataagccactgtgtctggccagaaaactcctatagctctatagtaagtatttaaatttggtaatgattgctggtctgccacctacccaattcctgctatttttcaaaattgtttcactctttgttaagttttatttttttctggatgtactttagaattagcattttagttcctaagaaagccttcattagggttgcattaaatgtatagatacctttaaggtgacaggaaccttgaatatttcaggtatgtctttccatttttctagccktcttaggtacttcagatctaaacttttaaaatataggttttacgcatttattcttatatacactattgtgaatagcatctttttcatgacttctaaatcagttatttgtataaaatataggaaagctattaactctctgcataccaattttagtaactggccacctccaaattatctcagtaattataaaactgaaacatactagttacctcttatttccttagagggtttttagaatttctcctctcagctctttttttaaattttgttttgttttttaattgggagatatgaccacag

SEQ ID NO: 167760 - DNA, 601 bp, Human
cggccttccaaagtgctgggattacaggcataagccactgtgtctggccagaaaactcctatagctctatagtaagtatttaaatttggtaatgattgctggtctgccacctacccaattcctgctatttttcaaaattgtttcactctttgttaagttttatttttttctggatgtactttagaattagcattttagttcctaagaaagccttcattagggttgcattaaatgtatagatacctttaaggtgacaggaaccttgaatatttcaggtatgtctttccatttttctagcctycttaggtacttcagatctaaacttttaaaatataggttttacgcatttattcttatatacactattgtgaatagcatctttttcatgacttctaaatcagttatttgtataaaatataggaaagctattaactctctgcataccaattttagtaactggccacctccaaattatctcagtaattataaaactgaaacatactagttacctcttatttccttagagggtttttagaatttctcctctcagctctttttttaaattttgttttgttttttaattgggagatatgaccacaga

SEQ ID NO: 167761 - DNA, 601 bp, Human
cgtccttcagctaacttgggaataaaacatgttaggagccaggagatgagtgactgtggctccagtcatccatccacaggagaggggaaggccctggagtggatcaaggacaaggatggtggacaaatgggcatcctggggtctgaggccaaggcatgtcaccatcaccacgtcaaaaagtggagtaagccttttgacatgggacatcctggtgtgtactggggcttgttcagctatttgtatattacgtgaaacaggaaatcccagacacagcatgacagagccctctttcctcttttcyttaccactattgtgcttttccctaccgtaaccaggagtgatgttaaaaggaagaggaaatgccagtcacgcccactgcttacaggggattctgtggagtgactaaaccagagctgtagtttgagtcacacaggacgtgtgacaaaaggagggtgacttttttcccccttgtttctttgaacttacttggaagtgttaacagattctaatggttagaatggtaaacagagcttcctactcctgtcgtggtttgacccaggagtctcaccttctctcaggcccttagtttcttccacttaaa

SEQ ID NO: 167762 - DNA, 601 bp, Human
aaaaagtggagtaagccttttgacatgggacatcctggtgtgtactggggcttgttcagctatttgtatattacgtgaaacaggaaatcccagacacagcatgacagagccctctttcctcttttctttaccactattgtgcttttccctaccgtaaccaggagtgatgttaaaaggaagaggaaatgccagtcacgcccactgcttacaggggattctgtggagtgactaaaccagagctgtagtttgagtcacacaggacgtgtgacaaaaggagggtgacttttttcccccttgtttmtttgaacttacttggaagtgttaacagattctaatggttagaatggtaaacagagcttcctactcctgtcgtggtttgacccaggagtctcaccttctctcaggcccttagtttcttccacttaaacagtgagagagttacatgatatggttgcaaatcctctcagcgctaatcttgtaaggttaaaaatgtttgagtgtattgggcattaaaaaggagactatacaccaggcacagtggctcacgcctgtaatcccagcactttgggaggctgaggtaggaagatcacttgagcccagc

SEQ ID NO: 167763 - DNA, 601 bp, Human
aaatcccagacacagcatgacagagccctctttcctcttttctttaccactattgtgcttttccctaccgtaaccaggagtgatgttaaaaggaagaggaaatgccagtcacgcccactgcttacaggggattctgtggagtgactaaaccagagctgtagtttgagtcacacaggacgtgtgacaaaaggagggtgacttttttcccccttgtttctttgaacttacttggaagtgttaacagattctaatggttagaatggtaaacagagcttcctactcctgtcgtggtttgacccakgagtctcaccttctctcaggcccttagtttcttccacttaaacagtgagagagttacatgatatggttgcaaatcctctcagcgctaatcttgtaaggttaaaaatgtttgagtgtattgggcattaaaaaggagactatacaccaggcacagtggctcacgcctgtaatcccagcactttgggaggctgaggtaggaagatcacttgagcccagcagttcagaaccagcctgggcaacatagtgagacaccatatctaaaataaaattgttaattgtaaaaaaataaaaataaaaaaga

SEQ ID NO: 167764 - DNA, 601 bp, Human
atctcaatttttttaaaaattgaggaagggccaggtgcaatggctcatgcctgtaatcccagcactttgggaggccaaggcgggcggatcacctgaggtcaggagtttgagaccagcctggccaacatggtgaaaccctcgtctctactaaaaatgcaaagttagttgcgcatggtggcaggcacctgctactcaggaggctgagacaggagaatcgcctgaacctgggaggcagaggttgcaatcagccgagatcataccactgcactccagctgggcagcagagccagactgtgcctcaaaaaaaaaaaaaattgaggaaggaaccatgtgaaattctgtgcacctcctacttgagttggatacctggtcagtggtagcaaactaagcaagctatttccattgacaaatacaaataaatccttccttcattgtcttcctcaaataaaatcccttgccaatataggcaaggtattttcattctcatgaaactgtggctttgaaatgtgtaaatatctcccttgtttgtaatgaagtggtcagtctcgttctgtttgtgggcaatatgattgaagtctgtctcaaaggagtagtcaaacat

SEQ ID NO: 167765 - DNA, 601 bp, Human
accctcgtctctactaaaaatgcaaagttagttgcgcatggtggcaggcacctgctactcaggaggctgagacaggagaatcgcctgaacctgggaggcagaggttgcaatcagccgagatcataccactgcactccagctgggcagcagagccagactgtgcctcaaaaaaaaaaaaaattgaggaaggaaccatgtgaaattctgtgcacctcctacttgagttggatacctggtcagtggtagcaaactaagcaagctatttccattgacaaatacaaataaatccttccttcattgkcttcctcaaataaaatcccttgccaatataggcaaggtattttcattctcatgaaactgtggctttgaaatgtgtaaatatctcccttgtttgtaatgaagtggtcagtctcgttctgtttgtgggcaatatgattgaagtctgtctcaaaggagtagtcaaacattaacagaccgtgatccaaattaaactatgaaatgtgttcttgtttatcccatgccagactcttaaaaacggttgttagttaaaattgaggtttcaaaaaatgcagtcttctggattatctagggagggggcaga

SEQ ID NO: 167766 - DNA, 601 bp, Human
agataaaatatcaccagcttggggtggtcgtggtggctcacacctgtaatcccagcacttcgggaggccaaggtgggaggaccacttgagcccaggagtttgaaaccagcctgggcagcatggtgaggctgtgtctttacaaaaaattaaagaattggccaggtacggtggctcacacctgtaatcccagcactttgggaggccaaggtgggaggaccgcttgagcccaggagtttgaaaccagcctgggcagcatggtgaggctgtgtctttacaaaaaattaaagaattggccaggtayggtggctcacacctgtaatcccagcattttgggaggccaaggcaggcggatcacgaggtcaggagatcgagaccatcctggccaacatagtgaaaccccgtctctactaaaaatacaaaaaagtaggccggcatggtggcaggcacctgtagtcccagctacttgggaggctgaggcaggagaatggcgtgaacccgggaggtggagcttgcagtgagtcgagattgtaccactgcactccagcctgggtgacagagcgagattctgtctcaaaaaaaaaaaaaaaaattaaagaattaa

SEQ ID NO: 167767 - DNA, 601 bp, Human
tacaaaaaattaaagaattggccaggtacggtggctcacacctgtaatcccagcattttgggaggccaaggcaggcggatcacgaggtcaggagatcgagaccatcctggccaacatagtgaaaccccgtctctactaaaaatacaaaaaagtaggccggcatggtggcaggcacctgtagtcccagctacttgggaggctgaggcaggagaatggcgtgaacccgggaggtggagcttgcagtgagtcgagattgtaccactgcactccagcctgggtgacagagcgagattctgtctcaaaaaaaaaaaaaaaaattaaagaattaactgggtgtggtggcacacacctgtagtcccagttattcaggagcctgaggtgggaggttcacttgagcccacgaggttgaggctgcagtgagccagagttgtgccactgcactccagcctgggcaacagagtaagaccgtgtctcaaatatatatatatatatatccagtcttgtcacaatatcccagcctgaagggagtggctggtggcagactggatgggagagcacaaaacaggcacgggcttctcctcccctttggtactgccacctg

SEQ ID NO: 167768 - DNA, 601 bp, Human
tcttgatctgatccaacttttaattgagcttgctttgttcttttgattttcagtgggcatgtgtggcctcatctctgagctattgtttcatcaggcattgcagtaaactttgaagaatgcaaattctgaacttcatttgctgtcacctggaaggtgctagacaaattcaatccccttgaattctgtgactagaacctataagaaaaaatgaattgtcgttttgtaggttttcatagagaagtagcaatagggaatgatgggtgaatttggacaagtcactttatcccaaagcgtccatttrctcttctgtgaaatactactttatagtgttgtttggcctaaattaaacaaaccatgcaaaaagcccagccctgtgcctggcatacagtgagtgctcatgtgtttgctgctattatattctcctaatccagtttgaaagctgtgaggcagcaactttccaggaaaagatggcttcagccaagggtatgttcctaggacctaccctaaagttagtctctcctattagagtagtttgaagctgaacttggctgaaaactataagaaaggctggtttaggggaagcctttgttacttttagttt

SEQ ID NO: 167769 - DNA, 601 bp, Human
gaaatatccttcatacaaaatggttaatttctaaaacctgtggcatcaccttgacagatctcttctgtttggtttatacgggggaatccaactggaagagtccttcctgacccttggtctgcctgggcagaggaggtactgtcctctgaccatcagattatgttgggtctagcaggctgccttcttccaggctttgtgcaccaacattaaaaaggcagtcatttctcaaaattgtttgggaaatgattaacttgtttcctttgatcctccctgctctgtgtgaggacagtcaagtagcagrggtggagaatgtgttctattattttcaacagtgctaagtaaacactgggggaaattctgccactagagaggtacaactgtgtttgagggtttgaaggcgtgcgcgcgtgtgtgtgtgtatgtgtgtgtgtgtgtccttctgaaaacatagagctattgagtacaaaaatatggccatttcctctaaattttctttcccctgttttttttttaaggtctgaatttcctgctgctgttcacaaagatgctttttatctttaactttttgttttccccacttccgaccccggcgttgatctgc

SEQ ID NO: 167770 - DNA, 601 bp, Human
catcttctaccctcttcagagaaaaaagcattcctgttccttcacaaggctaatttcttctgttgtttttacagtcttctctttccaggatagaaggaatcttactccaagctacctctactctccagctcctctcccacctgtgggtacatctgcatgttcaatgtcttcactgacatcttcccgtcctgctgcattccaccaccacctctcatgcctttcctttcccaccagagttctttgagagtagtttgcttatcgatttcctcttctgaacttcaacccactgagatctgacctyttaccactaccatctcctccaaagtgctctgaatcactcataacctaacttctaaattcagtgacttctctttcagctttcctctcaattgacttgagacttctttcttgaaactcctcctttcgccttttataatatcattccatgagatttcttcctaatttcaaaacaatctttctttgttctttcctctcttcataatagggttttattctcagcatctcttgattcctctgcagcaggggttggcaaacatatgctgtaaaggccaggcagtaaatggcatagaatttgcagacc

SEQ ID NO: 167771 - DNA, 601 bp, Human
ccttcacacacacacacacacacacccctcctttcctattctatttcagttaaatgtatctcttcttacccagttgccaaagttaatagtctgaaacatcttggattcttccttcttccttgactaggcacttaaacagacagcaagaccctgtcttccttcactagacaaggaactttatttttgctattttctgtcttaacgtgatggcccatgtaaattttccctgatgtcctagactaagtcagatctcttgttacatcctcgtgtgttttcctgtacttttatagctctcactttkgatactaatttacattgttgaatgcttatttaattgttgcctgttcttctctacacgaaacttcatgagagttggaccactggaccacacccgcagcacctgttgtagctccagggtccatcccagggccctgatcctgtagatccagctgacatttcagatagattcctagctactccctttttctttttttttttttttttagaggaagtctcgctcttgtcccccaggttggagtgcaaatggtgtgatcttggctcactgcaacctccgcttcccaggttcaagcgattctcctgc

SEQ ID NO: 167772 - DNA, 601 bp, Human
aaagagtgaggggagacttgaacttggcctaaacttggtcttgtgtcttagggaggagcacggaagggggtttcccagaagaacaatgacctaacaagttgctgcttctcagatgccaagactatgtatgaggttttccaaagaggactcgctgtgtctggtaagcctggtggtctgtccttgcctgaagaagacaaggtgaggtctgtggcccatctctctttctctgtctcacttctaaaaccccagctatttagatgcagtgatccaagtagaatcgcaacatgcaaaatagaggcarcattagaacatagtattaggatgggcgttggaaccagtgtcagacggacttaggtttgaaacctggttcttccatttccagcttcataaccttgtgcagaccactttgcttctctgaatctgtttctcaacacaagaagaacgtccctgccaaaactgttgttaaagggtcaaggagataataatataggacagtatctttaactcactagtacctcatatttgtttagaaacatgcctttcattaatgtaattccctgcatttacagatagacaatctgagccaggactagcagtccag

SEQ ID NO: 167773 - DNA, 601 bp, Human
ttaatgtaattccctgcatttacagatagacaatctgagccaggactagcagtccaggattcctgatgtcttaccttgtccttaactctgataccatcctactgaccaaagttagcacttctttggacttttttagagactaccaaatgggctttgacacgttcatttggaatacatcaagccttaatatttatatcttatatcattgaacataatgcctggcacacacacgtttacttttaaaagctgctggcttatagctctttctgtgcctttggtcttttgggtgacattctggccrtgtaacttttatccgtcccttgacttctgcatgttaactaagactaagagcatattcatagccaactcctgtcaagtgttaactatacaatagctactgcacatatattacttcatcttccctaaaccatagagagtggttactatcactgccatttttaaagatgaggacccagactcacagcttcaagaccattaccaaggtcatagaactagaaaatgtcagagctgataggaaaatctaagtgtgtctgtttgacttggttgttctattttaggttagctcgtaagtgttttataa

SEQ ID NO: 167774 - DNA, 601 bp, Human
tttatccgtcccttgacttctgcatgttaactaagactaagagcatattcatagccaactcctgtcaagtgttaactatacaatagctactgcacatatattacttcatcttccctaaaccatagagagtggttactatcactgccatttttaaagatgaggacccagactcacagcttcaagaccattaccaaggtcatagaactagaaaatgtcagagctgataggaaaatctaagtgtgtctgtttgacttggttgttctattttaggttagctcgtaagtgttttataaaagtagtyactcctccagacaatgaaagatttattgtcaagaaaacatctatctgaagagtccgatggggcctgtacttagtatatctggctccaaatcagcatttacttatagacttcatgcaaataacaaataaaaacaaaccaaacatcagtttctttacttctctggcaatttaagatagtatatgtctaatacagtataatttcctttggggttttttccttttttttcagagacgggatcttgctctgtcacccaggctagagtgcagtggtgtgatagaatatagctcactacaactttaa

SEQ ID NO: 167775 - DNA, 601 bp, Human
agccaactcctgtcaagtgttaactatacaatagctactgcacatatattacttcatcttccctaaaccatagagagtggttactatcactgccatttttaaagatgaggacccagactcacagcttcaagaccattaccaaggtcatagaactagaaaatgtcagagctgataggaaaatctaagtgtgtctgtttgacttggttgttctattttaggttagctcgtaagtgttttataaaagtagtcactcctccagacaatgaaagatttattgtcaagaaaacatctatctgaagastccgatggggcctgtacttagtatatctggctccaaatcagcatttacttatagacttcatgcaaataacaaataaaaacaaaccaaacatcagtttctttacttctctggcaatttaagatagtatatgtctaatacagtataatttcctttggggttttttccttttttttcagagacgggatcttgctctgtcacccaggctagagtgcagtggtgtgatagaatatagctcactacaactttaaattcttggactcaagcaatcctctcacctcagcttcccaagtagctaggact

SEQ ID NO: 167776 - DNA, 601 bp, Human
cccagccacttgggaggctgaggcaggagaatcgcttgaacctgggaagtggaggttgcagtgagccgagatcgcgccactgcacttcagcctgggtaacagagggacactccatctcaaaaaaataaaaaaagaaaaatgacacttctggtcctatctggggttgcatacattagccttagctagtagtttgtttatcttgagactcacttggggctactgtttaaaatatatatcttctggttacaccttaggttcactgaattaaatttccagataatgaaacctaaaaatcctcagraagctttgtatttttagcaacacttccaggggattctgtataccagagttggaattctacttagtttagagggacaactttgccaagaatttgttaatggatgggctctttgtagatggccacagcttagaacagaacaggtctgagttgactaagttaatgaaaggctaggctgttgcctggtcaggcatttggctagtaggctgaagctgatcaagtcacagagtttaatgagacctgagttgttgcccctttgggctaattatttgacttattccttagacaccagcctctgctagc

SEQ ID NO: 167777 - DNA, 601 bp, Human
actatgcaaaagggccatgggataatatatcagtgttaataatggtatttgggtgatgagattgatgattcatattttaacttttttatatctttatgagcatagtttttattgtagggaagttcaatccaagattgttcaatacaggctgtttgtgtttacttgtaggctttcacttggtcatgttttgtgggctaaccccatatggatggctttctctgaatgtctacattatcatggaggttacatattcaacactgaaccactcctgttttgtgtagcatttcctaaatgtttcaastatagtttataggactcttcatttttgaggactcagtgctttctgactttgaatttcctggacatataatagaagctcaaatccttgttggacttaccctttgtgtcttgccccttcttaatctccttttagcttccttggtccagagaatttgcaactggagttgattttcttttaatattatgtttttagacaatgggccctgcttgggatatagaaaaccaaaccagccctacagatggctatcttacaaacaggtaagttgagtccatgtttttagacagattctttctaacatag

SEQ ID NO: 167778 - DNA, 601 bp, Human
catattttaacttttttatatctttatgagcatagtttttattgtagggaagttcaatccaagattgttcaatacaggctgtttgtgtttacttgtaggctttcacttggtcatgttttgtgggctaaccccatatggatggctttctctgaatgtctacattatcatggaggttacatattcaacactgaaccactcctgttttgtgtagcatttcctaaatgtttcaactatagtttataggactcttcatttttgaggactcagtgctttctgactttgaatttcctggacatataakagaagctcaaatccttgttggacttaccctttgtgtcttgccccttcttaatctccttttagcttccttggtccagagaatttgcaactggagttgattttcttttaatattatgtttttagacaatgggccctgcttgggatatagaaaaccaaaccagccctacagatggctatcttacaaacaggtaagttgagtccatgtttttagacagattctttctaacatagtattctgaactacaggatacgatattggtcagtttttggtcttgacctcttctctctctctctcacccca

SEQ ID NO: 167779 - DNA, 601 bp, Human
taactatgttgaagttaactaaaggaaatgagtcagggttaagtttaaaaacttcaaatgctattccccgtccagcattccaacacttgttaatgccttaccaaagctattgttaaaattttctaatgcttattctacttgaaagagttaccactcagaacctatttaatttctggttaagtgtctggcactctcacctaggtgtttggacttctcttttttctcagcctatcatgtgttttttgaagtcagtctgattgttacatgaggaaaataaggaagctaggagggaccgccaaataagatcttgaagatattgtggaaagtatgtattagtattagaactgaaacttgcaatttgtaattgaactagtaaattcagccattcattgctactgagtctggccatagctatctttccacagtgagttggaagcagattttagacagtaagatgacagaatcaagcttatctccaagttttggttaagtcattaggcacattatccccagaggaagtctttttatgcttcaaacgctccctagaaatgcagcatatgatacatataacatacaaaatctgtgttaactgtctgtgtta

SEQ ID NO: 167780 - DNA, 601 bp, Human
gtcattaggcacattatccccagaggaagtctttttatgcttcaaacgctccctagaaatgcagcatatgatacatataacatacaaaatctgtgttaactgtctgtgttatcagcaaggcttccagtcgacagaagccattagtagttaagttttgggggagttaagttctatgtggatcttgttgaaagttcacaaactgtaagtcccatttctaatgctaatacaaatataaaaatattcaccaacatttttaggtgaatctgcatactccattcttgtcacagtcagcctcaatagcaaaaggttcccttgactctagtttaggaacttaacacctaatctgatacagttaatccttgaacaacatgggggttaggaccactgcctattcagtaaaaaaatccacagataacccccccaaaacttaactactaatagccttcctttatgataatataggtagttgattaacacatattttgtatgttatatgtattgtatactgctttcttacaatatagtaagctagagaaacaaaaatgtcattaagaaaatgataaggaagagaaaatgtatatactattcattaggtggaagt

SEQ ID NO: 167781 - DNA, 601 bp, Human
catctgagtcatctttaccttgagtgggttgaggaggagggagaagagaggttggtcttgctgtctcagacctggcagaggtggaagaggtagaggagatggaaagagaggcaggaaatataggcaccctcaatgtaacttttattgaaaaaaaaaatccacaagcagacccttacagttcaaacccatgtgttcaaggagcaactgtatattagtctgctagaactgccataatctaatacacagaccatgtggcttaaacaacagaaatttattttctcacagttctggagtctaggawtccaaggtcagagtgtcagcaggtttagcttctcccgaggcctctctccttgacttgtagacagccactttttcattttgtcttcacacggccttttctctgtgcacatgtatccctcatgaccgttcttcttcatagaaggaagggattaggaccccacacttaaaacttcatttaaccttaattacttatttaaaagccctatctcatatactgtcacattggggattagggtttcaacatgaatttgggttgggccggaggaggggtgacagggagacaggattcagtccataacat

SEQ ID NO: 167782 - DNA, 601 bp, Human
cacatgtatccctcatgaccgttcttcttcatagaaggaagggattaggaccccacacttaaaacttcatttaaccttaattacttatttaaaagccctatctcatatactgtcacattggggattagggtttcaacatgaatttgggttgggccggaggaggggtgacagggagacaggattcagtccataacatctacattgatatttaaggcccatcactagcagattcctacctacctttccagttttatttcctgtagtcttcaagcttgctaatgtgtatccacacaatgatgtyatgctgtctgtattagttcgttatcacactgttacgaagaaatacctgagactgggtaatttataaaggaaagaggtttaattgactcacagttctgcagtgctggggaggcctcaagaaacttacaatcatggcggaagggaaagcaaacatgtccttcttcacatggtggcaggaaagaaaagaatgagagcaaagggggtggaaagccccttatgaaatcagatcacatgagaactcactcactgtcacgagaacaatgtattagtctgtttttatgctgctgataaagacatacct

SEQ ID NO: 167783 - DNA, 601 bp, Human
aggaaagaggtttaattgactcacagttctgcagtgctggggaggcctcaagaaacttacaatcatggcggaagggaaagcaaacatgtccttcttcacatggtggcaggaaagaaaagaatgagagcaaagggggtggaaagccccttatgaaatcagatcacatgagaactcactcactgtcacgagaacaatgtattagtctgtttttatgctgctgataaagacatacctaagacctggaagaagaggaggtttaattggacttacagttccacatggctggtgaggcctcagaatyatggtaggaggcaaaaggcacttcttacatcgtggcagcaagagaaaatgaggaagaagcaaaaagtggaaacccctggtaaacccatcagatctcatgggacttatttactatcatgagaatagcacaggaaagaccagcacccatgattgaattacctccccctgggtccctcccacaacacatgggaattctgggagatacaattcaagttgagattttattttatttatttatttatttattttttgtgagacggagtttcactctgttgccaggctggagtacagtggtgccatc

SEQ ID NO: 167784 - DNA, 601 bp, Human
gacggagtttcactctgttgccaggctggagtacagtggtgccatctcagctcactgcaacctccacctcccgggttcaagcaattcttctgcctcagcctcccgagtagctgggattacaggcacatgccaccacgcccagctaatttttgtatttttagtagagacaggatttcaccatgttggccaggatggtctcaatctcttgacctcgtgatcttcccatctcagcctcccaaagtgctgggattacaggcatgaaccactgcacccggcctcaagttgagatttgaatgggtaygcagctaaaccacgtcaaacagtatgagggtaaccacccccatgattcaattacctcccactgggttcctcccacgacacatggggattatgggaactacaattcaagatgagatctggatggggacacagccaaaccatatcactattctttgttcattcacttccttcttttaatctacctctacctccataaccaaatcctactagtcctctaaagccctgcccagttttcatcagtttcccacaagcagtcccaaatagctttcctcacccttgaaagtgatctctgacaccctaa

SEQ ID NO: 167785 - DNA, 601 bp, Human
catatcactattctttgttcattcacttccttcttttaatctacctctacctccataaccaaatcctactagtcctctaaagccctgcccagttttcatcagtttcccacaagcagtcccaaatagctttcctcacccttgaaagtgatctctgacaccctaaggctcctaatgccttccatacctcttacggatggaacttatcacactctgcctttgtattctggtctacctttgtattgcagttgtccctgtgcctttcttatctcccttatttaattgtactttatagcagtatttrcaactgtccctatggccccacagtgatttttttttttacataaaagtcaacaaataagtaatcccagcactttgggaggcccaggtaggcagataggttgagcctaggagttttatgccagaatgggaaacatggtgaaatcccgtctctacaaaaaatacaaaaattagcttgacatagtgatgtgtgcctgtagttccagctactcaggaggctgaggtgggaggattgcttgatcctggaaggttgaggctgcagtgagctatgatcacaccactgcactccagcctgggcagcaga

SEQ ID NO: 167786 - DNA, 601 bp, Human
agctaaaaatcctatttgcccccttctttttcttctattccctactatcctcctcaaataaaacagtgatagaaccacacctcagtaacctgtttaggttatctgaatgacttcttaagcagaaggaattctgtggttcctctagaaactgtaaaatctgctggcacagttcaagaacatgtgcttctgtttcagttaagttcatttatcatcaatggaatgtttcaggttgtacattataaatctgatttgcaggtgtaatctcctttggacacctgttagctttgaaaacttttaaaamctcttccttcttgcaaggcaatcaggtacttagcagagagagggaatgacctctggttctattttggcttccagctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgaggtatggatctgaaatttagcttgcagctccaatgcttgtccaacacc

SEQ ID NO: 167787 - DNA, 601 bp, Human
attcttggccactggtaggctggtaaatactccctctaaagagccctatacttaggggctcacagcctaaggcttctaagtgtgaattcccaaatggaaaaacataaacataagtaaatacactttatttaatatattgggaggtgtttatattcaatagatttcaggggtcttaaagatgatgtcagaaagtcctttcccccgcccccaccaacccaccactctcttgatttgacaccgctggaatggtttcattcaatcaagataactcagtgatagttctccataaagggcttcaacyccaccctacatccacccatctgttagaatgcttaatagtttttaatgtggtccatcatggtctacagttatattctttctagtatgcccagtttataaggtttataaccatatcactatataatattggtagatctggaattccaaacatataaacagcatgagatgtggggcagagggacaaggagggttaacttgaatttttctttgcagctgtgcttctatctgaaatcatggctgtgctctgcatagtagtagaaggccaacgatgcattcagcagtagaatctccgggggcatta

SEQ ID NO: 167788 - DNA, 601 bp, Human
tacttccctggcctacatagcatgcttatgagcccactcctgatgatgtggccatatcctacctccctctggctcatatgtttgagaggattgtacaggtgagtgttctgtgttcctagcagtatgtggcaagggggtcctgacttgctatcacatgtttattccaaaggcagctacacagtatttactgttctttctccggtgtgagaggtgcaggcaaggagttggctcatgggagccctaatcatggcatggcccctcatttcctgcagagtcttcctctgctaagtctgcatgtgtgcagggaggatagtacttgctcctgccttcatgggggtgtgtgagtctagtgacatcacagctaggagcttactatctatctgcccttaattctgagctgacacaagacattgtcttctttttaaattttattttggttagaatttttgaaaagatctaggattagagaaaaggaagttccctacagaggatcagggaaggagcatttgatctacataaggtgtgagatgtcccccgcgccggtttttgcacacctgagtgtgtaaggtggtgctgtcagcatggtgcataccggaggagg

SEQ ID NO: 167789 - DNA, 601 bp, Human
aaaaattgattctaagaaatcttaaaaaatattttaacataatttatgaaattgtgatggtcttacgattgaaggcaggttctgctttaattggcagtgctttcttagtgccacataatgaattgcgtcttacaaaggatgattatcttagactgtcacacagacctgtggtggagtctgggggaccacacagtctcaatatctgtcttatctgtcatgccaccacaacagaaataaatgtccatcctttcttgggggaaggttctcagagtcctgaattgggagggaggtgctgtgcaaraaaagtgtctgtgtgcctcagcccacttcccaaattccttccaagacaggtccccactgaaggggttgtttgcctcagcccacctcctgaattccttccaagacaggtccccactaaaggggttgtttgcctctaagctctataatttggttttgttttcaggctgttgtgtacagctgtggagccagagttggattcttccaaggggatattcggttgctggctgacgacatgaagactttgaagcccacattgtttcccgcggtgcctcgactccttaacaggatctacgataaggta

SEQ ID NO: 167790 - DNA, 601 bp, Human
tgagacagagtcccactctgtcacccaggctggagtgcaatggcacgatctcagctcactgcaacctccgcctcctgggttcaagtgattctcttgcctcagcctcctgagagctgggattataggcgtgcactaccacacccagctaattttttaatattttttagtagagatggggtttcaccatattggccaggctggtctcgaactcctgacctcaagtgatcaccctacctcagcctcccaaattgttagtctttcttcttgatcttctaactgccccatcgtggcagttgggaamcctcatcaagttgctcatgtgtccttttgacaatacccctgtagcctctgatagcttccttggtttctggcacaagatgtctcaacctcatcttgtatatttctcacccaattcttagagtgtctgattgcttcagggagccgttgaagctatttgaacccaggcaatatagtatgtgatgattcctcgggctgggatccgtgaggaagtaatgcatggccattcttcacatgctttggaaccctcccccacctccccaaccacctccaagattttaactcttcctttcactcttaggac

SEQ ID NO: 167791 - DNA, 601 bp, Human
ttcttcacatgctttggaaccctcccccacctccccaaccacctccaagattttaactcttcctttcactcttaggactctcagcagatgctaaatgggctctggtgacagggcaggcagtgttctagcagaactgataacaattccagcagtttcttaccatgctacgcaattagtagatttggtggttgttatggtttttgttcatatgttgttgttgttgtacattttttatttttcagagatagttattgtataatataatacctaatacacagttcacttctggaatgtatttttkttttgttttgtttttgtttttgagacggagtctcgctctgtcgcccaggctggagtgcagtggcacgatctcggctcactgcaagctccacctcccgggttcgtgccattctcctgcctcagcctcctgagtagctgggactacaggtgcccaccaccacgaccggctaattttttgtatttttagtagagacgggttttcaccgtgttagccaggatggtctcgatctccctggaatgtatttttaaaatgaaggactttattagcacacgtctctaatactagctctttgtcagtgac

SEQ ID NO: 167792 - DNA, 601 bp, Human
tactgaatgtagttgacccttgaacaatgcaagagttaggattgcctacccccatggcagtcaaaaattcatgtataatacttgactccctagccgggcatggtggctcatgcctgtaatcccagcactttgggaggctgagacgggcggatcacgaggtcaggagatagagaccatcctggctaacaaggtgaaaccctgtctctactaaaaatacaaaaaaattagctgggcgtggtggtgggcgcctgtagtcccagctactcgggaggctgaggcgggagaatggcgtgaacccggsaggtggagcttgcagtgagctgagattgcgccactgcactccagcctgggcaacagagcaagactccatctcaaaaaaataaaaataaaaaaaatacttgactccccaaaaacttaactactagtagactactattgactagaagccttaccaataatgtaattaatcaacacatattttgtatatgtattatatactgtattcttacaataaagtaagctagaaaaaagaaaatgttatttaagaaatcataaggaagagaaaacatatttactattcattaagtggaaatggatcatc

SEQ ID NO: 167793 - DNA, 601 bp, Human
gacagactttatcagtcattcagatattagctaatcagataaatgaaaaatcttattacagttttgtttcttttatttacaccaaacatctttctattgcttattgacatgtatattttatccatgaattattctattacttccttatagaaaaacaggcaaaagataatttggtccttttttatatttctaagagttcttcacagagtaatacaggttgagtatctccctatttgaaatgcttgggactaaaagtgttttgaattttgcatttttttccaattttgtaatgtttgcattrtaaaacagttgagcattctgaatctgaaaatccaaaatctgaaatgctccaaaaagcatttccttggaacatcatgttggcactcaaaaagttttggattttggaacattttggatttcaaacatttggattagaatagtcaacctgtaatattaacttttgtcatgttggaaacatttttcctggtctcatcatttttgccctgtgtattgccatataaaaatttccaatgtttttatagtcaaactaaataatcttttctatttgtaggttttaaactgcttagacaggacttcctaa

SEQ ID NO: 167794 - DNA, 601 bp, Human
tatttacaccaaacatctttctattgcttattgacatgtatattttatccatgaattattctattacttccttatagaaaaacaggcaaaagataatttggtccttttttatatttctaagagttcttcacagagtaatacaggttgagtatctccctatttgaaatgcttgggactaaaagtgttttgaattttgcatttttttccaattttgtaatgtttgcattataaaacagttgagcattctgaatctgaaaatccaaaatctgaaatgctccaaaaagcatttccttggaacatyatgttggcactcaaaaagttttggattttggaacattttggatttcaaacatttggattagaatagtcaacctgtaatattaacttttgtcatgttggaaacatttttcctggtctcatcatttttgccctgtgtattgccatataaaaatttccaatgtttttatagtcaaactaaataatcttttctatttgtaggttttaaactgcttagacaggacttcctaacccccaatatttcataagactgtttcacccttattttctggcaaacttaccattttccattttttccttttaa

SEQ ID NO: 167795 - DNA, 601 bp, Human
tcatataaagttctatgctttggtctatttccagacccttttggtttctgaatggccagaaggcttggtagtaaatactttgcagcttgggtatgagttcaaggttttttgtttgttcgtttgtttgtttgtttgttttttgagacggagtctcgctctgtcacccaggctggagtacaatggcgtgatttcagctcactgcaacctctgcctcccaggttcaagagattctcccacctcagcctctcaagtagctgggattacagacacctgccatcatgcccagctaattttttttgtrtttttgtagagatggggtttcaccatgttggccaggctggtctcaaactcctgatctcaggtgatcctcccgcctcggcctcccaaagtgctgggattacaggcatgagccaccgccccctccaagttcaaggttttaagacactaagtggtctcgaacccttagagaccttgctttcctcgtgtcttgaccatagcacgtggccagctcacactttatcttgagtaagtctaaaagctcttctttggtttcccaggtgtatgaagcttatggtcaaacagaatgcacaggtggctgtac

SEQ ID NO: 167796 - DNA, 601 bp, Human
gttcgtttgtttgtttgtttgttttttgagacggagtctcgctctgtcacccaggctggagtacaatggcgtgatttcagctcactgcaacctctgcctcccaggttcaagagattctcccacctcagcctctcaagtagctgggattacagacacctgccatcatgcccagctaattttttttgtgtttttgtagagatggggtttcaccatgttggccaggctggtctcaaactcctgatctcaggtgatcctcccgcctcggcctcccaaagtgctgggattacaggcatgagccacygccccctccaagttcaaggttttaagacactaagtggtctcgaacccttagagaccttgctttcctcgtgtcttgaccatagcacgtggccagctcacactttatcttgagtaagtctaaaagctcttctttggtttcccaggtgtatgaagcttatggtcaaacagaatgcacaggtggctgtacatttacattacctggggactggacatcaggtaagtcctccatctgctgggcaggaggtgccatggttgggagaaaggttctaactgaactaggactttggagtttagataactt

SEQ ID NO: 167797 - DNA, 601 bp, Human
aggtggctgtacatttacattacctggggactggacatcaggtaagtcctccatctgctgggcaggaggtgccatggttgggagaaaggttctaactgaactaggactttggagtttagataacttcagttctctggactaatgtggcaaatgcaaaattcaagttttgggtccaggcctgcctatcttggctagtctgcattggtgccaggtgatttttcagtcttcctcttctagagtcaattcataaatatcttagaaatgtgcctggaattatcaccatgcaagagtttctcagctrattcagcacggtatgttctaggtcacgttggggtgcccctggcttgcaattacgtgaagctggaagatgtggctgacatgaactactttacagtgaataatgaaggagaggtgggtaggtcatgccctgtggtcagacagtcatggtggggaggtttatatcagaaagagcaaataattgtaagcaaacttggatttggcccctttgagattgttagcaaagaattaagcattctgaacttcactttcctatcccctatagtggagacttagatctggtgctcttcacagtgtagtggaa

SEQ ID NO: 167798 - DNA, 601 bp, Human
tacaatgacataattctgctttatttaactactgggggacatccctacataacttctctcatgcccttgcaccttttatttcctttccatagtcatccttagtaggagtggtggttcctgacacagatgtacttccctcatttgcagccaagcttggggtgaagggctcctttgaggaactgtgccaaaaccaagtaagtcttgcctaggaaagctttatgcacacccatgggcccatcgtggaggagaggatgcctcaccagttcctgcatctgtcacaagtggctgcagcccaaacagrctgaatagttttatgggactcggggataggatggagagtttaaaaaataaaactctcttttctatttaaaataatatgttcattgtgggaaaagattgggaaagaagagtaaaaatgctattcagagaaaactgttaacacttagatgtgccttttcttctcagtttttctttcaatattgggcatataatgtgcttgtgcatagttttatattcctgctttcatactgcatggctttgacaggcactttgagttggttcatgcttagcccttcaggctttttgaaacagccatgcttta

SEQ ID NO: 167799 - DNA, 601 bp, Human
gaaagaagagtaaaaatgctattcagagaaaactgttaacacttagatgtgccttttcttctcagtttttctttcaatattgggcatataatgtgcttgtgcatagttttatattcctgctttcatactgcatggctttgacaggcactttgagttggttcatgcttagcccttcaggctttttgaaacagccatgctttaagtgatgttttgtattcttaggttgtaagggaagccattttagaagacttgcagaaaattgggaaagaaagtggccttaaaacttttgaacaggtgtgtrctaccactgatgttatactggcctcttgtcagaaagttttgtttaaagtttccatctaatgaggtttaaatgtataatttctaaggaattgattttagattttgtgccattaactacaaaatgaccttttgtagttacttgtacagcgccctttttttgctgtttattgtccattctcccttctccctactcattactttcttaaattatgtttgtgggaatgggcatgtgttactgttacctttaccctttcactgcatcaacctcactttcttcacagagcactcagggggctctgca

SEQ ID NO: 167800 - DNA, 601 bp, Human
gccactgcactccagcctgggtgacagagcaagactctgtcaaaataaatacataaataaataaataatggacagtccttcaaattaaacttagtgtctggtgtattaagcatggtcaaagaaaaataagaataaacagcttcaggtagaactgttgtcagttttcagtttgcaaagcttcaggtagaactgttgtcattttttagtttgcaaagaccagaagaggaaaaaaaatcttgtcatggaaacagaacacagcagtcagagtgctggttccacagtacttgggttcaaattctaytctaccacttagtagattcactcactaagatgatccccatgaggcccctggcacagggtctggcatgcagtaagtgttttttcttttgctatgatcacattactattctggaccagcatcagtccaagagcttttatttggaaaccagtgacttgtcattcttttttgacccaataaccttgacagtgattattactaccctgattttatagattgcaaagagtaaaaaacaggactaaaggaattcacccgcatataaccccttacctacattggtaaacaatgaagccaaggcttgaa

SEQ ID NO: 167801 - DNA, 601 bp, Human
ttgaacctgggaggtggaggttgcaatgagccaagatcgtgccactgcactccagcctgggtgacagagcaagactctgtcaaaataaatacataaataaataaataatggacagtccttcaaattaaacttagtgtctggtgtattaagcatggtcaaagaaaaataagaataaacagcttcaggtagaactgttgtcagttttcagtttgcaaagcttcaggtagaactgttgtcattttttagtttgcaaagaccagaagaggaaaaaaaatcttgtcatggaaacagaacacagcartcagagtgctggttccacagtacttgggttcaaattctactctaccacttagtagattcactcactaagatgatccccatgaggcccctggcacagggtctggcatgcagtaagtgttttttcttttgctatgatcacattactattctggaccagcatcagtccaagagcttttatttggaaaccagtgacttgtcattcttttttgacccaataaccttgacagtgattattactaccctgattttatagattgcaaagagtaaaaaacaggactaaaggaattcacccgcatataac

SEQ ID NO: 167802 - DNA, 601 bp, Human
ggctatcgaggacttttttgccaaataaaatctaaacactataggtatttactatctatattggccatactatacacacacgcacacacacacacacaccccccacacccacccatccatcaaacttcagaaagtaaagaacattcaaagaaaatattcaaacgcatttagaataatggacagtcctggctgggtgtggtggctcacccccgcaatcccagcacttgggaggccgaggcgggtggatcacctgaggtcctcaggagatcaagaccagtctgaccaacatggcaaaaccccrtctctgctaaaaatacaaaattagacgggtttggtggcgcatgcctgtaatcccagctacttgggaggctgaggcaggagaatcgcttgaacctgggaggtggaggttgcaatgagccaagatcgtgccactgcactccagcctgggtgacagagcaagactctgtcaaaataaatacataaataaataaataatggacagtccttcaaattaaacttagtgtctggtgtattaagcatggtcaaagaaaaataagaataaacagcttcaggtagaactgttgtcagttttcagtttgca

SEQ ID NO: 167803 - DNA, 601 bp, Human
ctttttcttagtgagcaatttttgtacagtctgattcagcaaaacagaaaacaaaacaattcaaaggaccctgctctggcatccactatctccgcacagccgggcgcgtggcgcaccgcaaggctctctgcactttcttcctccccacgcctctccctgtatttgttctcagagctctcaaatggtcaaatgagcttgctcaaaaccaacttaccactatatcaaaatctgttcctgtctttgttggaataggagttcaatcttccccagtactggctgtacttgaaacttgctctccacratcaaaatttgcccaattcctgattatcagccagaaagctgctttatttgcaactaaaatatacctttaactttatatggacaacctaaaattctggctctagctgtgtgtgaggggggacatacagaggtgagaacaggccttctttggtcccacaccctccaccctccaatatccttacctcttgggcaggtgagcgaaggggtccttggccttgggctcagcagccagcgcctgctcacattcatccatctcctcctcaggagcaggggcagccgcctttttctcctccttccgctc

SEQ ID NO: 167804 - DNA, 601 bp, Human
ctacttggggactttactcggttgtggaacaatgaactagacagacactacttagctatgatcttcatcctttttcttagtgagcaatttttgtacagtctgattcagcaaaacagaaaacaaaacaattcaaaggaccctgctctggcatccactatctccgcacagccgggcgcgtggcgcaccgcaaggctctctgcactttcttcctccccacgcctctccctgtatttgttctcagagctctcaaatggtcaaatgagcttgctcaaaaccaacttaccactatatcaaaatctgwtcctgtctttgttggaataggagttcaatcttccccagtactggctgtacttgaaacttgctctccacaatcaaaatttgcccaattcctgattatcagccagaaagctgctttatttgcaactaaaatatacctttaactttatatggacaacctaaaattctggctctagctgtgtgtgaggggggacatacagaggtgagaacaggccttctttggtcccacaccctccaccctccaatatccttacctcttgggcaggtgagcgaaggggtccttggccttgggctcagcagccag

SEQ ID NO: 167805 - DNA, 601 bp, Human
gttacacatcaaggacctaagttctggagagggtctgacttggagtggcaatttctagtgaggccctagagtcagaggagggaaggcaaatttgttcagaaggcagagaattcaaggaaaagggatttgagactcactgggaagatggaggcaagcagtgggtagaaaatggtgactttcccccatgttcctggttgtaaggacctgagaagaaaacagagtctggaagctctgtgttgaagggaatgaagtggtacaagtggctgctctgtccatgagctgagtgtgccacagggcccgstgtgcacatgtgcacacctcttcccggccaggttcgggggcccatgtttggctggtacaatctcaatggcttcttttcttttcttttcttttcttctttttcttttctcttgcttgcttgcttgcttgcttgcttgcttgctttttgagacagaatctcgctctgttgcccaggctggagtgcagtgacgagatctcagctcactgcaacttctgcttcctggattcaagtgattctcctgcctcagcctcctgagtagctaggattacgggtgcccagaaccacgcccggctaattttt

SEQ ID NO: 167806 - DNA, 601 bp, Human
ttgttcagaaggcagagaattcaaggaaaagggatttgagactcactgggaagatggaggcaagcagtgggtagaaaatggtgactttcccccatgttcctggttgtaaggacctgagaagaaaacagagtctggaagctctgtgttgaagggaatgaagtggtacaagtggctgctctgtccatgagctgagtgtgccacagggcccggtgtgcacatgtgcacacctcttcccggccaggttcgggggcccatgtttggctggtacaatctcaatggcttcttttcttttcttttcttttcttctttttcttttctcttgcttgcttgcttgcttgcttgcttgcttgctttttgagacagaatctcgctctgttgcccaggctggagtgcagtgacgagatctcagctcactgcaacttctgcttcctggattcaagtgattctcctgcctcagcctcctgagtagctaggattacgggtgcccagaaccacgcccggctaattttttgtatttttagtagagacggggtttcaccatgttggccaggctggtctcgaactcctgacctcgtgatccgcctgcctcggcctcccaaag

SEQ ID NO: 167807 - DNA, 601 bp, Human
cagaaggcagagaattcaaggaaaagggatttgagactcactgggaagatggaggcaagcagtgggtagaaaatggtgactttcccccatgttcctggttgtaaggacctgagaagaaaacagagtctggaagctctgtgttgaagggaatgaagtggtacaagtggctgctctgtccatgagctgagtgtgccacagggcccggtgtgcacatgtgcacacctcttcccggccaggttcgggggcccatgtttggctggtacaatctcaatggcttcttttcttttcttttcttttcttctttttcttttctcttgcttgcttgcttgcttgcttgcttgcttgctttttgagacagaatctcgctctgttgcccaggctggagtgcagtgacgagatctcagctcactgcaacttctgcttcctggattcaagtgattctcctgcctcagcctcctgagtagctaggattacgggtgcccagaaccacgcccggctaattttttgtatttttagtagagacggggtttcaccatgttggccaggctggtctcgaactcctgacctcgtgatccgcctgcctcggcctcccaaagtgctg

SEQ ID NO: 167808 - DNA, 601 bp, Human
gtccatgagctgagtgtgccacagggcccggtgtgcacatgtgcacacctcttcccggccaggttcgggggcccatgtttggctggtacaatctcaatggcttcttttcttttcttttcttttcttctttttcttttctcttgcttgcttgcttgcttgcttgcttgcttgctttttgagacagaatctcgctctgttgcccaggctggagtgcagtgacgagatctcagctcactgcaacttctgcttcctggattcaagtgattctcctgcctcagcctcctgagtagctaggattacrggtgcccagaaccacgcccggctaattttttgtatttttagtagagacggggtttcaccatgttggccaggctggtctcgaactcctgacctcgtgatccgcctgcctcggcctcccaaagtgctgggattacaggtgtgagccaccgtgcctggcttacaatcgctttttcctgccagagcctgaatttgtcacatgcccccagtgaagcatggctcagggcatctctaaccactgatgagaggcaagtttctggtgggaaataaaaccctcagtggcctcttcccagcctccacactg

SEQ ID NO: 167809 - DNA, 601 bp, Human
cttcttttcttttcttttcttttcttctttttcttttctcttgcttgcttgcttgcttgcttgcttgcttgctttttgagacagaatctcgctctgttgcccaggctggagtgcagtgacgagatctcagctcactgcaacttctgcttcctggattcaagtgattctcctgcctcagcctcctgagtagctaggattacgggtgcccagaaccacgcccggctaattttttgtatttttagtagagacggggtttcaccatgttggccaggctggtctcgaactcctgacctcgtgatcygcctgcctcggcctcccaaagtgctgggattacaggtgtgagccaccgtgcctggcttacaatcgctttttcctgccagagcctgaatttgtcacatgcccccagtgaagcatggctcagggcatctctaaccactgatgagaggcaagtttctggtgggaaataaaaccctcagtggcctcttcccagcctccacactgcattaaaaaatcaggccagcagcttctatgatcaatactctgccttgatctccaacagaaagaaaaacggcaccttgctcacctcaacccaagaagtcta

SEQ ID NO: 167810 - DNA, 601 bp, Human
gaggctgccatggaacttttcagccctgatcaagacatgagggaggcaggggctcagctgaagaagctggtggacaccctcccccaaaagcccagagaaagcatcattaagctcatggtaaccagcacctttcacgtcacactggttagaagtggcttccccaagtggggctgcaggattgccccagttttcagacctgtttctaatccagagaggagagtcacagtgccactgtccccaggcaggcagcacagtgatctttctagacatctcctcttcctttttttttttttttttttttgagacagagtctcgctctgtcgcccagactagggtgcaatagcacgatcttggcttactgcaacctccacctcccaggttcaagcgattctccggcctcagcctcttgagtagctgggattacaggcacccaccatcatgccgagctaatttctgtatttttgtagagatggggtttcaccgtgtttgccaggctggtctcgaactcctgacctcaggtgatccacccgcctcagcctcccaaagtgctggcattacaggcgtgagccaccacgcccagcctccccttactattttgtaa

SEQ ID NO: 167811 - DNA, 601 bp, Human; identical to SEQ ID NO: 39166

SEQ ID NO: 167812 - DNA, 601 bp, Human; identical to SEQ ID NO: 39167

SEQ ID NO: 167813 - DNA, 601 bp, Human; identical to SEQ ID NO: 39168

SEQ ID NO: 167814 - DNA, 601 bp, Human; identical to SEQ ID NO: 39169

SEQ ID NO: 167815 - DNA, 601 bp, Human; identical to SEQ ID NO: 39170

SEQ ID NO: 167816 - DNA, 601 bp, Human; identical to SEQ ID NO: 39171

SEQ ID NO: 167817 - DNA, 601 bp, Human; identical to SEQ ID NO: 39172

SEQ ID NO: 167818 - DNA, 601 bp, Human; identical to SEQ ID NO: 39173

SEQ ID NO: 167819 - DNA, 601 bp, Human; identical to SEQ ID NO: 39174

SEQ ID NO: 167820 - DNA, 601 bp, Human; identical to SEQ ID NO: 39175

SEQ ID NO: 167821 - DNA, 601 bp, Human; identical to SEQ ID NO: 39176

SEQ ID NO: 167822 - DNA, 601 bp, Human; identical to SEQ ID NO: 39177

SEQ ID NO: 167823 - DNA, 601 bp, Human; identical to SEQ ID NO: 39178

SEQ ID NO: 167824 - DNA, 601 bp, Human; identical to SEQ ID NO: 39179

SEQ ID NO: 167825 - DNA, 601 bp, Human; identical to SEQ ID NO: 39180

SEQ ID NO: 167826 - DNA, 601 bp, Human; identical to SEQ ID NO: 39181

SEQ ID NO: 167827 - DNA, 601 bp, Human; identical to SEQ ID NO: 39182

SEQ ID NO: 167828 - DNA, 601 bp, Human; identical to SEQ ID NO: 39183

SEQ ID NO: 167829 - DNA, 601 bp, Human; identical to SEQ ID NO: 39184

SEQ ID NO: 167830 - DNA, 601 bp, Human; identical to SEQ ID NO: 39185

SEQ ID NO: 167831 - DNA, 601 bp, Human; identical to SEQ ID NO: 39186

SEQ ID NO: 167832 - DNA, 601 bp, Human; identical to SEQ ID NO: 39187

SEQ ID NO: 167833 - DNA, 601 bp, Human; identical to SEQ ID NO: 39188

SEQ ID NO: 167834 - DNA, 601 bp, Human; identical to SEQ ID NO: 39189

SEQ ID NO: 167835 - DNA, 601 bp, Human; identical to SEQ ID NO: 39190

SEQ ID NO: 167836 - DNA, 601 bp, Human; identical to SEQ ID NO: 39191

SEQ ID NO: 167837 - DNA, 601 bp, Human; identical to SEQ ID NO: 39192

SEQ ID NO: 167838 - DNA, 601 bp, Human; identical to SEQ ID NO: 39193

SEQ ID NO: 167839 - DNA, 601 bp, Human; identical to SEQ ID NO: 39194

SEQ ID NO: 167840 - DNA, 601 bp, Human; identical to SEQ ID NO: 39195

SEQ ID NO: 167841 - DNA, 601 bp, Human; identical to SEQ ID NO: 39196

SEQ ID NO: 167842 - DNA, 601 bp, Human; identical to SEQ ID NO: 39197

SEQ ID NO: 167843 - DNA, 601 bp, Human; identical to SEQ ID NO: 39198

SEQ ID NO: 167844 - DNA, 601 bp, Human; identical to SEQ ID NO: 39199

SEQ ID NO: 167845 - DNA, 601 bp, Human; identical to SEQ ID NO: 39200

SEQ ID NO: 167846 - DNA, 601 bp, Human; identical to SEQ ID NO: 39201

SEQ ID NO: 167847 - DNA, 601 bp, Human
tcaccccaccccgaccattcactgaccctgacctagaagcccccttgggagaggagaaatccagtgaggaagggccacactggggaacagagttcaagttaaagaccatgaaacagttgtcccttagctctgagcctcccttctctagagttgaccctgtcagggagcagagaacaaaattaactaaatgttcctttaaactgggcattaaagtaatctaaaatatcaggctgaatcaggcagagagacaggcaattatctggaatgttaaaaagaatccagacacagagcattttgtgcyagccccatgctcccacttctgatcccactgagactaggcccaccacacttaccagtgtgtaactatgctcttaaagtctcattggatatcttatggaattgggaacagatgtgtctgcaatgaagcattttcactgaaacctaaagaagcagtctgaaatttcaagtcattctgaattaatctgatatctgatcattgcggctttaagggtggaagggtggggttttctattgggattatctgaataattatattattctctgcttttgattgaaccacagatcttgttgaagattctcc

SEQ ID NO: 167848 - DNA, 601 bp, Human
ttgtcaccgcactgtccagttttctgtgaaatattatcttaagaaaaagaggaatgtcagttgccatgcttttctcccccctagttccctgctctgggatgtggtaccccgggcagagcatggcatctggagggagaggacccttgtttagagctggggatggctatacgtcctgggggaagggagagcagccagtgccaggtgactgtgagtcctgacccagatcagtggtctgggagcaatttttcagaactgaagcttccaaccccgcccccctcccccggccactcccccttctccrcaggaatgaccctttcctcaggactttcatagcccctacctggcactaagtcaaccacctatgtgtgtttccttgactgtctttactacttttatataatcccctcggggcagaaaccacatctctttaatcttttcacacatcctcctgcccctaagcaggaaaacagggcagcctgtttacttagcagtaaatacggctagaagaagcttagatatgagccccagtttcatcattactagttgtgtgactctttgagtctcagttttgccaactacaaaacagacacaaacacaccaa

SEQ ID NO: 167849 - DNA, 601 bp, Human
caaatttgtcaccgcactgtccagttttctgtgaaatattatcttaagaaaaagaggaatgtcagttgccatgcttttctcccccctagttccctgctctgggatgtggtaccccgggcagagcatggcatctggagggagaggacccttgtttagagctggggatggctatacgtcctgggggaagggagagcagccagtgccaggtgactgtgagtcctgacccagatcagtggtctgggagcaatttttcagaactgaagcttccaaccccgcccccctcccccggccactccccctyctccgcaggaatgaccctttcctcaggactttcatagcccctacctggcactaagtcaaccacctatgtgtgtttccttgactgtctttactacttttatataatcccctcggggcagaaaccacatctctttaatcttttcacacatcctcctgcccctaagcaggaaaacagggcagcctgtttacttagcagtaaatacggctagaagaagcttagatatgagccccagtttcatcattactagttgtgtgactctttgagtctcagttttgccaactacaaaacagacacaaacac

SEQ ID NO: 167850 - DNA, 601 bp, Human
ctgctaaaacctttaaaacaaggcaaaattaacctgtattctctgggatgtgaaattatgtggtaaaatgataaaaaaaaaaagcaagggagtgactgtcacaaaatcaaagacagtgttttgctctggagtgagagagagagagtgattacaaaggcacacgaggagcttctggaacaagggtaacatccgctttgtcaggctgcattgtgatggcaaatttgtcaccgcactgtccagttttctgtgaaatattatcttaagaaaaagaggaatgtcagttgccatgcttttctccccsctagttccctgctctgggatgtggtaccccgggcagagcatggcatctggagggagaggacccttgtttagagctggggatggctatacgtcctgggggaagggagagcagccagtgccaggtgactgtgagtcctgacccagatcagtggtctgggagcaatttttcagaactgaagcttccaaccccgcccccctcccccggccactcccccttctccgcaggaatgaccctttcctcaggactttcatagcccctacctggcactaagtcaaccacctatgtgtgtttccttgactg

SEQ ID NO: 167851 - DNA, 601 bp, Human
acaagtcaattggtgcatttggtagcaaacatggaaacactgatgagtgacaatctggcagatctgtttggcgcctagttttttctggaaacttttggtttgagtgccccggttgacacaatgggtgggttaaaactggtctgtagttttgtaggaaatctttcaactgaaagaaacaagatctacaaggagaatgtccaatccaagaacatctatttcttttgttaccctcaaaaaagactccgtttaagaaaaggctcttaagctaaatctcattaggcaaaataaagctaagagatgrggagtcaggcaatgggtctttgaacctctagattggagtttgagtcccatgatctggttttagccgagagtagtggctgcttacaatcttgcttatgcagaggatggcagaattgtaaagaacatgcgtccagggaacaactggggaatttggtgctgcttatatcagagaacaaccttggtagcttgattttactggtgttggtaaaacgttagattaaaaagttttagaatgttttcaggagttgacaagtagcagtttttctaaatctttctcctttaattccattctgtcagtgaa

SEQ ID NO: 167852 - DNA, 601 bp, Human
ctggggtgtgtgtgctaatttcttcccaggttaactggtatcagtgagtttctaatacaagtcaattggtgcatttggtagcaaacatggaaacactgatgagtgacaatctggcagatctgtttggcgcctagttttttctggaaacttttggtttgagtgccccggttgacacaatgggtgggttaaaactggtctgtagttttgtaggaaatctttcaactgaaagaaacaagatctacaaggagaatgtccaatccaagaacatctatttcttttgttaccctcaaaaaagactccrtttaagaaaaggctcttaagctaaatctcattaggcaaaataaagctaagagatggggagtcaggcaatgggtctttgaacctctagattggagtttgagtcccatgatctggttttagccgagagtagtggctgcttacaatcttgcttatgcagaggatggcagaattgtaaagaacatgcgtccagggaacaactggggaatttggtgctgcttatatcagagaacaaccttggtagcttgattttactggtgttggtaaaacgttagattaaaaagttttagaatgttttcaggag

SEQ ID NO: 167853 - DNA, 601 bp, Human
aagacatcaagattcaaaataaagttgtcttaagtggaaaaaactccagcctcgatttaaaaagtatgtcttcgattatgaacagactcacttgctgataatgagtgtttcctctccagagatccagactcgcatgaattctccatacacccggttgtagtagttgcaggcactgccgatccccatccacaggaatctgccgtgggagatgaggggtccaattcccatgcagtagccaggacctaggacaggtgtcagagcataagcaacatcttagttacaccaaaaattgcaactgttytgtgttactcctgtttttgttcttttatagctaagtgttctttacatgtgatgtatatctgtgaatcacgaataaagtgatttgaaacaaaacaaaacaaaacaaaagcctcacgcttaacatgaggctcttcacttctccatgagtaaaaaggagttcagtatccataccacactagttttatttggtctcaatcatttcagtctgaatgaactggggtgtgtgtgctaatttcttcccaggttaactggtatcagtgagtttctaatacaagtcaattggtgcatttggtagcaaaca

SEQ ID NO: 167854 - DNA, 601 bp, Human; identical to SEQ ID NO: 17950

SEQ ID NO: 167855 - DNA, 601 bp, Human; identical to SEQ ID NO: 17951

SEQ ID NO: 167856 - DNA, 601 bp, Human; identical to SEQ ID NO: 17952

SEQ ID NO: 167857 - DNA, 601 bp, Human; identical to SEQ ID NO: 17953

SEQ ID NO: 167858 - DNA, 601 bp, Human; identical to SEQ ID NO: 17954

SEQ ID NO: 167859 - DNA, 601 bp, Human; identical to SEQ ID NO: 17955

SEQ ID NO: 167860 - DNA, 601 bp, Human; identical to SEQ ID NO: 17956

SEQ ID NO: 167861 - DNA, 601 bp, Human; identical to SEQ ID NO: 17957

SEQ ID NO: 167862 - DNA, 601 bp, Human; identical to SEQ ID NO: 17958

SEQ ID NO: 167863 - DNA, 601 bp, Human; identical to SEQ ID NO: 17959

SEQ ID NO: 167864 - DNA, 601 bp, Human; identical to SEQ ID NO: 17960

SEQ ID NO: 167865 - DNA, 601 bp, Human; identical to SEQ ID NO: 17961

SEQ ID NO: 167866 - DNA, 601 bp, Human; identical to SEQ ID NO: 17962

SEQ ID NO: 167867 - DNA, 601 bp, Human; identical to SEQ ID NO: 17963

SEQ ID NO: 167868 - DNA, 601 bp, Human; identical to SEQ ID NO: 17964

SEQ ID NO: 167869 - DNA, 601 bp, Human; identical to SEQ ID NO: 17965

SEQ ID NO: 167870 - DNA, 601 bp, Human; identical to SEQ ID NO: 17966

SEQ ID NO: 167871 - DNA, 601 bp, Human; identical to SEQ ID NO: 17967

SEQ ID NO: 167872 - DNA, 601 bp, Human; identical to SEQ ID NO: 17968

SEQ ID NO: 167873 - DNA, 601 bp, Human; identical to SEQ ID NO: 17969

SEQ ID NO: 167874 - DNA, 601 bp, Human; identical to SEQ ID NO: 17970

SEQ ID NO: 167875 - DNA, 601 bp, Human; identical to SEQ ID NO: 17971

SEQ ID NO: 167876 - DNA, 601 bp, Human; identical to SEQ ID NO: 17972

SEQ ID NO: 167877 - DNA, 601 bp, Human; identical to SEQ ID NO: 17973

SEQ ID NO: 167878 - DNA, 601 bp, Human; identical to SEQ ID NO: 17974

SEQ ID NO: 167879 - DNA, 601 bp, Human; identical to SEQ ID NO: 17975

SEQ ID NO: 167880 - DNA, 601 bp, Human; identical to SEQ ID NO: 17976

SEQ ID NO: 167881 - DNA, 601 bp, Human; identical to SEQ ID NO: 17977

SEQ ID NO: 167882 - DNA, 601 bp, Human
tcacccatttccatctcctctaaaaaaatatgaaataagccttaaaaggctgtcatagaaacccattattaagccaataaaaactaatgaagaaattatgtcatttatccaagatatggaagaaccacctatttacagaaatcctaccaatgtcctagaccttcagaaactacatctcactaagctgaccatcaagccccttcaaactgcatctaaggacaataataatattcaaacatcaagaaacaggcacaggttccactcaacaccattattccgtggagtcttccaggactaaatygttttatagaatctttgctatctttgttctctagaaaatgatatcccaaagactctaaaataaaaccagcaaaacccctgtatttgttttccattgtgtcataacaaattatcacaaacaaaacaacacaaatggattatcttacagaagtcagtgggcttgactgggtctcacaagggctaaatgagggtatccagtgggtgggttccctgctggaaactctggggaaaatttgcttccacattcattcaagctattggctgaatttagttccttgcagctgtaggactgagttcccac

SEQ ID NO: 167883 - DNA, 601 bp, Human
acagcaagggactgtaaactggtgaccacaaacacagccaacccccatacccatggtttcagttacccgcagtcaactgcagtctgaaaatattaaatggaaaattccagaaataaataagtcataagttttattttccatgtttgtttttagagacgaggattcactcagtcacccaggctggagtgcagtggtgcaaccgtagctcactgtagcagcctctacctcccatctcagcctcccttgtagctgggaccacgggcatgcaccaccactcctggctatttttttttttttttttgtaaagaaggtttctcactatgttgcccgggctagtcttgaactcctgggctcaagcaatcctcccgccttaccctcccaaagtgctgggattacaggcatgagccattgcacccagccatgttttaaattgtacatggttctgagtaatgtgatgaaatcttgcaccatctagtaccatccagccctggatgtgaatcatccctttgtccagctgtatatgccacctgctcattagtcacttggtagccttcttggttacttgaatgttgcagtattgcagtgcttgtcttcaagttac

SEQ ID NO: 167884 - DNA, 601 bp, Human
gaggctgcagtgagctgtgattatgccactgcactctagcctgggcgacatagcaaggccctgattcgaaaataaaaattcataaacttgaacttagaaaagcaaactaaaaattaagaacttacacatatctcaataaatttgaaaacagaagcccagagaaactagaaggaaaaaaacgggaaaagcagcaatcaaagaaatatgaaacaaagaggatccacaataccaattgagtctttaaaaatgctcgtgctgagcccgtggctcatgcctgtaatcccaacactttgaaaggccraggcaaaggattgtctgagtccaggagtttgagatcagcctgggcaacagagtgcaacccccaatctctacaaaaataatttaaaaattaggccaggcatggtggctcatgactgtaatcccaatacttaggaaggctgaagcgggaagactgcttgagcccaggagtttgagaccagcctgggcaatacagtgagactccatctcaaaaaaattgtttttaataataaaaacaatggaaaaaattagctgagtcccagctactcaggaggctaaggcaggaagatcacttgagcccagg

SEQ ID NO: 167885 - DNA, 601 bp, Human
gaaattaagagctgggcacagctcaggggtccctgcactttgggagactgaagaggaaagatggcttgaggctgagttcgtgaccagcctgggcaacacagcaagactaccatctctacagaaaaatttaaaagttagctaagtatggtgcatgcacctgtgtcctagctactcagaaggctgaagtgatcatgtgaacctaggagtttgaggcttcagtgagctatgatcacagtgttgcactccaacctggctgacagacactctgcctcaaaatcaatcaatcaataaattttaaatwaaaaaaaacataggctatagagagtttgttcataaaaatacgatatttcaaaacgtgggatacaattaaagcaggacttagaaatttataaacttaggccaggtgtggttgctcatgcctgtaatcccagcactttgggaggctgaggtgagtggattacttgaatctaggagttcgagaccagcctgggcaacatggcgagacctcgcctctataaaaataaaaattttaaaaatcggctgggcgcagtggctcacgcctgtaatcccagcactgtgggaggctgaggcgggcggatca

SEQ ID NO: 167886 - DNA, 601 bp, Human
aaggaaaggaaataagtaagcatggaaagagagcctaaatttctccctttccatgcttattcattacaagggtattcctaagtccaatgggcttggaaagggagaaatagcaactctacagtagaaaaacctggcagactttactgaaatatcactagtgttaagtcactttgacatcatatgcccctgatataatgtgatgagaagggcacttcacctctgtggtagtcttctcaaaaatccataaccacaatttaatcttgagaaaacatcaaacctgtattgaaggacattctataamatacatcaccagtcttcttcaaaagtttccaagtaatgaaaattaaagacagactaagaagcttcacagactggaggatactaaggagacatgatgactaaattaatgtggtatcctggactggctccttgaacagaaaaaggatacaactggtaaaatccaaacaaagcctgtagtttagttaatagtattataccgatgttaatttcttaattattttatttatttatttatttttagagatggggtctcactttgtcacccaggctggagtgcaatggtgtgatcctagctctccca

SEQ ID NO: 167887 - DNA, 601 bp, Human
cagttcatggcctgttaggaaccaggctacacagcaggaggtgagcagcgggagtcactcgcattactgcccgagctctgcctcctgtcccatcagcaacagcattagattctcataggagaaccctattgtgaactgcacatgtgaggaatctaggaggtggagctcaatttttctcctttaaggaaaggaaataagtaagcatggaaagagagcctaaatttctccctttccatgcttattcattacaagggtattcctaagtccaatgggcttggaaagggagaaatagcaactctayagtagaaaaacctggcagactttactgaaatatcactagtgttaagtcactttgacatcatatgcccctgatataatgtgatgagaagggcacttcacctctgtggtagtcttctcaaaaatccataaccacaatttaatcttgagaaaacatcaaacctgtattgaaggacattctataacatacatcaccagtcttcttcaaaagtttccaagtaatgaaaattaaagacagactaagaagcttcacagactggaggatactaaggagacatgatgactaaattaatgtggtatcctg

SEQ ID NO: 167888 - DNA, 601 bp, Human
acaaacaaatggtttgccatgtgatgcttagcaataaaaaggaacaaattactgatttgtgcaacaaaatggatgaatcgtttttctttttttggtagagacagggtctcgctttgttgcccaggctggtctcaaacgtctagcctcaagtaatcctttggcttcagtctcccaaagtgctaggattacaggtgtgagctgctacacctgaccaacatggtgaatcttaaaagtgaagaagccagaaacaaaagcctacatattgtatacttccatttatatcaggggtccccaatccccrggccatgggcctgtaccagttcatggcctgttaggaaccaggctacacagcaggaggtgagcagcgggagtcactcgcattactgcccgagctctgcctcctgtcccatcagcaacagcattagattctcataggagaaccctattgtgaactgcacatgtgaggaatctaggaggtggagctcaatttttctcctttaaggaaaggaaataagtaagcatggaaagagagcctaaatttctccctttccatgcttattcattacaagggtattcctaagtccaatgggcttggaaaggg

SEQ ID NO: 167889 - DNA, 601 bp, Human
aaggtggtctctggattagtgcccatgcatacctgatataagcaagctctccatggaggaaagtaccttactgtgggcctcaaatgatcactacaaatatctatttttatttttattattttttatttttttgagacagagtctcgctctgtcacccaggctggagtacagtggcctgatctcagctcactgcaagctctgcttcctgggttcacgccattctcctgcctcagcctcccgagtagctgggactacaggagtccgccaccacgcccggctaattttttttttttttttttttaagtaaagacggggtttcaccgtgttagccaggacggtctcgatctcctgacctcgtgatccacccgccttggcctcccaaagtgctgggattacaggtgtgagccaccgcacccagccaattatttatttttaaatacaatgtcctagcagatctcaaaaaacaagaggaaaaatatagtgaaatcgttggatatacttttttttttttttttttttgccacaaagtcttgttctgccacccaggttagagtgcagtggcacgatctcagttcattgcaacctctgcctcccaggttca

SEQ ID NO: 167890 - DNA, 601 bp, Human
atttcagaccactacatctaccttaacaccgtcagaatgactttgaagacatggctaggtcttgtatgctcaacgtttagcctaacagaagccaattaatcagctacgaaaaaagtatcatgtcaatgaatttttcccgactgaagtaagatcacatcgaagccaactgcatgggtctgcatgacctattctttaataaagtataagtaaataaaaagaaaatgccattaaaccataaggaaaaattgtccattgccaaaatcataagtttactgatatacactgaatacagcagaattaatttcaataaaaactcctcttgcccttagctagtccctccttctaatctcttatgttcagttgttatttttcaatttggcaactaaaaagaaaactagaggcttagtaacagtccaataccagaaaactatacaaacaagtttgcttagtcatttctgctaatgtatttttattgatgaatttcctagtatcagaaatggaaaagatcattctagaactttaagtcaatttttgaactgtaatataattagttctttttaaccctaatgtttattagtctccatcttaaaaggaaaaaaaa

SEQ ID NO: 167891 - DNA, 601 bp, Human
cccaaagaggtgcttcaccttactgtcacgcataccaaataatctgcttatagtaagaaaggtattcacatgaatttcaaatggctggccttcattaattatacgggaaaataaaacagaggattcttcaactgtgactctgtaatctcagatagataaaagggtactaagagattgggggttaagggatggtgataaaaaggggatgtgaagcccagtgtggtggctcatacctataatcccagcactctggcaggatcacttgagcccaggagtttgagaccaccctgggcaacacagygagacctcctctctacaaataacataaaaatgagctgggtgtagtggagtacaactgtggtcccaggtacttggtaggctgagatggaaggatcacttgagcctgggaggtcaaggttgcagtgagccatgatctcaccactgcactccaacctgggtgacagagcaagaccctgtctcaaaaacaaacaaacaaacaaacaaaaaacaaaaacaagaggggatgtgaaaagacagaaaagggaggtcaaagaccaaatattatcattattatttttttgagacaggagacagggtcttg

SEQ ID NO: 167892 - DNA, 601 bp, Human
tatgaattctcccacccaaaaaactgctgtaacttgcctctgttcaactcaaaccttctgaggttccataaatgtactaaatgaccagaaaacaacaaagtaattcaagtaccaaaagtctttaaaattatttctatttctttgattttgtaaaacctgggtgacattaatctatcttcacttaatatcagttaaaactgtaaacgcacacacacacaaacacatcaaacatgcaaaaaccagatgttttcttgtaatttttcttcttcccaaagaaataaggtcatctatgttgtaggaytggtgactctgtgactactatgcctgccttgacagcaatgaaagacactaggaaaaccgtagagaaaggtgtaggtgtgaatatggccaaaatagtagaaacagcagcatgaacccaacagaaatgctgtccccagaaatttattacttttaatatactaaacttttaaattctcagcctctcctctgacaggaaacagtatctttctctacataacctttacagccactttactcttctggttaacattttatacgtgtaagacagccttcgtctgtggatctcaaagcccttttccta

SEQ ID NO: 167893 - DNA, 601 bp, Human
acatgctgacttatgaattctcccacccaaaaaactgctgtaacttgcctctgttcaactcaaaccttctgaggttccataaatgtactaaatgaccagaaaacaacaaagtaattcaagtaccaaaagtctttaaaattatttctatttctttgattttgtaaaacctgggtgacattaatctatcttcacttaatatcagttaaaactgtaaacgcacacacacacaaacacatcaaacatgcaaaaaccagatgttttcttgtaatttttcttcttcccaaagaaataaggtcatctrtgttgtaggattggtgactctgtgactactatgcctgccttgacagcaatgaaagacactaggaaaaccgtagagaaaggtgtaggtgtgaatatggccaaaatagtagaaacagcagcatgaacccaacagaaatgctgtccccagaaatttattacttttaatatactaaacttttaaattctcagcctctcctctgacaggaaacagtatctttctctacataacctttacagccactttactcttctggttaacattttatacgtgtaagacagccttcgtctgtggatctcaaag

SEQ ID NO: 167894 - DNA, 601 bp, Human
cacatgctgacttatgaattctcccacccaaaaaactgctgtaacttgcctctgttcaactcaaaccttctgaggttccataaatgtactaaatgaccagaaaacaacaaagtaattcaagtaccaaaagtctttaaaattatttctatttctttgattttgtaaaacctgggtgacattaatctatcttcacttaatatcagttaaaactgtaaacgcacacacacacaaacacatcaaacatgcaaaaaccagatgttttcttgtaatttttcttcttcccaaagaaataaggtcatctatgttgtaggattggtgactctgtgactactatgcctgccttgacagcaatgaaagacactaggaaaaccgtagagaaaggtgtaggtgtgaatatggccaaaatagtagaaacagcagcatgaacccaacagaaatgctgtccccagaaatttattacttttaatatactaaacttttaaattctcagcctctcctctgacaggaaacagtatctttctctacataacctttacagccactttactcttctggttaacattttatacgtgtaagacagccttcgtctgtggatctcaaa

SEQ ID NO: 167895 - DNA, 601 bp, Human
aagactgggatggagattaattctctattccttaaccgtgacaaacacaattaatgacattccactccaaatatatgagatcaaaagattcacatgctgacttatgaattctcccacccaaaaaactgctgtaacttgcctctgttcaactcaaaccttctgaggttccataaatgtactaaatgaccagaaaacaacaaagtaattcaagtaccaaaagtctttaaaattatttctatttctttgattttgtaaaacctgggtgacattaatctatcttcacttaatatcagttaaaackgtaaacgcacacacacacaaacacatcaaacatgcaaaaaccagatgttttcttgtaatttttcttcttcccaaagaaataaggtcatctatgttgtaggattggtgactctgtgactactatgcctgccttgacagcaatgaaagacactaggaaaaccgtagagaaaggtgtaggtgtgaatatggccaaaatagtagaaacagcagcatgaacccaacagaaatgctgtccccagaaatttattacttttaatatactaaacttttaaattctcagcctctcctctgacaggaaaca

SEQ ID NO: 167896 - DNA, 601 bp, Human
tgactgtgattttaatttgcatttccctaatgattaatgatgttgagcatctttttacatgcttattggccatttgtatatttgttttggagaatgtctattcaaagctgttgtccattttttgattgggttgttttgtttgttgacgatgcatttgttaactatactgtttttttgttgcttacaagctgctcatctttccaaggtaagctgtaacttagctaccacacccaaagagaagccagaagagatacctccttatgcccatggtgtcggcagctaaaggctttcagaagaatakcaagactgggatggagattaattctctattccttaaccgtgacaaacacaattaatgacattccactccaaatatatgagatcaaaagattcacatgctgacttatgaattctcccacccaaaaaactgctgtaacttgcctctgttcaactcaaaccttctgaggttccataaatgtactaaatgaccagaaaacaacaaagtaattcaagtaccaaaagtctttaaaattatttctatttctttgattttgtaaaacctgggtgacattaatctatcttcacttaatatcagttaaaa

SEQ ID NO: 167897 - DNA, 601 bp, Human; identical to SEQ ID NO: 23574

SEQ ID NO: 167898 - DNA, 601 bp, Human; identical to SEQ ID NO: 23575

SEQ ID NO: 167899 - DNA, 601 bp, Human; identical to SEQ ID NO: 23576

SEQ ID NO: 167900 - DNA, 601 bp, Human; identical to SEQ ID NO: 23577

SEQ ID NO: 167901 - DNA, 601 bp, Human; identical to SEQ ID NO: 23578

SEQ ID NO: 167902 - DNA, 601 bp, Human; identical to SEQ ID NO: 23579

SEQ ID NO: 167903 - DNA, 601 bp, Human; identical to SEQ ID NO: 23580

SEQ ID NO: 167904 - DNA, 601 bp, Human; identical to SEQ ID NO: 23581

SEQ ID NO: 167905 - DNA, 601 bp, Human; identical to SEQ ID NO: 23582

SEQ ID NO: 167906 - DNA, 601 bp, Human
tgggttttcccgcatccttctgtttgggggcctgggcattaagtcagtggttctgggcttggggtgccgcacccagcacgaattccacgtcgcttccccctggcctcgttggggacccctgcacctctccggttcccgcagaggcgctgccccccgcctaccccgacctggcggccgcagcgagggacgcagcacactcacccccttgcgctggttgctgaggcagaaggtgcagatggagcgcggctggcggccgccgtcggcggcggcggggacggcgcccttggcactgcccgcggcrcggaagcacggctgcccgtcgtcggccgagtcgcccagcagcagcacgttggccaggtgcgcgatgtagctggacgccaggcgcagcgtctcgatcttggacagcttgcggtccaccggctcggtggggatgagcgtgcgcagcgccgtgaaggccgtgttcacgctctgagtgcggtcccgctcccgcgcgttggccgcctgccgctgtcgcaccaccaccacggggcccgcgccgccgccgccgcccgcccgccgcccgcccccggggcccgggccgcgccgcgccgcctccgggccc

SEQ ID NO: 167907 - DNA, 601 bp, Human
gtgcctcctggtcccagctaccctctgggtataccaacaggggagagccttacaagatgatcctgtccaatcctcacccccaggtgacaaagggaaaacagggcagagacaagaaccccctttccacctcccacgtgctaattctaccacagagggccacacctaacccctccttcaacagaaagatgctacaggaaactgtttccacggcaaccccaactccagactggccaggatgggagggaggtggtggctcagggtaaaggaacggggtcttgggtcttaaagctcttctggcccmcaaagctcagaagggagcaagagctccccaagccagccagttttcttccagcagagtcttcaaggggccatagctggccaggattgcccctctcgcctattcccagaggagaccgtggggttgagagcatggtttctacagccaaatttggctgagttcttggtcccatagacagatcccagggaagcggccaggcccaggggaggcccctgtgagctgtgggacaggcctgagacctgcagagaagtcccccagcctgcttgctatgggggtggacacatgacagttacagggacttcc

SEQ ID NO: 167908 - DNA, 601 bp, Human
cgaatgtgaatgcagctgtgtaagctgctaagtgtacttagaagaggtcttgacggccgggtatggtggcttatgcctgtaatcccagcacttttgggaggccgaggcaggcggatcacctgaggccaggagttcgagaccagcctggccaacatggcaaaaccccgtctctactaaaaatacaaaaaattagccaggtgtggtggctggcacctgtaatcccagctacttgggaggctggggcaggagaactgcttgaacccgggaggcggaggctgcagtgagttgagatcgtgccackgtactccagcctgggcgacagagcgagactccatcgcaaaaaaaaaaaaaaaaaagtcctgacaagaccccagtttgtttgtcccttaggaactcagcaccaagggtcttcgggaagcaccatggttaggagttaggctcaagtgagacagacctaggcttcgatccctactttgccaagggccaactactggacctcaggcaagtgatttcatctcactgagcctcagtttcccccccgtaaaggggaattactttacaggatcacacaagctaatctaggtaaagccttggcacagtg

SEQ ID NO: 167909 - DNA, 601 bp, Human
aaactctggcaggagtggctgagaagggcagataggggagggggtgcaatattaaggttgaattagaaaactggccttcctctcttttactctgtaagtgctcagggacagggagagccgccccctcccaccccaagtctggaggtcagctggagacctagggtcccagaagaatgctgggactgttcacctccctgaacctcagtttcttcatctatgaaatggggacaaaatgattttacttgccatctcaaggtgcagtcgaatgtgaatgcagctgtgtaagctgctaagtgtactwagaagaggtcttgacggccgggtatggtggcttatgcctgtaatcccagcacttttgggaggccgaggcaggcggatcacctgaggccaggagttcgagaccagcctggccaacatggcaaaaccccgtctctactaaaaatacaaaaaattagccaggtgtggtggctggcacctgtaatcccagctacttgggaggctggggcaggagaactgcttgaacccgggaggcggaggctgcagtgagttgagatcgtgccactgtactccagcctgggcgacagagcgagactccatcgca

SEQ ID NO: 167910 - DNA, 601 bp, Human; identical to SEQ ID NO: 27495

SEQ ID NO: 167911 - DNA, 601 bp, Human; identical to SEQ ID NO: 27496

SEQ ID NO: 167912 - DNA, 601 bp, Human; identical to SEQ ID NO: 27497

SEQ ID NO: 167913 - DNA, 601 bp, Human; identical to SEQ ID NO: 27498

SEQ ID NO: 167914 - DNA, 601 bp, Human; identical to SEQ ID NO: 27499

SEQ ID NO: 167915 - DNA, 601 bp, Human; identical to SEQ ID NO: 27500

SEQ ID NO: 167916 - DNA, 601 bp, Human; identical to SEQ ID NO: 27501

SEQ ID NO: 167917 - DNA, 601 bp, Human; identical to SEQ ID NO: 27502

SEQ ID NO: 167918 - DNA, 601 bp, Human; identical to SEQ ID NO: 27503

SEQ ID NO: 167919 - DNA, 601 bp, Human
gtatgcatacagtataattggtttgtaaagtttcaaaaaagacagagaactctaaccacgtatttcaggatttggtggttcttctagacaccagcctccttcaaacctctggtgttgtaggctagaagggacttaggaaccatctagtattctctttccagagctaaagacgtggaagccctggataaggagtaagttgtctgaggccacccagctagtcagttcaaaaccaggaccagctctcccgtggcctggtgttcagggtagtgctcactcttgaccactggctggctctttgatyttctgatctccagctaactgtggggcctgtctgcagtggatcccatgcttcagggtgcatagtgacgtgcccttggctctccctgactgcctttcctgccctggctcctcagacatttccagtcactccggtgggctcctaccacccacatccctgatgtcctctcctgcaaacctgcctctgcctcagggcctctgaggccccaagagtcctgcctgggggaccccaggaagggacgctcaggaggactcttccctttgctctggagcctgtttcaggaaaaagtggtgcttgctctat

SEQ ID NO: 167920 - DNA, 601 bp, Human
catataacaaggactattagctgtttttaataagagagccctgaagtttcattctactaaatatctggtgattggtaacctagtggtagagtccagtaaagggaatcaaggtgccatccagctgcgccagatgtgcacaggaacagtattgcagtatttggttaagtctaaaagagtttagaaaataacccctccccacctgccttacttgagcaatagtttggcttagcccacctctttcatttctctaacttaagtgattatcagcctgaggctggccaagatgggtatgcatacagtmtaattggtttgtaaagtttcaaaaaagacagagaactctaaccacgtatttcaggatttggtggttcttctagacaccagcctccttcaaacctctggtgttgtaggctagaagggacttaggaaccatctagtattctctttccagagctaaagacgtggaagccctggataaggagtaagttgtctgaggccacccagctagtcagttcaaaaccaggaccagctctcccgtggcctggtgttcagggtagtgctcactcttgaccactggctggctctttgattttctgatctccag

SEQ ID NO: 167921 - DNA, 601 bp, Human
gttgtgaagaacaaacgaattaccaagatagtacatataaagtgttcatataacaaggactattagctgtttttaataagagagccctgaagtttcattctactaaatatctggtgattggtaacctagtggtagagtccagtaaagggaatcaaggtgccatccagctgcgccagatgtgcacaggaacagtattgcagtatttggttaagtctaaaagagtttagaaaataacccctccccacctgccttacttgagcaatagtttggcttagcccacctctttcatttctctaacttragtgattatcagcctgaggctggccaagatgggtatgcatacagtataattggtttgtaaagtttcaaaaaagacagagaactctaaccacgtatttcaggatttggtggttcttctagacaccagcctccttcaaacctctggtgttgtaggctagaagggacttaggaaccatctagtattctctttccagagctaaagacgtggaagccctggataaggagtaagttgtctgaggccacccagctagtcagttcaaaaccaggaccagctctcccgtggcctggtgttcagggtagt

SEQ ID NO: 167922 - DNA, 601 bp, Human
ttgctgaacagtgtccgagcattccatggctccaaaccatttcttaaataaggacaggtgctcaaaaagtgcaaattttttttccctttcccagacctctctcctataggtcacgctgacatcttacattccatgaagaggatggtgagatcgaagagccagccaggtgtggcagagggtaagcgctttgagaatctctgcagccacaggaggctgtaaagcaatgcgctttagcaagctttctctggaagcaggcagcctgcgctcaaattccgtctcccctaattatgagtgtgtggcyttgagcaagttacctggcctttttacagcttggtttcttcatctgtaaaatgagggtagccaacaaggatggctgggcagccaataggcttgttgtgaagaacaaacgaattaccaagatagtacatataaagtgttcatataacaaggactattagctgtttttaataagagagccctgaagtttcattctactaaatatctggtgattggtaacctagtggtagagtccagtaaagggaatcaaggtgccatccagctgcgccagatgtgcacaggaacagtattgcagtatttggtt

SEQ ID NO: 167923 - DNA, 601 bp, Human
aggtgggttatttgacctcactcattggcaggtccaggaaacatggagtcaactgtcccacagttcagacgatgaacactctccaccctcccagcccctgtttgatactgtgcaatctttagaaaaagagaagccaaaaaccatgccagccaggatcagaagcagccctggaactgcccctttaaaggaccagtatgatgatttcaggattcagacaacttgctgtgttttctttctgcctttgctgaacagtgtccgagcattccatggctccaaaccatttcttaaataaggacaggtrctcaaaaagtgcaaattttttttccctttcccagacctctctcctataggtcacgctgacatcttacattccatgaagaggatggtgagatcgaagagccagccaggtgtggcagagggtaagcgctttgagaatctctgcagccacaggaggctgtaaagcaatgcgctttagcaagctttctctggaagcaggcagcctgcgctcaaattccgtctcccctaattatgagtgtgtggccttgagcaagttacctggcctttttacagcttggtttcttcatctgtaaaatgagggtag

SEQ ID NO: 167924 - DNA, 601 bp, Human
ttcacatcagagaggtgggttatttgacctcactcattggcaggtccaggaaacatggagtcaactgtcccacagttcagacgatgaacactctccaccctcccagcccctgtttgatactgtgcaatctttagaaaaagagaagccaaaaaccatgccagccaggatcagaagcagccctggaactgcccctttaaaggaccagtatgatgatttcaggattcagacaacttgctgtgttttctttctgcctttgctgaacagtgtccgagcattccatggctccaaaccatttcttaartaaggacaggtgctcaaaaagtgcaaattttttttccctttcccagacctctctcctataggtcacgctgacatcttacattccatgaagaggatggtgagatcgaagagccagccaggtgtggcagagggtaagcgctttgagaatctctgcagccacaggaggctgtaaagcaatgcgctttagcaagctttctctggaagcaggcagcctgcgctcaaattccgtctcccctaattatgagtgtgtggccttgagcaagttacctggcctttttacagcttggtttcttcatctgta

SEQ ID NO: 167925 - DNA, 601 bp, Human
tatgcccattgtacagacaagggagtcagaataagaaccagagaggttgccagactcttaagttccagcttcgtgcattctaccagcggcctcacagggttactcgggtagcagtgtgcaggatggaggagagaggacaggcaggacaggaacgtggcagctactatagtcatccaggagagaagttaaggtggcacaatgagggccggaacgttacgggagtgaggcaggatagtgggtcagaagaggggctgagctggagctccttctctcttctccatggggctcagagcacttcttrttcattcacatcagagaggtgggttatttgacctcactcattggcaggtccaggaaacatggagtcaactgtcccacagttcagacgatgaacactctccaccctcccagcccctgtttgatactgtgcaatctttagaaaaagagaagccaaaaaccatgccagccaggatcagaagcagccctggaactgcccctttaaaggaccagtatgatgatttcaggattcagacaacttgctgtgttttctttctgcctttgctgaacagtgtccgagcattccatggctccaaaccatttc

SEQ ID NO: 167926 - DNA, 601 bp, Human
tagaattatagaaattttgaattgaacattcccctacccctatgcccattgtacagacaagggagtcagaataagaaccagagaggttgccagactcttaagttccagcttcgtgcattctaccagcggcctcacagggttactcgggtagcagtgtgcaggatggaggagagaggacaggcaggacaggaacgtggcagctactatagtcatccaggagagaagttaaggtggcacaatgagggccggaacgttacgggagtgaggcaggatagtgggtcagaagaggggctgagctggrgctccttctctcttctccatggggctcagagcacttcttattcattcacatcagagaggtgggttatttgacctcactcattggcaggtccaggaaacatggagtcaactgtcccacagttcagacgatgaacactctccaccctcccagcccctgtttgatactgtgcaatctttagaaaaagagaagccaaaaaccatgccagccaggatcagaagcagccctggaactgcccctttaaaggaccagtatgatgatttcaggattcagacaacttgctgtgttttctttctgcctttg

SEQ ID NO: 167927 - DNA, 601 bp, Human
gaaagaagcatgggacatgttttgggcgcatgaagtaattcaggttccctaccgagtatctgggggtgagtagaggaagagctgtgaatgacattatgtaaagtctttgatgtcagaatgaagtgtttatactcaacactaaaagcaatgagactactaaaggtttttggaagaagggagaaaaaccatagaattatagaaattttgaattgaacattcccctacccctatgcccattgtacagacaagggagtcagaataagaaccagagaggttgccagactcttaagttccagcttcrtgcattctaccagcggcctcacagggttactcgggtagcagtgtgcaggatggaggagagaggacaggcaggacaggaacgtggcagctactatagtcatccaggagagaagttaaggtggcacaatgagggccggaacgttacgggagtgaggcaggatagtgggtcagaagaggggctgagctggagctccttctctcttctccatggggctcagagcacttcttattcattcacatcagagaggtgggttatttgacctcactcattggcaggtccaggaaacatggagtcaactgt

SEQ ID NO: 167928 - DNA, 601 bp, Human
atgattttgatctgcagtggcaggaaataaggaggcagttttggtggggggattatcataaacaaaagcatagaattagaaagaagcatgggacatgttttgggcgcatgaagtaattcaggttccctaccgagtatctgggggtgagtagaggaagagctgtgaatgacattatgtaaagtctttgatgtcagaatgaagtgtttatactcaacactaaaagcaatgagactactaaaggtttttggaagaagggagaaaaaccatagaattatagaaattttgaattgaacattccccyacccctatgcccattgtacagacaagggagtcagaataagaaccagagaggttgccagactcttaagttccagcttcgtgcattctaccagcggcctcacagggttactcgggtagcagtgtgcaggatggaggagagaggacaggcaggacaggaacgtggcagctactatagtcatccaggagagaagttaaggtggcacaatgagggccggaacgttacgggagtgaggcaggatagtgggtcagaagaggggctgagctggagctccttctctcttctccatggggctcagagcac

SEQ ID NO: 167929 - DNA, 601 bp, Human
aagtggcatttgaggtgagacttggggaatgaacatgattttgatctgcagtggcaggaaataaggaggcagttttggtggggggattatcataaacaaaagcatagaattagaaagaagcatgggacatgttttgggcgcatgaagtaattcaggttccctaccgagtatctgggggtgagtagaggaagagctgtgaatgacattatgtaaagtctttgatgtcagaatgaagtgtttatactcaacactaaaagcaatgagactactaaaggtttttggaagaagggagaaaaaccayagaattatagaaattttgaattgaacattcccctacccctatgcccattgtacagacaagggagtcagaataagaaccagagaggttgccagactcttaagttccagcttcgtgcattctaccagcggcctcacagggttactcgggtagcagtgtgcaggatggaggagagaggacaggcaggacaggaacgtggcagctactatagtcatccaggagagaagttaaggtggcacaatgagggccggaacgttacgggagtgaggcaggatagtgggtcagaagaggggctgagctgga

SEQ ID NO: 167930 - DNA, 601 bp, Human
agaccaatggactatgcattcatgccttcttcaaactcactttctgcgaaaccaggctccttccccgtgctggcagaagtttcaacaggtaagtctatttttaatctggtactagcacacacgatatacaaaataaatttgtatgacaaatatattatctggtccctatccctgtaatgttctttgtgaattttttaaaaataggactggtcctatttgcattaatagacaaggaagctcaaagcaagctgaattaaaactgggctcctcactattgggttatcccgcagtcaaaggttastgatcttccaaatttttcacctctcttgaccttaaagatttcaaatacttcaaaaatccaattatctcttaacaaatagttcacaagtgtttatgcaaggtactgaacatggttcacaggtgaatgagacactgtccctgccttcatggagcttccattctaatggggtgttagataagcatttggaacaccataatacaaagtagcataagaggaaggctattgggattcaaaggtcaaatagactactcaaaagaaaaaaagtatattcagctggtgaaaccatggacaggtgtatgg

SEQ ID NO: 167931 - DNA, 601 bp, Human
tgaaatgttatgacgcctgcctgatttttcaggcaatttctcatataataaaaaccaatgccaattattcagcatttagctcacttaactgaagcatcacaagagcagctgtgatcttgaagcttaagtacatgagctgaaaaggaaggagagacatttttctatttcaaaaatgtgtaataggatcatggaattcgggttccagtcttggcccttctactgagctagctgtataaccttagccaaacctctctgaactttggtttcttcttcatcttaaaagaaggcatagatttagatsaaagattaacttgggttccaaggaaaagtatcaggaggtctcaatgaggtcttaaatattattggcaaatttgatgtatacatgtctttttctaagaagttggttttgtgattttcatcagattctacaaagggtctgggactcaaaattttaagaacgattgatttaaacagtctcttagttttcctccagttctggcaatctttgactctacctttaaaaaatatccatcatcactagatgcattcatgaaataatactcatgtgtaccctgcccagataagcacaagacaaaaatag

SEQ ID NO: 167932 - DNA, 601 bp, Human
attaattcctttctcctgaatacaccagacatacatgacactgcagagttcctaggacttccagttacgttggcaaaattgaaatgttatgacgcctgcctgatttttcaggcaatttctcatataataaaaaccaatgccaattattcagcatttagctcacttaactgaagcatcacaagagcagctgtgatcttgaagcttaagtacatgagctgaaaaggaaggagagacatttttctatttcaaaaatgtgtaataggatcatggaattcgggttccagtcttggcccttctactragctagctgtataaccttagccaaacctctctgaactttggtttcttcttcatcttaaaagaaggcatagatttagatgaaagattaacttgggttccaaggaaaagtatcaggaggtctcaatgaggtcttaaatattattggcaaatttgatgtatacatgtctttttctaagaagttggttttgtgattttcatcagattctacaaagggtctgggactcaaaattttaagaacgattgatttaaacagtctcttagttttcctccagttctggcaatctttgactctacctttaaa

SEQ ID NO: 167933 - DNA, 601 bp, Human
cccacatctttgggactttgagtattaattcctttctcctgaatacaccagacatacatgacactgcagagttcctaggacttccagttacgttggcaaaattgaaatgttatgacgcctgcctgatttttcaggcaatttctcatataataaaaaccaatgccaattattcagcatttagctcacttaactgaagcatcacaagagcagctgtgatcttgaagcttaagtacatgagctgaaaaggaaggagagacatttttctatttcaaaaatgtgtaataggatcatggaattcggrttccagtcttggcccttctactgagctagctgtataaccttagccaaacctctctgaactttggtttcttcttcatcttaaaagaaggcatagatttagatgaaagattaacttgggttccaaggaaaagtatcaggaggtctcaatgaggtcttaaatattattggcaaatttgatgtatacatgtctttttctaagaagttggttttgtgattttcatcagattctacaaagggtctgggactcaaaattttaagaacgattgatttaaacagtctcttagttttcctccagttctgg

SEQ ID NO: 167934 - DNA, 601 bp, Human
tcatgtgctaccaattgccatgagtgaacagtgcctgaaaaaatcaataagcagggtaacacccatctgttcctgatgacaaccacatctggaccagccagaaaattctcagaattaaaaaaaattcagagaatgttactggtataaggaaacttagagataaccttaatctcatattttcattttacaaaggagaaaactaaggctcagagtggtatgattttcctaggctcacccagaagaaatgattaaggagctaaagctattgatttccagtcctgttccttgtacacatacaccmacatctttgggactttgagtattaattcctttctcctgaatacaccagacatacatgacactgcagagttcctaggacttccagttacgttggcaaaattgaaatgttatgacgcctgcctgatttttcaggcaatttctcatataataaaaaccaatgccaattattcagcatttagctcacttaactgaagcatcacaagagcagctgtgatcttgaagcttaagtacatgagctgaaaaggaaggagagacatttttctatttcaaaaatgtgtaataggatcatggaattcgggtt

SEQ ID NO: 167935 - DNA, 601 bp, Human
tcggaaggcaggggttgcagtgagtggagactgtgccactgcactctagcctaggtgacagaacaagactctgtctcaaaaaaaaaaaaaaaaaaaacaaagctcctgcttacaaatagttttataccgtagcccctctgcactgaagtctatcctaggtgtccatgcttgaggctgttctgtaggtaaccctgcttaagatgaggtccttttggtgagtatttcagttactgaacttcctgggtggggggatcgggccatcaccctgaacctgaatggtgctccatggctaacagtgcckcagggcagttccaggatggagattactactgttttcttccaattagttcgttgacccttcttggtttatcatcatgtgctaccaattgccatgagtgaacagtgcctgaaaaaatcaataagcagggtaacacccatctgttcctgatgacaaccacatctggaccagccagaaaattctcagaattaaaaaaaattcagagaatgttactggtataaggaaacttagagataaccttaatctcatattttcattttacaaaggagaaaactaaggctcagagtggtatgattttcctag

SEQ ID NO: 167936 - DNA, 601 bp, Human
gaaaatggccaggcacggtggctaatgcctgtaatcccagcccattgggaggccgatgatcacttggggtcaggagtttgagaccagcctggcaaacatggtgaaaccccatctctattaaaaatacaaaaaattagctgggcgtgatggtgggtgcctgtaatcccagctactcaggaggctgaggcaggagaatcgcttgaactcggaaggcaggggttgcagtgagtggagactgtgccactgcactctagcctaggtgacagaacaagactctgtctcaaaaaaaaaaaaaaaaaaaacaaagctcctgcttacaaatagttttataccgtagcccctctgcactgaagtctatcctaggtgtccatgcttgaggctgttctgtaggtaaccctgcttaagatgaggtccttttggtgagtatttcagttactgaacttcctgggtggggggatcgggccatcaccctgaacctgaatggtgctccatggctaacagtgccgcagggcagttccaggatggagattactactgttttcttccaattagttcgttgacccttcttggtttatcatcatgtgctaccaattgccatgag

SEQ ID NO: 167937 - DNA, 601 bp, Human
gtagaagaaaatggccaggcacggtggctaatgcctgtaatcccagcccattgggaggccgatgatcacttggggtcaggagtttgagaccagcctggcaaacatggtgaaaccccatctctattaaaaatacaaaaaattagctgggcgtgatggtgggtgcctgtaatcccagctactcaggaggctgaggcaggagaatcgcttgaactcggaaggcaggggttgcagtgagtggagactgtgccactgcactctagcctaggtgacagaacaagactctgtctcaaaaaaaaaaaamaaaaaaacaaagctcctgcttacaaatagttttataccgtagcccctctgcactgaagtctatcctaggtgtccatgcttgaggctgttctgtaggtaaccctgcttaagatgaggtccttttggtgagtatttcagttactgaacttcctgggtggggggatcgggccatcaccctgaacctgaatggtgctccatggctaacagtgccgcagggcagttccaggatggagattactactgttttcttccaattagttcgttgacccttcttggtttatcatcatgtgctaccaattgc

SEQ ID NO: 167938 - DNA, 601 bp, Human
atataatcccctgtcagagtactacaagtgggctggtaatatatacatctcatatttcaaaatccaaccacaagttcaaatctaggcaaggaatccattaagctgtacatttactaggtatgctttatatgcacattttgccttaattttaaaagtagaagaaaatggccaggcacggtggctaatgcctgtaatcccagcccattgggaggccgatgatcacttggggtcaggagtttgagaccagcctggcaaacatggtgaaaccccatctctattaaaaatacaaaaaattagctgrgcgtgatggtgggtgcctgtaatcccagctactcaggaggctgaggcaggagaatcgcttgaactcggaaggcaggggttgcagtgagtggagactgtgccactgcactctagcctaggtgacagaacaagactctgtctcaaaaaaaaaaaaaaaaaaaacaaagctcctgcttacaaatagttttataccgtagcccctctgcactgaagtctatcctaggtgtccatgcttgaggctgttctgtaggtaaccctgcttaagatgaggtccttttggtgagtatttcagttactgaac

SEQ ID NO: 167939 - DNA, 601 bp, Human
tttcagaataaccatgtgtctcctggtaagtggaaaacacatggtttttggaatccaaagtcctgggttggtgtcctagctcagctgtttactcgcagtgtattctagagaaagaagctcactttacttctctgagcctccatttatgtatctgtgaaatggagtaataataatacttactctcaaagagtgatttgaggtgagataaggtatgttaatatacttcgtaaactactaaaccttgtacaaatgttagaaattaattatactgtcataatattcctgcccatataatcccctstcagagtactacaagtgggctggtaatatatacatctcatatttcaaaatccaaccacaagttcaaatctaggcaaggaatccattaagctgtacatttactaggtatgctttatatgcacattttgccttaattttaaaagtagaagaaaatggccaggcacggtggctaatgcctgtaatcccagcccattgggaggccgatgatcacttggggtcaggagtttgagaccagcctggcaaacatggtgaaaccccatctctattaaaaatacaaaaaattagctgggcgtgatggtgg

SEQ ID NO: 167940 - DNA, 601 bp, Human
cttgatttcagaataaccatgtgtctcctggtaagtggaaaacacatggtttttggaatccaaagtcctgggttggtgtcctagctcagctgtttactcgcagtgtattctagagaaagaagctcactttacttctctgagcctccatttatgtatctgtgaaatggagtaataataatacttactctcaaagagtgatttgaggtgagataaggtatgttaatatacttcgtaaactactaaaccttgtacaaatgttagaaattaattatactgtcataatattcctgcccatataatmccctgtcagagtactacaagtgggctggtaatatatacatctcatatttcaaaatccaaccacaagttcaaatctaggcaaggaatccattaagctgtacatttactaggtatgctttatatgcacattttgccttaattttaaaagtagaagaaaatggccaggcacggtggctaatgcctgtaatcccagcccattgggaggccgatgatcacttggggtcaggagtttgagaccagcctggcaaacatggtgaaaccccatctctattaaaaatacaaaaaattagctgggcgtgat

SEQ ID NO: 167941 - DNA, 601 bp, Human
catatgaggtgagtcatacccaatccataaacctcatcatccacagtctcaggatagtgtcagcaagggaagctcatgcatctgaccccaaagcatctgacctcttggacactagaagggtcttctgacgtattagaaggaacactagtaatccatacatgatgtgtgtagaagtagttctcagttataaacaatagtcatccaaacacatttcttaaccattggaatggagtgggggaaggggatgggtaataaatgtttagcagaactttccactttggggtttaaagatgaagcctcygcttcagcctgatccactcttctcagtaacacagagccttgatttcagaataaccatgtgtctcctggtaagtggaaaacacatggtttttggaatccaaagtcctgggttggtgtcctagctcagctgtttactcgcagtgtattctagagaaagaagctcactttacttctctgagcctccatttatgtatctgtgaaatggagtaataataatacttactctcaaagagtgatttgaggtgagataaggtatgttaatatacttcgtaaactactaaaccttgtacaaatgttagaa

SEQ ID NO: 167942 - DNA, 601 bp, Human
tcggggtctcagagcccagctaggggcccgaactctagcaggcgcacccgctctgtaattgttttgtgtgagacagcgtgtgcctgaagtaggaaatgttacagcttggatgtaagccctaaagaagatcttaaaagggacatcactgagctgctcccgccatccgtgaaatagaacgcgctcagaggctgctctgtaaacaccaggaggtcagcttagcttggctttttcatcccctacagtctctgtgccttcctcctcctcttcctcctcctcttcctcctcctcttcctcctcttcttcctcctcctcctcctctcctttcttctcctctgccaccgttcgtgacctgaactttccacatcccccttgctgccgctctttacaaaaacccccaatattccacacccactgagggactattctgaagatagttgcccattttctcttctcagtatgggcacaaaggaaacagctttctcccctgcctgctgttgaaacaaaggagcattcagtcttctcaccgccaggctttggctgaggctccacacacagtgacccaaccgactgctgctaacaaaataaaggtttcatctcggct

SEQ ID NO: 167943 - DNA, 601 bp, Human
ttttgtacgatcggggtctcagagcccagctaggggcccgaactctagcaggcgcacccgctctgtaattgttttgtgtgagacagcgtgtgcctgaagtaggaaatgttacagcttggatgtaagccctaaagaagatcttaaaagggacatcactgagctgctcccgccatccgtgaaatagaacgcgctcagaggctgctctgtaaacaccaggaggtcagcttagcttggctttttcatcccctacagtctctgtgccttcctcctcctcttcctcctcctcttcctcctcctcttcctcctcttcttcctcctcctcctcctctcctttcttctcctctgccaccgttcgtgacctgaactttccacatcccccttgctgccgctctttacaaaaacccccaatattccacacccactgagggactattctgaagatagttgcccattttctcttctcagtatgggcacaaaggaaacagctttctcccctgcctgctgttgaaacaaaggagcattcagtcttctcaccgccaggctttggctgaggctccacacacagtgacccaaccgactgctgctaacaaaataaaggttt

SEQ ID NO: 167944 - DNA, 601 bp, Human
ctaggatggaataccttacctcttatgtctcacttttgtatcctgtaatatagggacaataataccaatctcacaggttgtttaagaatataagaaattacttgtctggaagtccctagcacaatgcctagtccatagtacttgctcagttaaacattacttaacactgaaagcagaaacgaaccaaccagttataagcccaggctggggcagcctaagttggcacaggcactcgggggcatgagtcaagagggtagaacccaggaaaagaagactcacagctgtgatatgccaagcagcrtagaagggcacctcttgcctagggctaaataacacaaaaagttgctctcccagagtagctgtggagagttggggcacaatttgtgagcttttttttttttttgagatggtgtctcactctgtcacccagaggctggaatgcagtggcgtgatctcaactcactgctgcaatctccgcctcccaggtttgaatgattctcctgcctcaagctcccgagtagctgggattacaggcgtgcgtcaccacaccaggctcatttttatatttttagtagagacagggtttcgccatgttggccag

SEQ ID NO: 167945 - DNA, 601 bp, Human
ctggcccaggacttcattctgagtgggaattctaggctcgcaggaatctgggacaccagtttagccctctttaatgaggagaaaaaatcgcactttgctgttcaggtcagtgggaagaaaaaaacaaacagatttttcttctcaccttgaggttttcctttcctcctatttaaaaagcaaacataattcaacacatcttgtatttgggtgtagggctcattggagtttaattttgatcaggacaaatgactgcctggaaactgggggtgaggaacttgcagctcccacaggccaggcctcycagtggcctcctgtctgtctgtgtgtcactgtacctatgtgacctggctgcctcgtcatgcctacttcccagatcagtgctgaagagggcaaactctgctcgcgtctgctgttttgctctattcaagctgtacagcctaggatggaataccttacctcttatgtctcacttttgtatcctgtaatatagggacaataataccaatctcacaggttgtttaagaatataagaaattacttgtctggaagtccctagcacaatgcctagtccatagtacttgctcagttaaacattacttaa

SEQ ID NO: 167946 - DNA, 601 bp, Human
ccaggggagagagagagagagagagagcaggaggaaggtcaggctgaggcagcagcatgtggggacggtcacctgcattcctcagggcttgggaagctgcaggactccgggaacagggtgtgagaggcagtggagcagagaaggaggctgcggagaggtggcctcgtttccggcctcccctccctggggatggagcggaggcaaggcgggagccggctgcccttccctattggtgggagtggagtcgggtagagctcccccaggggaaggcagatgggtaccaggcctccgctgaaaaccyggactctgcctgcctggcccaggacttcattctgagtgggaattctaggctcgcaggaatctgggacaccagtttagccctctttaatgaggagaaaaaatcgcactttgctgttcaggtcagtgggaagaaaaaaacaaacagatttttcttctcaccttgaggttttcctttcctcctatttaaaaagcaaacataattcaacacatcttgtatttgggtgtagggctcattggagtttaattttgatcaggacaaatgactgcctggaaactgggggtgaggaacttgcagctccca

SEQ ID NO: 167947 - DNA, 601 bp, Human
tggcgccaggggagagagagagagagagagagcaggaggaaggtcaggctgaggcagcagcatgtggggacggtcacctgcattcctcagggcttgggaagctgcaggactccgggaacagggtgtgagaggcagtggagcagagaaggaggctgcggagaggtggcctcgtttccggcctcccctccctggggatggagcggaggcaaggcgggagccggctgcccttccctattggtgggagtggagtcgggtagagctcccccaggggaaggcagatgggtaccaggcctccgctgamaacccggactctgcctgcctggcccaggacttcattctgagtgggaattctaggctcgcaggaatctgggacaccagtttagccctctttaatgaggagaaaaaatcgcactttgctgttcaggtcagtgggaagaaaaaaacaaacagatttttcttctcaccttgaggttttcctttcctcctatttaaaaagcaaacataattcaacacatcttgtatttgggtgtagggctcattggagtttaattttgatcaggacaaatgactgcctggaaactgggggtgaggaacttgcagc

SEQ ID NO: 167948 - DNA, 601 bp, Human
ctgagggcaggccaatttggcgccaggggagagagagagagagagagagcaggaggaaggtcaggctgaggcagcagcatgtggggacggtcacctgcattcctcagggcttgggaagctgcaggactccgggaacagggtgtgagaggcagtggagcagagaaggaggctgcggagaggtggcctcgtttccggcctcccctccctggggatggagcggaggcaaggcgggagccggctgcccttccctattggtgggagtggagtcgggtagagctcccccaggggaaggcagatgggkaccaggcctccgctgaaaacccggactctgcctgcctggcccaggacttcattctgagtgggaattctaggctcgcaggaatctgggacaccagtttagccctctttaatgaggagaaaaaatcgcactttgctgttcaggtcagtgggaagaaaaaaacaaacagatttttcttctcaccttgaggttttcctttcctcctatttaaaaagcaaacataattcaacacatcttgtatttgggtgtagggctcattggagtttaattttgatcaggacaaatgactgcctggaaactggg

SEQ ID NO: 167949 - DNA, 601 bp, Human
agccttacctggcaaccatctttcagggaaagctcactgactgcccacccgatgtgctggggtggggatgaaacacagaagccataagccagcacagagccctgctgagtgcggtggggtgtggctgccactcataatggggctcctggtcatgtggggcagtaggatgagtaatgattcaggagccagaagacctggcttcgagttttgatttgactaactggctgtggtaacaccagaaaaatttcttaacctctctgatcctcatctgcaaaatgaaggctgtcatctgtctcataaygttatcttgaagattaaatgtgctaacatagggataagcacttagcctagaaatcatattttaattaattaattattactttttttgattaatttcgctttgtcgcccaggctggagtgcagtggtgtgatctcagctcactgcaacctctgcctcccgggttcaagtgattattctgcctcagcctcctgagtagctgggactacaggcacgtgccaccacgccaggctaatttttgtatttttagtagagatggggtttcaccatgttggccaggctggtctcgaactccctgacctc

SEQ ID NO: 167950 - DNA, 601 bp, Human
acaagctccctggtgaaaccactgctgctagtctgagggtcactttttttgctgttgtttgtttgtttgacagagtcttgctctgttgcccaggctagagtgcagtggcgggatctcggctcactgcaacctccatctcccgggttcaagtgattttcctgcctcagcctcctgagtagctgggattacaggcacccaccatcatgcctggctaatttttgtatttttagtaaagacagggtttcactatgttggccagactggtctcgaactcctgacctcaagtgattcacctacctcrgcctcccaaagtgctggaattacaagtgtgagccactgcacctggcctgagggtcactctttgagtagcaagatactctactactagggtgaccaattaaatggctttcttgggactgtcccagttttagcactgagaatcctgcattccatgtcctgaggaacccacaggacatgggcaaacaggatgcttggtcactgtatgcgtgaaacaaatctcaaatctcaaatcttcccagagaagacagccttacctggcaaccatctttcagggaaagctcactgactgcccacccgatgt

SEQ ID NO: 167951 - DNA, 601 bp, Human
ttaaccgtgaaataactcaatgcccacacaccctcacccagcactcacgcaccctccagcctttcattccatttggactgaatgtggacccttaactcctttcttcctcagtttataaacctaagtcttttgtgccaatgtgcatcacctgaggtatatagcaaagccataacatataaaatgcaagcttagaaaagtgaggatgtcacctctctcaggtcagatgattcaggtatgaatcttcatttccataacttctgtcaaatgtgccttcagtacttgctcttctataatgtttttycccttccatggggatcttgctaaaatgtgcattctggttcagtgggtctggagttagtgggtctgagattctgcatttccaacaagctccctggtgaaaccactgctgctagtctgagggtcactttttttgctgttgtttgtttgtttgacagagtcttgctctgttgcccaggctagagtgcagtggcgggatctcggctcactgcaacctccatctcccgggttcaagtgattttcctgcctcagcctcctgagtagctgggattacaggcacccaccatcatgcctggctaatttt

SEQ ID NO: 167952 - DNA, 601 bp, Human
cttctgtttccatccgagcgaggtcatcaccacagggtaggacaggctggggaaccatgaataactcatttccaaatctgggttagactcttgcagcagggaagggacctacaaattttcccttctgatctctccttggacagggtgaaaatgagacctagattcagagccaggcatcaaacaggaaaacatgtagtcttggaatacctctttggtggcctaattatttcttcaattataactactgagggtctactcttcaccaagcgtggttcctattatatgctttaccctctgggcrtttatttccctttctgaatcctcaggcccaagaacacaggctactgctgtcctcacacacagtctggtttatttgctgtccactgtgacactccagcccgacctcggcaaaagggtgtaggccagtgaatccagaaaactccaaggccttcgtaagaacatcatcatttcaaagacgcaagaaaggcttaaccgtgaaataactcaatgcccacacaccctcacccagcactcacgcaccctccagcctttcattccatttggactgaatgtggacccttaactcctttcttcctcagtt

SEQ ID NO: 167953 - DNA, 601 bp, Human
tattttaacatctgacagtctggttttagagcaaaacattaacaaaagatgacactcagcacccatttaaaagacttttacagtgactttgacccaggatgacacacagcaccgatttaaaagaccgaacaactgctctgacccaagtttgctttgagataagccaagaccctagagaagctggtgaagcatcctgcgaagagctggccaaccactttctcacctggagcacagattccatcacttctgtttccatccgagcgaggtcatcaccacagggtaggacaggctggggaaccaygaataactcatttccaaatctgggttagactcttgcagcagggaagggacctacaaattttcccttctgatctctccttggacagggtgaaaatgagacctagattcagagccaggcatcaaacaggaaaacatgtagtcttggaatacctctttggtggcctaattatttcttcaattataactactgagggtctactcttcaccaagcgtggttcctattatatgctttaccctctgggcgtttatttccctttctgaatcctcaggcccaagaacacaggctactgctgtcctcaca

SEQ ID NO: 167954 - DNA, 601 bp, Human
tttgtctgaaacagctcgaactgaacggatgaacacattcatttccaggcctgcctgtcattccctcccctgggctgcccttattttgggctccctactgggcatgtgacttggaatagagagaaagtcgacaaatgtgggttatgcttcttttagttcaaggctgctccgcaatcctagaaatacaaatgtcttttcctaccttgcttggtgcctgctattttaacatctgacagtctggttttagagcaaaacattaacaaaagatgacactcagcacccatttaaaagacttttacartgactttgacccaggatgacacacagcaccgatttaaaagaccgaacaactgctctgacccaagtttgctttgagataagccaagaccctagagaagctggtgaagcatcctgcgaagagctggccaaccactttctcacctggagcacagattccatcacttctgtttccatccgagcgaggtcatcaccacagggtaggacaggctggggaaccatgaataactcatttccaaatctgggttagactcttgcagcagggaagggacctacaaattttcccttctgatctctccttgga

SEQ ID NO: 167955 - DNA, 601 bp, Human
ccctcaaggtgctggtatttggaggtggggccttggggactgattaggtcatgagagcagagccttagaaacgaagccccagagagctcccttaccccttccaccacgtggctctctatgaacgaggaagcaggccctcaccagacacctaacctgttgtgccttgctcttggacttcccaacctccagaactgtgaggaatacatttctgttgtttataagtcacccagtctacagtaatttgttaagcagcctgaacagacaaaaacagaaatgcataggagtaaaaaaaaaaaaaaaagacactgataagtgttagggagaaaatataacaaggcaaagtgatagtgactaggcagagtccctggttagctggggcaggggtgagagagggtttcaggaaagcgctcactgaggtggtgtttgcactgaaacctgaaaggcaaggagccagccttgcagccatctggggaaagagcattcctgggcaagggaaaaacaagcgcaaagactctgagacagaaaccactttggcatcttcaagggcagaggcttgggcagagtcagactgtgtgggaagctggatgcctggagagaaggt

SEQ ID NO: 167956 - DNA, 601 bp, Human
cggtctaatgtgtgtgtttcccacaaagctcatatgttgaaatcctaaccctcaaggtgctggtatttggaggtggggccttggggactgattaggtcatgagagcagagccttagaaacgaagccccagagagctcccttaccccttccaccacgtggctctctatgaacgaggaagcaggccctcaccagacacctaacctgttgtgccttgctcttggacttcccaacctccagaactgtgaggaatacatttctgttgtttataagtcacccagtctacagtaatttgttaagcagyctgaacagacaaaaacagaaatgcataggagtaaaaaaaaaaaaaaaagacactgataagtgttagggagaaaatataacaaggcaaagtgatagtgactaggcagagtccctggttagctggggcaggggtgagagagggtttcaggaaagcgctcactgaggtggtgtttgcactgaaacctgaaaggcaaggagccagccttgcagccatctggggaaagagcattcctgggcaagggaaaaacaagcgcaaagactctgagacagaaaccactttggcatcttcaagggcagaggc

SEQ ID NO: 167957 - DNA, 601 bp, Human
tcggtctaatgtgtgtgtttcccacaaagctcatatgttgaaatcctaaccctcaaggtgctggtatttggaggtggggccttggggactgattaggtcatgagagcagagccttagaaacgaagccccagagagctcccttaccccttccaccacgtggctctctatgaacgaggaagcaggccctcaccagacacctaacctgttgtgccttgctcttggacttcccaacctccagaactgtgaggaatacatttctgttgtttataagtcacccagtctacagtaatttgttaagcakcctgaacagacaaaaacagaaatgcataggagtaaaaaaaaaaaaaaaagacactgataagtgttagggagaaaatataacaaggcaaagtgatagtgactaggcagagtccctggttagctggggcaggggtgagagagggtttcaggaaagcgctcactgaggtggtgtttgcactgaaacctgaaaggcaaggagccagccttgcagccatctggggaaagagcattcctgggcaagggaaaaacaagcgcaaagactctgagacagaaaccactttggcatcttcaagggcagagg

SEQ ID NO: 167958 - DNA, 601 bp, Human
gcttacagggcctctatctttgggcaagtcatttaaatcctctgagcctcagtttacgtattggtagaatgaggattggtgctttgtacttcagggtgtggttgtattacatgaggttcacatatatgaaaacgtctagcacagtgtctgttacagataaatttaaaaagtgtttttttagggattgtgtctccctatgttgctcaggctggtctccaactcctggcctcaagcaatcctcctgcctcagcctcccaaagtgctgggattagcaaacatgagccactacacccagcctgayaaatgtttttaaaacatcgctttataaattggaggaccctttacttgtaaggcagttatggccattactaatatttgttacctcggttggtggaagatgccaggaagggaaactccagttcagaggagaaagtcctttctcatggaaggagctgcctgagagtggaaagggctttgcaagtattgagcttcctgttgtttgctcaaatggaggatgcatgatcatctttcagaaagggatttctattgggtggaggcgggatagagagatttgtaaaagtttccaacaggtctagctctc

SEQ ID NO: 167959 - DNA, 601 bp, Human
tctgaagaagccaaacagggctgtaaacatggattctgggcctcaagatcaaaacaaatcatcaaactacaaagttgtatgggaatccagaagcaaagggaggatgacaggttctatacagtctggactatagctgagattgcaggcatgagccactgtgcccagccttgagatgccatcctttttgggtttatgacacatgtttaaaacatcttgattgtggtgatgtttcatgggcatatatgaaactcaaccaattatatagtttaaatatgtgcagttcattgtatgttaattataycccaaaaaatcttgtttttatttatttttatttaattattttattatttttaacacggggtctcactctgttgcccaggctggagtctggagtgcagtggcacgatctcggctcactgcaacctccgcctcccgggttcaagcgatacttctacctcggcctccagaggagctgggattacaggcacgtgccactatgctgggctaattttttttgtatttttagtagagatgggtgtcaccatgttggccaggctggtctcgaactcctgacctcaggtgatccacccgcctcagcctc

SEQ ID NO: 167960 - DNA, 601 bp, Human
ggtacttaggccatttagaggcagtcctagagcaggcttctgtctgaattcagagcccttccctcaaaatcctcactgctttggggtgtttttgctcctttgatgcagtgtgtatttgggaggtgcggtcttaggaagcaaaaatgaggcaataggaagcagatgggagggtggggagtggacattggccctgtgcctcctgtctcctgagcatcttcttggaggctctggtgggtcacttcatccttgctgaatcaggaaccctcagctggaggaccaacacgtttgggttacatttacktcatctttcagccccaaggacttaatggtaaatttattcttgaactcacatgaggggttcatgggaatctgaagaagccaaacagggctgtaaacatggattctgggcctcaagatcaaaacaaatcatcaaactacaaagttgtatgggaatccagaagcaaagggaggatgacaggttctatacagtctggactatagctgagattgcaggcatgagccactgtgcccagccttgagatgccatcctttttgggtttatgacacatgtttaaaacatcttgattgtggtgatgtttca

SEQ ID NO: 167961 - DNA, 601 bp, Human
ggaatatagacagtcttagggtaaagatggtacttaggccatttagaggcagtcctagagcaggcttctgtctgaattcagagcccttccctcaaaatcctcactgctttggggtgtttttgctcctttgatgcagtgtgtatttgggaggtgcggtcttaggaagcaaaaatgaggcaataggaagcagatgggagggtggggagtggacattggccctgtgcctcctgtctcctgagcatcttcttggaggctctggtgggtcacttcatccttgctgaatcaggaaccctcagctggmggaccaacacgtttgggttacatttacgtcatctttcagccccaaggacttaatggtaaatttattcttgaactcacatgaggggttcatgggaatctgaagaagccaaacagggctgtaaacatggattctgggcctcaagatcaaaacaaatcatcaaactacaaagttgtatgggaatccagaagcaaagggaggatgacaggttctatacagtctggactatagctgagattgcaggcatgagccactgtgcccagccttgagatgccatcctttttgggtttatgacacatgttt

SEQ ID NO: 167962 - DNA, 601 bp, Human
gtggcatgtggtgtgacagacacaagggtagtgctatgctcagctctaagtcctgccttgaggtttaggacaaagtgggtcattcacttgtccattcaacaagtacccactgagtaccacatgttagccactacagaggatgcaaagaagaatcagatcagcaccatgcctacagagagcttatggtctagaaagtgaaagaatacgtgtgaatcatcacattttgaagggtagcaggtgcgggtgattgttgccataacagaaagttcatgagagcttagagtagacagagattaatttsatggaggggaatatagacagtcttagggtaaagatggtacttaggccatttagaggcagtcctagagcaggcttctgtctgaattcagagcccttccctcaaaatcctcactgctttggggtgtttttgctcctttgatgcagtgtgtatttgggaggtgcggtcttaggaagcaaaaatgaggcaataggaagcagatgggagggtggggagtggacattggccctgtgcctcctgtctcctgagcatcttcttggaggctctggtgggtcacttcatccttgctgaatcaggaaccct

SEQ ID NO: 167963 - DNA, 601 bp, Human
ctgtgagttgcctcaagaaatcttattttagttagttaccaaatgctagccattccctagcactagagtgtaaacttaggccactggtccttgacattttcattgcctcacaggggagtaagaaaaaatatagatgatgtaatctgcatgtgtataaaataaggtgttattaaaatacttagaatagtgtctagtgtacatttagcactcactaagtgttagctattggaaacagagagctgtccatgaatggttgccaactgcctttttatctttgtttttgaaattctgcttctttttmggaataattttaacagcaggatggtagtttgtattttggtttaaaactatagtcaataatattctaaaagtgagcccctgattttgtgcccaagtttatttttgaaattacactagttcctgaaataaaaaaaaaattgagaaacactcatttaggcatgtctgtatttgaaatcacactttgatgtataaagattcctctttgagtgacccaaggaagcttaaccatttgggcgttttgttcaaggaatgagtatctctggaagggaaatggtaggctggtggcccgcaggcaccacta

SEQ ID NO: 167964 - DNA, 601 bp, Human
ggcattgcattggttgacaaaggctgcaagcttatgagtctccgtgtcaactcaatgggttccatatattgaagaaacttgagaggaagatgtttgtcatctagatcctgcatagaaagagctcactctgaaagatcacatcctggcctttgcatcaggtggaaacttgaagattcatagaagttttgactcctgcagctgtgagttgcctcaagaaatcttattttagttagttaccaaatgctagccattccctagcactagagtgtaaacttaggccactggtccttgacattttcaytgcctcacaggggagtaagaaaaaatatagatgatgtaatctgcatgtgtataaaataaggtgttattaaaatacttagaatagtgtctagtgtacatttagcactcactaagtgttagctattggaaacagagagctgtccatgaatggttgccaactgcctttttatctttgtttttgaaattctgcttctttttaggaataattttaacagcaggatggtagtttgtattttggtttaaaactatagtcaataatattctaaaagtgagcccctgattttgtgcccaagtttatttt

SEQ ID NO: 167965 - DNA, 601 bp, Human
taatctagaaattaggaagcacttaggattttttaaatggttatctaagggttatttaattcatcaccctgttactcaacccagcattccttccctggattaaagccatctggtgtgtgctcattgtgaaacatactagtggaatgttaatgcctgtattttggaagcagaggcaaggaaagaggggaaaggggctctctattgcaaaagtggtagcttttctttggtgttttagagacaagatctcgttctgtcacgccagctggagtatggtgatgcaatcacggtttggtgcagcctyaaactcctgagatcaagtgatcctcctgcctctgtctctctagtagccgggactgtgggcctgcaccaccatgcctgacttattaaaaaaaattttttttaagagacggggtgtattagtccattttcacactgctataaagaacttccctgagactgggtaatttataaagaaaggtttaattgacagttctgcgtagctggggaggcctcaggaaactaataatcacggtggaaggggaagcagacaccttcacaaggcagcaagagagagaagagcaaagaaggaacttctaaacac

SEQ ID NO: 167966 - DNA, 601 bp, Human
ccccatgaattttctttaatctagaaattaggaagcacttaggattttttaaatggttatctaagggttatttaattcatcaccctgttactcaacccagcattccttccctggattaaagccatctggtgtgtgctcattgtgaaacatactagtggaatgttaatgcctgtattttggaagcagaggcaaggaaagaggggaaaggggctctctattgcaaaagtggtagcttttctttggtgttttagagacaagatctcgttctgtcacgccagctggagtatggtgatgcaatcayggtttggtgcagccttaaactcctgagatcaagtgatcctcctgcctctgtctctctagtagccgggactgtgggcctgcaccaccatgcctgacttattaaaaaaaattttttttaagagacggggtgtattagtccattttcacactgctataaagaacttccctgagactgggtaatttataaagaaaggtttaattgacagttctgcgtagctggggaggcctcaggaaactaataatcacggtggaaggggaagcagacaccttcacaaggcagcaagagagagaagagcaaaga

SEQ ID NO: 167967 - DNA, 601 bp, Human
atggcataggcaaagatcatctggactaggcgacatcctatcctgaatccagcttctcttccatctggacactaaagctctatctcccaaaatataatatttcatatctaggcctgacattgggtctccttgagttgttttgttaagcactgaaaaaataaataaaagagcctcccacttgcccacttgctgcctccttcctcctttggaagatgtgtctggtctctggggagacttttgcaatggctgaccttgctggtctatccatcttctaaaggcccttctgtctagaggtggcaayctaatgtcctttatattctctcttttttaaggccccatgaattttctttaatctagaaattaggaagcacttaggattttttaaatggttatctaagggttatttaattcatcaccctgttactcaacccagcattccttccctggattaaagccatctggtgtgtgctcattgtgaaacatactagtggaatgttaatgcctgtattttggaagcagaggcaaggaaagaggggaaaggggctctctattgcaaaagtggtagcttttctttggtgttttagagacaagatctcgttct

SEQ ID NO: 167968 - DNA, 601 bp, Human
gaagggatggcataggcaaagatcatctggactaggcgacatcctatcctgaatccagcttctcttccatctggacactaaagctctatctcccaaaatataatatttcatatctaggcctgacattgggtctccttgagttgttttgttaagcactgaaaaaataaataaaagagcctcccacttgcccacttgctgcctccttcctcctttggaagatgtgtctggtctctggggagacttttgcaatggctgaccttgctggtctatccatcttctaaaggcccttctgtctagaggyggcaacctaatgtcctttatattctctcttttttaaggccccatgaattttctttaatctagaaattaggaagcacttaggattttttaaatggttatctaagggttatttaattcatcaccctgttactcaacccagcattccttccctggattaaagccatctggtgtgtgctcattgtgaaacatactagtggaatgttaatgcctgtattttggaagcagaggcaaggaaagaggggaaaggggctctctattgcaaaagtggtagcttttctttggtgttttagagacaagatct

SEQ ID NO: 167969 - DNA, 601 bp, Human
agagcaagctcttcctacacgtaattacatgctccttctactgcactgtgctacctcatatctccctccacatcagttcttttgggaacaggaaatagcttaaaagtgttctgtttcatactatgtataataggaaattctgattgtttccttccttcttattcagggaaacaagatggttaatgggaagggatggcataggcaaagatcatctggactaggcgacatcctatcctgaatccagcttctcttccatctggacactaaagctctatctcccaaaatataatatttcatatckaggcctgacattgggtctccttgagttgttttgttaagcactgaaaaaataaataaaagagcctcccacttgcccacttgctgcctccttcctcctttggaagatgtgtctggtctctggggagacttttgcaatggctgaccttgctggtctatccatcttctaaaggcccttctgtctagaggtggcaacctaatgtcctttatattctctcttttttaaggccccatgaattttctttaatctagaaattaggaagcacttaggattttttaaatggttatctaagggttatttaat

SEQ ID NO: 167970 - DNA, 601 bp, Human
tccaggcctgggctgagtgctgtggatcagacctgtaatctcaacagtttgggagatcaaagtgggtggatcgcttgagctcaggagttcgagaccagcctgggcaatatggtgaaatctcatctctacaagaaatccaaaaaattagctgggcatggtggtgcatacctgtagtcccagctacttgggaggctgaggtgggaggaccacctgagtctgggaagttgaggcagcagtgagctgtgatctcgctactgcattccagcctgggcaacaggtgggaccctgtttcaaaaaaaawtttttttaataaaacaaaaaataaaaattccaggcttagaaatttaaacttcttaagtttaaccttaacctttccaccttacatagaggccaagacattgtccttcagagcaagctcttcctacacgtaattacatgctccttctactgcactgtgctacctcatatctccctccacatcagttcttttgggaacaggaaatagcttaaaagtgttctgtttcatactatgtataataggaaattctgattgtttccttccttcttattcagggaaacaagatggttaatgggaagggat

SEQ ID NO: 167971 - DNA, 601 bp, Human
tcaccacatcaaaaaaaaattccaggcctgggctgagtgctgtggatcagacctgtaatctcaacagtttgggagatcaaagtgggtggatcgcttgagctcaggagttcgagaccagcctgggcaatatggtgaaatctcatctctacaagaaatccaaaaaattagctgggcatggtggtgcatacctgtagtcccagctacttgggaggctgaggtgggaggaccacctgagtctgggaagttgaggcagcagtgagctgtgatctcgctactgcattccagcctgggcaacaggtgrgaccctgtttcaaaaaaaattttttttaataaaacaaaaaataaaaattccaggcttagaaatttaaacttcttaagtttaaccttaacctttccaccttacatagaggccaagacattgtccttcagagcaagctcttcctacacgtaattacatgctccttctactgcactgtgctacctcatatctccctccacatcagttcttttgggaacaggaaatagcttaaaagtgttctgtttcatactatgtataataggaaattctgattgtttccttccttcttattcagggaaacaa

SEQ ID NO: 167972 - DNA, 601 bp, Human
atatgacagcatgtgtaatttcccatgatatgagactgttttatggctggagccagcacatagcctgggttttcttggagagtccctgttctatcctgttattccaaaagtattctcaagccagtcagaccacaaagtgacttctatttgtaacacacagtcttacatgaatgcattcatggacacatgtagatgtgggccgacattcctttttatacatgccagatggaagtctgcgtgtaataaccacaagggaatgactgcatagtgcctggctcattacaaaatattttaatgcatrtgatctcatcttgaggtttggggtgattaaggaaaagagcacaggcttggcaataaggtatatactagtttgtgactttggccacatttcttaacctctaagagcctcatcctcctctgtaaaatgggagttagtgtccttgttttgcagatgaggaaactgaagctcaggaataagtgacttgcctaagatcacagagctgataaataacagctctgtccaggatgccgcactccttcaccacatcaaaaaaaaattccaggcctgggctgagtgctgtggatcagacctgtaatctca

SEQ ID NO: 167973 - DNA, 601 bp, Human
gctcactgcagcctcaacctcttgagctcaggtgatcctcccatctcggcctcccatgtagctgggactatagtcgtgagccactatacttggctaattttttgttaattattttgtagagacaggttttagccgtgttgcccaggctggtctcaaactcttgggctcaagtgatccacctgccttggcctcccaaagtgctaggattacaggtgtgagccaccacatccagccaataaacatttttttacattgtattttattatgtccttagcatagatttctaacaatggaattattrggccaaggctatgaatggttttaaaattcctgaagctgacttttaaatgttttttaaagaggtttgtgctgtttgcaccccactaataatgtatgagcacttccagagggatgtttctataagggccatagtattttccttgtcaccattttgcatgacaccttttcaggatgcatgagatgtcacaccttgcacccttagatacaaacccagagcttcactctcaaggttaacatcctcttttcctagacttctctagaacaattattagtaaaagcagatatggtttgctttaatctc

SEQ ID NO: 167974 - DNA, 601 bp, Human
ttgtttatttatttgcttttttttagacagggcctctctcagtcatccaggctgtagtgcaatggcaccaccttggctcactgcagcctcaacctcttgagctcaggtgatcctcccatctcggcctcccatgtagctgggactatagtcgtgagccactatacttggctaattttttgttaattattttgtagagacaggttttagccgtgttgcccaggctggtctcaaactcttgggctcaagtgatccacctgccttggcctcccaaagtgctaggattacaggtgtgagccaccayatccagccaataaacatttttttacattgtattttattatgtccttagcatagatttctaacaatggaattattgggccaaggctatgaatggttttaaaattcctgaagctgacttttaaatgttttttaaagaggtttgtgctgtttgcaccccactaataatgtatgagcacttccagagggatgtttctataagggccatagtattttccttgtcaccattttgcatgacaccttttcaggatgcatgagatgtcacaccttgcacccttagatacaaacccagagcttcactctc

SEQ ID NO: 167975 - DNA, 601 bp, Human
tgggattacaggcttgagccaccgcacccagcctacttagccactttcttattttgagatgttaatttgtgccagtgtttatgttgcaataaacttttattgtttatttatttgcttttttttagacagggcctctctcagtcatccaggctgtagtgcaatggcaccaccttggctcactgcagcctcaacctcttgagctcaggtgatcctcccatctcggcctcccatgtagctgggactatagtcgtgagccactatacttggctaattttttgttaattattttgtagagacaggktttagccgtgttgcccaggctggtctcaaactcttgggctcaagtgatccacctgccttggcctcccaaagtgctaggattacaggtgtgagccaccacatccagccaataaacatttttttacattgtattttattatgtccttagcatagatttctaacaatggaattattgggccaaggctatgaatggttttaaaattcctgaagctgacttttaaatgttttttaaagaggtttgtgctgtttgcaccccactaataatgtatgagcacttccagagggatgtttctataagggc

SEQ ID NO: 167976 - DNA, 601 bp, Human
ttcactatgttagccaggatggtctcgatctcctgaccttgtgatccacctgcctcgatctccctaagtgctgggattacaggcttgagccaccgcacccagcctacttagccactttcttattttgagatgttaatttgtgccagtgtttatgttgcaataaacttttattgtttatttatttgcttttttttagacagggcctctctcagtcatccaggctgtagtgcaatggcaccaccttggctcactgcagcctcaacctcttgagctcaggtgatcctcccatctcggcctcccrtgtagctgggactatagtcgtgagccactatacttggctaattttttgttaattattttgtagagacaggttttagccgtgttgcccaggctggtctcaaactcttgggctcaagtgatccacctgccttggcctcccaaagtgctaggattacaggtgtgagccaccacatccagccaataaacatttttttacattgtattttattatgtccttagcatagatttctaacaatggaattattgggccaaggctatgaatggttttaaaattcctgaagctgacttttaaatgtttttt

SEQ ID NO: 167977 - DNA, 601 bp, Human
ccactttctttctattttatttttcttgagatggagtctcgctctgttgcccaggtgcctcctggggtcaagtgattctcctgcctcagcctcccgagtagctgagactacaggcacccaccaccacgcctggctaattttttgtgtttttagtagagacggtgtttcactatgttagccaggatggtctcgatctcctgaccttgtgatccacctgcctcgatctccctaagtgctgggattacaggcttgagccaccgcacccagcctacttagccactttcttattttgagatgttartttgtgccagtgtttatgttgcaataaacttttattgtttatttatttgcttttttttagacagggcctctctcagtcatccaggctgtagtgcaatggcaccaccttggctcactgcagcctcaacctcttgagctcaggtgatcctcccatctcggcctcccatgtagctgggactatagtcgtgagccactatacttggctaattttttgttaattattttgtagagacaggttttagccgtgttgcccaggctggtctcaaactcttgggctcaagtgatccacctgccttggcct

SEQ ID NO: 167978 - DNA, 601 bp, Human
agccactttctttctattttatttttcttgagatggagtctcgctctgttgcccaggtgcctcctggggtcaagtgattctcctgcctcagcctcccgagtagctgagactacaggcacccaccaccacgcctggctaattttttgtgtttttagtagagacggtgtttcactatgttagccaggatggtctcgatctcctgaccttgtgatccacctgcctcgatctccctaagtgctgggattacaggcttgagccaccgcacccagcctacttagccactttcttattttgagatgttaatttgtgccagtgtttatgttgcaataaacttttattgtttatttatttgcttttttttagacagggcctctctcagtcatccaggctgtagtgcaatggcaccaccttggctcactgcagcctcaacctcttgagctcaggtgatcctcccatctcggcctcccatgtagctgggactatagtcgtgagccactatacttggctaattttttgttaattattttgtagagacaggttttagccgtgttgcccaggctggtctcaaactcttgggctcaagtgatccacctgccttggc

SEQ ID NO: 167979 - DNA, 601 bp, Human
aagacaccaagtagacaaagtctgcattaagctaagggctagctggtcccttagagtccacagaaggtaaccttggagacagcaggctggaaagggagtgggactggagaagggagggtatttgggagactattccctaagatttttttttttcttttcttttcttttcttttttttttttttgagacggagtctagctctgtcacccaggctggagtgcagtggtgtgatcttagctcactgcgacttccacctcttgggttcaagcaattcccttgcctcagccttccgagtagctggrattaacaggtgcgtgccaacacagccggccaatttttgttttttagtagagacagggtttcaccatgttggccaggctggtctcgaactcctggcctcaagcgatccgccttcctcggtctcccaaagtgctgggattgcaggcatgagccaccgcgctcggcctgttggaagactgtcgtactaattcaagcaagagagaaagccatttaaggacgagtggcacttagacatttagatgtttaaagtaatactttaaaaatagaagttatacatacttgttatacaaaacttggataat

SEQ ID NO: 167980 - DNA, 601 bp, Human
agaaaaatggggaaagggtgtcattctaagtagagggaagaacaagcatgaagaccagaagatctgaaagggtctggcctgtgtggggaacagcaagtcacaccagggagtctaaagggttctcctagtttaaagacaccaagtagacaaagtctgcattaagctaagggctagctggtcccttagagtccacagaaggtaaccttggagacagcaggctggaaagggagtgggactggagaagggagggtatttgggagactattccctaagatttttttttttcttttcttttctttttttttttttttttttgagacggagtctagctctgtcacccaggctggagtgcagtggtgtgatcttagctcactgcgacttccacctcttgggttcaagcaattcccttgcctcagccttccgagtagctgggattaacaggtgcgtgccaacacagccggccaatttttgttttttagtagagacagggtttcaccatgttggccaggctggtctcgaactcctggcctcaagcgatccgccttcctcggtctcccaaagtgctgggattgcaggcatgagccaccgcgctcggcctgtt

SEQ ID NO: 167981 - DNA, 601 bp, Human
tccctgggttatgcagcatctactcccggctttgcacagaacgtgcggcatccaagcattcactcaggattggggcatatgagagggtagtggggaaaccctgctcttcagggacccatgaatatgaaagaccaccataagagagggagggacagaacaaagctctggtccctcaaaagaccaagtgtctatttttgcactctgaaaatgaggtgtcaggtccctgctggggaatccctggaggcagctgggctccccaaagcagctgggctccaaatgtccaggaggaggtgcaaagagraagagattttgctttggctctgagggcctctgggattcccagaggaatccacaagcctcatatatatttatgtgaacttaagatgctaatgagcattgaggagccaagagccctgctgggtttgcaagtaactgggcctactcttcacacagtcttctttgtctgcaaggcttcaggttcaaattgcagatctgggtttttttagcgcagctgacatggaaacctgcccaggcctacggcagaatcaccgtgggctccaggagaaagcttccaccctgcttccttggacaagacactgag

SEQ ID NO: 167982 - DNA, 601 bp, Human
tgttctgggtctcattcccctcaacgctcttgcacctgccctccctgggttatgcagcatctactcccggctttgcacagaacgtgcggcatccaagcattcactcaggattggggcatatgagagggtagtggggaaaccctgctcttcagggacccatgaatatgaaagaccaccataagagagggagggacagaacaaagctctggtccctcaaaagaccaagtgtctatttttgcactctgaaaatgaggtgtcaggtccctgctggggaatccctggaggcagctgggctccccaragcagctgggctccaaatgtccaggaggaggtgcaaagaggaagagattttgctttggctctgagggcctctgggattcccagaggaatccacaagcctcatatatatttatgtgaacttaagatgctaatgagcattgaggagccaagagccctgctgggtttgcaagtaactgggcctactcttcacacagtcttctttgtctgcaaggcttcaggttcaaattgcagatctgggtttttttagcgcagctgacatggaaacctgcccaggcctacggcagaatcaccgtgggctcca

SEQ ID NO: 167983 - DNA, 601 bp, Human
tccctagttgggaacatgcctccttccctgtccagaaggaagcttgtgtggatgagggaggattgttgagttcctgagaagcaaatggagagagtgcagtctctcttatcaagcccaggaaggaaagacagacagacagacagacagacagacaggctacttagcatgaacgatatttccagaagctgaaagcttgttcttaaactgacggagggatgccagcctgccatggtcaacaaaggaattgggaccggggaaatcctgtcctaagaatctgagctgaaaagcatgattggggttraacatctgccaccatcatttccttttccacgtttattcactgcctgtccccccacccccaccccaggtccactaagtggtacctatgctttttccacaaagcaggctgcagagggaaggccatgtatctggccagggcagggctagggctgcagcgttacaccccagagctggggccacggcactccagctttgaccagacagcatctagggcagctgccccccctggttcttcctatctacatctggattccactgtcttctttttgtggcttttctctgaaagccctctcttccttcc

SEQ ID NO: 167984 - DNA, 601 bp, Human
tgttctcaccacaaggaaatgatacatgtttggggtgatgaaaatgcttatcacccggatttgatcgttacgtatcatatacatgcatcgaaacatctcattgcactccataaatatgtacaattattacgtgtcaattagaaacaaaataaaactaaaaaaaaaaatctgccaccaaaggagagatatccttggctaatgtggatcattgtgttctgagtgtagtaatcaatcattacagttaacatgccaggcatggcactaggtaccttggggtaatgggcacatacagtgtttagcrcagtgcttggcacatagtaggtatttgatgagtgatagcgattactatcaataatcttatagatcactctatgaagaggtatcattattatcgtcctttgttttgggaagctgaggaaacacacatacagagaagttcaacttgttcaaggttttgaaaccttgacaccatccagttagaaagacagatgtcttttatttctttctttctttcttttgagacggagtttcactctgtcaccctggctggaacgcagtggcacgatctcggctcactgcaagctccacctcctgggttcac

SEQ ID NO: 167985 - DNA, 601 bp, Human
tcagcaagacatggtgcagcctgaatgtgagctgctctcttgcttttaggtcttcctgactttcagaaactgggggccataagagctccaccatctcagaagtctgctgccaataggaggaaatagttcaggttctgttgcacggcagggtgactatggttgacaacagtgtattgtatatttcaaaatagttagaagagaggattttgaatgttctcaccacaaggaaatgatacatgtttggggtgatgaaaatgcttatcacccggatttgatcgttacgtatcatatacatgcatcraaacatctcattgcactccataaatatgtacaattattacgtgtcaattagaaacaaaataaaactaaaaaaaaaaatctgccaccaaaggagagatatccttggctaatgtggatcattgtgttctgagtgtagtaatcaatcattacagttaacatgccaggcatggcactaggtaccttggggtaatgggcacatacagtgtttagcgcagtgcttggcacatagtaggtatttgatgagtgatagcgattactatcaataatcttatagatcactctatgaagaggtatcattatt

SEQ ID NO: 167986 - DNA, 601 bp, Human
acagacagcctgcctgcctcttgggccttgtttaaacaagatgagagcaggccgtgtttggactagaaggcccgtgacccttccccagtgtgggagaacaggtcagcaagacatggtgcagcctgaatgtgagctgctctcttgcttttaggtcttcctgactttcagaaactgggggccataagagctccaccatctcagaagtctgctgccaataggaggaaatagttcaggttctgttgcacggcagggtgactatggttgacaacagtgtattgtatatttcaaaatagttagaagrgaggattttgaatgttctcaccacaaggaaatgatacatgtttggggtgatgaaaatgcttatcacccggatttgatcgttacgtatcatatacatgcatcgaaacatctcattgcactccataaatatgtacaattattacgtgtcaattagaaacaaaataaaactaaaaaaaaaaatctgccaccaaaggagagatatccttggctaatgtggatcattgtgttctgagtgtagtaatcaatcattacagttaacatgccaggcatggcactaggtaccttggggtaatgggcacat

SEQ ID NO: 167987 - DNA, 601 bp, Human
ttaacaacaacatggcctaccatttatttatcagtgtttgctctgttccaggggaagtactaaataatttgcttctacgaaaatcaatagtaaatacctaccaaaaattgtccttatctgttatatttacccccattcgtatcatataatttatctatttctttgtctgtctgccttaatagactccccttggatttcctggtacctaaaatagggcctcacaattagtaggaactcattgatttagttattgttatttttatttttattttatttcctgagaggaagtcttgctctgtcrccaaggctggagtgcagtggcccactctcagctcactgcaacttctgcctcccgggttcaagcaattctcccaccctagcctccccagtagctgggattacaggcacgtgccaccacgcctagctagtttttgtatttttagtagagacagggtttcgtcatgttggtcaggctggtctctaattcctgacctcagttgattgacccatctcggcctcccaaagtgctggagttaaagatgtgagccaccatgcctggcttgatttttttttttttaaatgaatgaaaaactaatcaagt

SEQ ID NO: 167988 - DNA, 601 bp, Human
accagcttatgggttctgaggcccacagctagagggagatgttgggagctagagtgtctctgcttaaatttcgaatctttactgcaaatcattgtacagtggagccgctcaatcacatcgtctacaggttccctctgtaaaatgcaacaatgacaatagtgcccacattttgttttattaaaaaaatccaaattaattggccaactatttattttccagtagtgatgatagtgatattaacaacaacatggcctaccatttatttatcagtgtttgctctgttccaggggaagtactaaayaatttgcttctacgaaaatcaatagtaaatacctaccaaaaattgtccttatctgttatatttacccccattcgtatcatataatttatctatttctttgtctgtctgccttaatagactccccttggatttcctggtacctaaaatagggcctcacaattagtaggaactcattgatttagttattgttatttttatttttattttatttcctgagaggaagtcttgctctgtcaccaaggctggagtgcagtggcccactctcagctcactgcaacttctgcctcccgggttcaagca

SEQ ID NO: 167989 - DNA, 601 bp, Human
ggcacctgggatgaattaattgagggcttgctgggagcaagacaccgtcagaggtgctatggggtttgctgagagagatgaaggagcttatagtccacaagggaagataaaagttgcataaatggccaggtgtgatggctcacacctgtaatccaagcactttgggaggtcaaggtgggcggatcgcttgagctcaggagtttgagaacagcctgggcaacatgacgaaacattgtctctaaaaaaaaaaatacaaaaaaaagcagccaggcatggtggcaagtgcctgtagtcccagctrcttggggggctgaggcaggaggatcacttgagcccgggaggctcaaaagctgcctgtgagtcaagacggcaccaccgcactccagcctgggtgatagagtgagaccctgtctcaaaaaaaaaagagagaagaaaaccaaaaaataaaaaatcagcataaataaccatatttaggcaaagagccatggcagattcaaggcaggagagatcattcccagctaggaaagtgggtacctgtaccttgaagaagggagagggtttgggggctgaaggaaggggagattagggctacagctggaag

SEQ ID NO: 167990 - DNA, 601 bp, Human
cgactcagctttgaagaaagcatccatttattcatttaacaaacatttcctgagagtctactcttcagctgattatttatgatttataacacaccagtttccaaaatgatttgaggtggtttataatgttaaaacacatccaaaacaggaacgtgtataatgtataatgcatgtataatgcaaatagaacagagatccattaagaggaactgggaaataaatctttcaggcacctgggatgaattaattgagggcttgctgggagcaagacaccgtcagaggtgctatggggtttgctgaragagatgaaggagcttatagtccacaagggaagataaaagttgcataaatggccaggtgtgatggctcacacctgtaatccaagcactttgggaggtcaaggtgggcggatcgcttgagctcaggagtttgagaacagcctgggcaacatgacgaaacattgtctctaaaaaaaaaaatacaaaaaaaagcagccaggcatggtggcaagtgcctgtagtcccagctgcttggggggctgaggcaggaggatcacttgagcccgggaggctcaaaagctgcctgtgagtcaagacggcac

SEQ ID NO: 167991 - DNA, 601 bp, Human
ctggtcacgtattacacatgcagactcttggacctaaactcccttggggtggattccagcaatctgtgtcttcacaagccctgcaggtgctaacgatgcactggctctcaaattggagaaccacttgattcagtaggcctcatgtacaatatgaggctttgagctcctgaatacctgcacagagaaccttgatgtggagctaggattgagaacccctgtgctggcaacaggaaagatgcagagatgcagagaacatggccccaacctgaagaagctcacagtttagtggacaatgttaaamcaaatgccactgagtgccacagaacagctcagtctaaggggaagttcctggaggacacagagctcattttagagttgaacaggattctaaagagctacaggaagatctctcagaggaatagatgagcagaaggacccgaggcaggagaaagtgggaagaacagacagcgactcagctttgaagaaagcatccatttattcatttaacaaacatttcctgagagtctactcttcagctgattatttatgatttataacacaccagtttccaaaatgatttgaggtggtttataatgttaaa

SEQ ID NO: 167992 - DNA, 601 bp, Human
aaattagccaggcgtggtggtgcatgcctgtaatcccagctactcaggaggctgaggcaggagaattgcttgaacccaggaggtggaggttgcagtgagccaagatcacaccactgcactccagcctgggtgacagagtgagaccctgcctcaaaaaaaaaaaaaaaaaggtgacaagaaacttgccttcctatttattgattgaaacaggcagcattagatttccttggccttcctttgacagcagcactggaaagggacaggaaaggcaattacttgtccaaaggtatgtactaggtaygtaccaggtgcctactacgtgcccagccctgggcctagccctgggttctgcccagtgagatttgtaagagcagtgctttaagacttggtttctaatcacaagttacttataatctatttgagactgtagaactgagacagatggagcaaataatttaacctgttaaatatgtatcaagcccttaccatgcactaaaccagtcatgctcagcctgcatgtgagaagcactgattttttttttctttaaatgcagaatgggttcgggtatggtggctcatgcctgtaatcccagcactttag

SEQ ID NO: 167993 - DNA, 601 bp, Human
tcagaggcacttggagaggtgaccatcacagagtagccacagaagggtggaatattctgagtagttttaggacatcagatgtaaccttcagtcatcccagtccaggagaatacttgagtgtcagaaccaggatatcttagaagtcacccagggcaacctctttatatcatgaataaagaagaaatgagggcgtggcgtggtggcttatgcctgtaatcccagcactttgggaggtcgaggtgggtggatcacttgaggtcaggaattcgaaatctgcctggccaatgtggagaaaccccawctctactaaaaatacaaaattaccccggcgtggtggcacatgcctctaatccagctactccagaggctgaggcaggcaaatcacttgaacccaggaggcagaggttgcagtgagccgagatcgcgccattgcacttcagcctgtgcaacaagagcgaaaccctgtctcaacaaaacccccaaaattagctgggcatggtggtagttgcctataatcccagctactccggaggctgaggcaggagaatcacttgaaccccgagtggggcaggaggcagaggtggcagtgagccaagatctc

SEQ ID NO: 167994 - DNA, 601 bp, Human
tgagggatacatttactcccaggaaaacagaggaatcccagaggttaaaagcttggggccaatttatcacctggctctgaattccaaaacaaaactcagaggcacttggagaggtgaccatcacagagtagccacagaagggtggaatattctgagtagttttaggacatcagatgtaaccttcagtcatcccagtccaggagaatacttgagtgtcagaaccaggatatcttagaagtcacccagggcaacctctttatatcatgaataaagaagaaatgagggcgtggcgtggtggctyatgcctgtaatcccagcactttgggaggtcgaggtgggtggatcacttgaggtcaggaattcgaaatctgcctggccaatgtggagaaaccccatctctactaaaaatacaaaattaccccggcgtggtggcacatgcctctaatccagctactccagaggctgaggcaggcaaatcacttgaacccaggaggcagaggttgcagtgagccgagatcgcgccattgcacttcagcctgtgcaacaagagcgaaaccctgtctcaacaaaacccccaaaattagctgggcatggtggtagt

SEQ ID NO: 167995 - DNA, 601 bp, Human
cagaaacactgagggatacatttactcccaggaaaacagaggaatcccagaggttaaaagcttggggccaatttatcacctggctctgaattccaaaacaaaactcagaggcacttggagaggtgaccatcacagagtagccacagaagggtggaatattctgagtagttttaggacatcagatgtaaccttcagtcatcccagtccaggagaatacttgagtgtcagaaccaggatatcttagaagtcacccagggcaacctctttatatcatgaataaagaagaaatgagggcgtggcrtggtggcttatgcctgtaatcccagcactttgggaggtcgaggtgggtggatcacttgaggtcaggaattcgaaatctgcctggccaatgtggagaaaccccatctctactaaaaatacaaaattaccccggcgtggtggcacatgcctctaatccagctactccagaggctgaggcaggcaaatcacttgaacccaggaggcagaggttgcagtgagccgagatcgcgccattgcacttcagcctgtgcaacaagagcgaaaccctgtctcaacaaaacccccaaaattagctgggcat

SEQ ID NO: 167996 - DNA, 601 bp, Human
gagaaatgtgagggggagatgcccagctttgctccatcccacagataaaaatctcacaaatgtgcttccttcttcttcccagaaagctttgctaagcttccccagcagcagtgcacatggctgcagggaaaacctccatggataccaatcactgcttggacactttctttccaggactctgccttttactttgttaagcaattattttggttaagatttctattcagtggctgaggcttgtgaccaaaataacatttaacagcattaggaacagaaacactgagggatacatttactcccrggaaaacagaggaatcccagaggttaaaagcttggggccaatttatcacctggctctgaattccaaaacaaaactcagaggcacttggagaggtgaccatcacagagtagccacagaagggtggaatattctgagtagttttaggacatcagatgtaaccttcagtcatcccagtccaggagaatacttgagtgtcagaaccaggatatcttagaagtcacccagggcaacctctttatatcatgaataaagaagaaatgagggcgtggcgtggtggcttatgcctgtaatcccagcact

SEQ ID NO: 167997 - DNA, 601 bp, Human
agtgagggagagggtcttttgtcccaagcattaaagcccattgccattttgtacagctggaagaaggaagcgtcatttgcgagtctttacctgtggtagggaaatgctttcttctttcagctatacaaaaaggtggagaaatgtgagggggagatgcccagctttgctccatcccacagataaaaatctcacaaatgtgcttccttcttcttcccagaaagctttgctaagcttccccagcagcagtgcacatggctgcagggaaaacctccatggataccaatcactgcttggacacttkctttccaggactctgccttttactttgttaagcaattattttggttaagatttctattcagtggctgaggcttgtgaccaaaataacatttaacagcattaggaacagaaacactgagggatacatttactcccaggaaaacagaggaatcccagaggttaaaagcttggggccaatttatcacctggctctgaattccaaaacaaaactcagaggcacttggagaggtgaccatcacagagtagccacagaagggtggaatattctgagtagttttaggacatcagatgtaaccttcag

SEQ ID NO: 167998 - DNA, 601 bp, Human
ttagccccaaccaagtcttcagaggactgtagcccaatcttggctgcaaactcgggcatgatcttgagccaggaccgcctagctaagctgcttctgaattcccgattcatagaaactgtgaaataataaatgtttgttgttttacgccattaagtggtggtcggggggatttttttggtagtgatagataactgatggaagaagtgagggagagggtcttttgtcccaagcattaaagcccattgccattttgtacagctggaagaaggaagcgtcatttgcgagtctttacctgtggtakggaaatgctttcttctttcagctatacaaaaaggtggagaaatgtgagggggagatgcccagctttgctccatcccacagataaaaatctcacaaatgtgcttccttcttcttcccagaaagctttgctaagcttccccagcagcagtgcacatggctgcagggaaaacctccatggataccaatcactgcttggacactttctttccaggactctgccttttactttgttaagcaattattttggttaagatttctattcagtggctgaggcttgtgaccaaaataacatttaacagca

SEQ ID NO: 167999 - DNA, 601 bp, Human
gcagatcctttagccccaaccaagtcttcagaggactgtagcccaatcttggctgcaaactcgggcatgatcttgagccaggaccgcctagctaagctgcttctgaattcccgattcatagaaactgtgaaataataaatgtttgttgttttacgccattaagtggtggtcggggggatttttttggtagtgatagataactgatggaagaagtgagggagagggtcttttgtcccaagcattaaagcccattgccattttgtacagctggaagaaggaagcgtcatttgcgagtctttayctgtggtagggaaatgctttcttctttcagctatacaaaaaggtggagaaatgtgagggggagatgcccagctttgctccatcccacagataaaaatctcacaaatgtgcttccttcttcttcccagaaagctttgctaagcttccccagcagcagtgcacatggctgcagggaaaacctccatggataccaatcactgcttggacactttctttccaggactctgccttttactttgttaagcaattattttggttaagatttctattcagtggctgaggcttgtgaccaaaataacat

SEQ ID NO: 168000 - DNA, 601 bp, Human
caggccagaacagaagcagatcctttagccccaaccaagtcttcagaggactgtagcccaatcttggctgcaaactcgggcatgatcttgagccaggaccgcctagctaagctgcttctgaattcccgattcatagaaactgtgaaataataaatgtttgttgttttacgccattaagtggtggtcggggggatttttttggtagtgatagataactgatggaagaagtgagggagagggtcttttgtcccaagcattaaagcccattgccattttgtacagctggaagaaggaagcgtcrtttgcgagtctttacctgtggtagggaaatgctttcttctttcagctatacaaaaaggtggagaaatgtgagggggagatgcccagctttgctccatcccacagataaaaatctcacaaatgtgcttccttcttcttcccagaaagctttgctaagcttccccagcagcagtgcacatggctgcagggaaaacctccatggataccaatcactgcttggacactttctttccaggactctgccttttactttgttaagcaattattttggttaagatttctattcagtggctgaggcttg

SEQ ID NO: 168001 - DNA, 601 bp, Human
tgaatttgtcagcaccttgcttatgaattttagcttccagaaaataaatgtctgttatttaagtcacccaggctgtgtcattttatgacagcctgagcatacaggccagaacagaagcagatcctttagccccaaccaagtcttcagaggactgtagcccaatcttggctgcaaactcgggcatgatcttgagccaggaccgcctagctaagctgcttctgaattcccgattcatagaaactgtgaaataataaatgtttgttgttttacgccattaagtggtggtcggggggatttttttggtagtgatagataactgatggaagaagtgagggagagggtcttttgtcccaagcattaaagcccattgccattttgtacagctggaagaaggaagcgtcatttgcgagtctttacctgtggtagggaaatgctttcttctttcagctatacaaaaaggtggagaaatgtgagggggagatgcccagctttgctccatcccacagataaaaatctcacaaatgtgcttccttcttcttcccagaaagctttgctaagcttccccagcagcagtgcacatggctgcagggaaaacctccat

SEQ ID NO: 168002 - DNA, 601 bp, Human
tctctctcccctcacgcacaggcactgaggaaaggccgtgtgaggatacaacaagaaggcaaccatccacaagccaggaagatagacctcacctgacactgaatttgtcagcaccttgcttatgaattttagcttccagaaaataaatgtctgttatttaagtcacccaggctgtgtcattttatgacagcctgagcatacaggccagaacagaagcagatcctttagccccaaccaagtcttcagaggactgtagcccaatcttggctgcaaactcgggcatgatcttgagccaggaccrcctagctaagctgcttctgaattcccgattcatagaaactgtgaaataataaatgtttgttgttttacgccattaagtggtggtcggggggatttttttggtagtgatagataactgatggaagaagtgagggagagggtcttttgtcccaagcattaaagcccattgccattttgtacagctggaagaaggaagcgtcatttgcgagtctttacctgtggtagggaaatgctttcttctttcagctatacaaaaaggtggagaaatgtgagggggagatgcccagctttgctccatccc

SEQ ID NO: 168003 - DNA, 601 bp, Human
agaagaaacaccagagagctcactctctctcccctcacgcacaggcactgaggaaaggccgtgtgaggatacaacaagaaggcaaccatccacaagccaggaagatagacctcacctgacactgaatttgtcagcaccttgcttatgaattttagcttccagaaaataaatgtctgttatttaagtcacccaggctgtgtcattttatgacagcctgagcatacaggccagaacagaagcagatcctttagccccaaccaagtcttcagaggactgtagcccaatcttggctgcaaactcrggcatgatcttgagccaggaccgcctagctaagctgcttctgaattcccgattcatagaaactgtgaaataataaatgtttgttgttttacgccattaagtggtggtcggggggatttttttggtagtgatagataactgatggaagaagtgagggagagggtcttttgtcccaagcattaaagcccattgccattttgtacagctggaagaaggaagcgtcatttgcgagtctttacctgtggtagggaaatgctttcttctttcagctatacaaaaaggtggagaaatgtgaggggga

SEQ ID NO: 168004 - DNA, 601 bp, Human
aaacatattatggcttctcctttgctatcttgaattgctgtctgcgggaagccaggtaccatggcatgagaatgacaaagcagcccaaggggaggcccacatggggaggaactgaggcttcctgccaacaaccaaaacctgtaaatataccatcttaggaactgtgatagaatgagtgtttatgtccccccaaaaattcatatgttgaagttctaaccctcaatgtggctatatttggagatggggccattaaggaagtaattaaggttaaatgggtggggccctgatccaataagattastgtccttatgagaagaaacaccagagagctcactctctctcccctcacgcacaggcactgaggaaaggccgtgtgaggatacaacaagaaggcaaccatccacaagccaggaagatagacctcacctgacactgaatttgtcagcaccttgcttatgaattttagcttccagaaaataaatgtctgttatttaagtcacccaggctgtgtcattttatgacagcctgagcatacaggccagaacagaagcagatcctttagccccaaccaagtcttcagaggactgtagcccaatcttgg

SEQ ID NO: 168005 - DNA, 601 bp, Human
tcctggtattcatgtccttgtatagtccctatattgaataagactgagctttgtaaccagtaggattttgcagaaatgatagtgtgtgacttccgagactcagtcataaaacatattatggcttctcctttgctatcttgaattgctgtctgcgggaagccaggtaccatggcatgagaatgacaaagcagcccaaggggaggcccacatggggaggaactgaggcttcctgccaacaaccaaaacctgtaaatataccatcttaggaactgtgatagaatgagtgtttatgtccccccaraaattcatatgttgaagttctaaccctcaatgtggctatatttggagatggggccattaaggaagtaattaaggttaaatgggtggggccctgatccaataagattactgtccttatgagaagaaacaccagagagctcactctctctcccctcacgcacaggcactgaggaaaggccgtgtgaggatacaacaagaaggcaaccatccacaagccaggaagatagacctcacctgacactgaatttgtcagcaccttgcttatgaattttagcttccagaaaataaatgtctgttattt

SEQ ID NO: 168006 - DNA, 601 bp, Human
ctctcatttggtacttacgcccatcgtgtgaggaaggtattattattttagtgatggagaaaccagctcagaggggttagttttgcatcttacaagaggtcgagctagaattttattttagttccaggtctactggttttcaaaacatacattctttttctgataccataatgtcctttcatccagagatgtgatagccagcctccaagatggtcctcagggactcttgcctcctggtattcatgtccttgtatagtccctatattgaataagactgagctttgtaaccagtaggattttkcagaaatgatagtgtgtgacttccgagactcagtcataaaacatattatggcttctcctttgctatcttgaattgctgtctgcgggaagccaggtaccatggcatgagaatgacaaagcagcccaaggggaggcccacatggggaggaactgaggcttcctgccaacaaccaaaacctgtaaatataccatcttaggaactgtgatagaatgagtgtttatgtccccccaaaaattcatatgttgaagttctaaccctcaatgtggctatatttggagatggggccattaaggaagtaat

SEQ ID NO: 168007 - DNA, 601 bp, Human
ccaccatgcttggcctcggaagacctttctgactctggcattctagaattcttgacttgtattaccattgcacaagggaagtgctgaagcctgggcaagtgctgaaggtgggaacagcgaggtggtgagagactagggaaggcaggggagggaaagagtgtttaccagatgattgctagttgcgacacagtaaattcgttctctcatttggtacttacgcccatcgtgtgaggaaggtattattattttagtgatggagaaaccagctcagaggggttagttttgcatcttacaagaggtmgagctagaattttattttagttccaggtctactggttttcaaaacatacattctttttctgataccataatgtcctttcatccagagatgtgatagccagcctccaagatggtcctcagggactcttgcctcctggtattcatgtccttgtatagtccctatattgaataagactgagctttgtaaccagtaggattttgcagaaatgatagtgtgtgacttccgagactcagtcataaaacatattatggcttctcctttgctatcttgaattgctgtctgcgggaagccaggtaccat

SEQ ID NO: 168008 - DNA, 601 bp, Human
cttggcctcccaaagtgctgagattatgggcatgagccaccatgcttggcctcggaagacctttctgactctggcattctagaattcttgacttgtattaccattgcacaagggaagtgctgaagcctgggcaagtgctgaaggtgggaacagcgaggtggtgagagactagggaaggcaggggagggaaagagtgtttaccagatgattgctagttgcgacacagtaaattcgttctctcatttggtacttacgcccatcgtgtgaggaaggtattattattttagtgatggagaaaccrgctcagaggggttagttttgcatcttacaagaggtcgagctagaattttattttagttccaggtctactggttttcaaaacatacattctttttctgataccataatgtcctttcatccagagatgtgatagccagcctccaagatggtcctcagggactcttgcctcctggtattcatgtccttgtatagtccctatattgaataagactgagctttgtaaccagtaggattttgcagaaatgatagtgtgtgacttccgagactcagtcataaaacatattatggcttctcctttgct

SEQ ID NO: 168009 - DNA, 601 bp, Human
ttttaatgctttttaattttaattttatttttttctgagatagggtctcactttgtcccccaggctggagtgcagtggcacgatctcagctcactccagcctcgacctcctgggttcatgtgatcctcccacctcagccttcttagtagctgggactacaggtgcatgccaccatgcctcactttttttttttttttttttttaagagatggggtttcaccatgttggccaggctggtctcgaactcttgagctcaagcgattcacctgcctcaacctcccaaagtgctaggattacaggygtgagccacctctcctggcctcccttttaattcttaggcttttcttcctttggttcttttttgttcccttttatagaaggtgttgggattggacacctatcataatgctgaccttccagccaataaatgaggttgatggcccacaccaggatgagtatggagccctcatacttctcagctcttgctctccatggcaagacggagtcaatgccaaaccgtgccctctctcaccccctcctccatgcaggtaggctcaaggatgacttccttgcaccctactctgacttgactcttactcgt

SEQ ID NO: 168010 - DNA, 601 bp, Human
caattaattcctgctgagatatgaagtatgataggaaccaaataaatgcattacccttccaggggcctttttgcttatttcatagcatgttcatttttagcatgtttattatccaaggcaacatcaagttgttggtagggctggtttcctctaaggcatttttctagttctagtaccactcccctaattccagcttttatcacttcactcctgttctaatcttgaatagctccctgcctccttcctcttccctctccagagcattcttcacaagtctgtcagatgaatttgcctatagcayagttctgattgcagccctcgaatctgctggtaaagcaatttaaactctcttcccctcaatttcctataataatcattatggaatgattccagtgatgccctgatgctttcactgagtatttgtagtgatgaaaatgagatcgttgatgaaaaatcttaataattataaggagctatacacatatattattactgctatgttcactgcccagctaaaaagtgttcgtggtggccgggcacggtggctcatgcctgtaatcccagcactttgggaggctgagatgggtggatcacgaggtca

SEQ ID NO: 168011 - DNA, 601 bp, Human
ctcctgccacgtgccaggcagtgatgtgagaatggcagcaggaaggaggaccagcgtgctgtctgtgagcttacaagaaaggacccctggaccactaccagggcagggccatggagagggaaccattggtttctacctagaaacctattctgtggaacaagttatttcagatcatctttgccatttccctggcagttctctatgataaagtccacatatggaaatggctgtcacctgaagtgacctagtattcggtcctggctttaagtttctggatcttagagagatgtctttcaggacrgatttacctgatggctctaagccactggcacttgtccttaaggtcttagcctctgctatttatgttcactcattcacctgcccactcattcattcattccaaaggtatttattaagcgtctaactacagaagcattttgctgtgtatcaggtatacaaaaatgaatacaatgctgtactgccacttttccagcggaggaactcatactctagtgggaaagacaatatatgaatacatgattacagggtaatatactaaatgcctgtgaaagacatgtgggaacagagctgcaccttcttc

SEQ ID NO: 168012 - DNA, 601 bp, Human
ggaaggaaggaaggaaggaatgaaggaaggaaggaaggaaaggaaggaaggaaggaaggtaggtgtggggagaaagtggataggaggtagaataccatcccactctcccacaaattctgaaagtcatgacttctttttttgttttgttttgagatggagtctcactctgtcgctcagggtggagtgcaggggcacgatctcggctcactgcaacctctgccttttgggttcaagtgagtctcatacctcagcctctcgagtagctgggattacaggcacatgccaccactcctagcatatyagagacggggttttgccatgttgtccaggctagtcttgaactcctggcctcaagtgatctgcccaccttggcctcccaaagtgctgggattacaggcgcgagccactgtgcctggcctgggtctttccatcttatctcaccacttttctgttactgccagacttgttcattcaacaggtgtttcggtggctcctgccacgtgccaggcagtgatgtgagaatggcagcaggaaggaggaccagcgtgctgtctgtgagcttacaagaaaggacccctggaccactaccagggcagggcca

SEQ ID NO: 168013 - DNA, 601 bp, Human
tttcaggtgagctcttcccaaggggagcaaaatggccccagaatataaattccaggcttaactttgaccaatttagttgtaaaaagcctgggtttggtcaatcttgagttctgtgtccattgccaaaccagttcctgccaccatagggatggagtgctgtaactggctaggcctgagaactttgtgcatccctggaactgggaacaagtggggaaatgggagaagagaggttctcaaagggaaaagaggtcctcaaaaggttttctttctttctttctttcttcctttctttctttctttstttctttctctctttttttttttaggcagagactcactctgtcatccaggctgcagtttagtggtgcaatctcacctcactgcaacctccgctcccgggtttaaatgattctcctggctcctgagtagctgggattacaggcgctcgccaccatgcctggctaatttttgtatttttggtagagatggggtttcactatgttggccaggctggtcttgaactcctgacctcaggtgatcctcccatctcagcctcccaaagtgctgagattacaggtatgagacactgtgcccagactct

SEQ ID NO: 168014 - DNA, 601 bp, Human
atttcaggtgagctcttcccaaggggagcaaaatggccccagaatataaattccaggcttaactttgaccaatttagttgtaaaaagcctgggtttggtcaatcttgagttctgtgtccattgccaaaccagttcctgccaccatagggatggagtgctgtaactggctaggcctgagaactttgtgcatccctggaactgggaacaagtggggaaatgggagaagagaggttctcaaagggaaaagaggtcctcaaaaggttttctttctttctttctttcttcctttctttctttcttcgtttctttctctctttttttttttaggcagagactcactctgtcatccaggctgcagtttagtggtgcaatctcacctcactgcaacctccgctcccgggtttaaatgattctcctggctcctgagtagctgggattacaggcgctcgccaccatgcctggctaatttttgtatttttggtagagatggggtttcactatgttggccaggctggtcttgaactcctgacctcaggtgatcctcccatctcagcctcccaaagtgctgagattacaggtatgagacactgtgcccagactc

SEQ ID NO: 168015 - DNA, 601 bp, Human
aagaattcttccctagagccttcagaggaaacaccactctgctataccttgatttcagatgtctggcctccagaactgtgacaggatatatttctgttgtttgaggctacccaggttgtggtgatttcccgcagcagccctgggaaactgatacatttttatatctgaaaatccagggatttctggctttaggcatggttaaatgcaggtgcttatacatatcatgtcatcagaaatataccagtcaccatctctgggttctgtttatcttggagttgacttcatttcaggtgagctcttyccaaggggagcaaaatggccccagaatataaattccaggcttaactttgaccaatttagttgtaaaaagcctgggtttggtcaatcttgagttctgtgtccattgccaaaccagttcctgccaccatagggatggagtgctgtaactggctaggcctgagaactttgtgcatccctggaactgggaacaagtggggaaatgggagaagagaggttctcaaagggaaaagaggtcctcaaaaggttttctttctttctttctttcttcctttctttctttctttgtttctttctctctttt

SEQ ID NO: 168016 - DNA, 601 bp, Human
attacatgccacgtgttcatctgcagagcccactgagccatgctaagaaagtgtttacagaatctaggaagaggcaggaaagaattcttccctagagccttcagaggaaacaccactctgctataccttgatttcagatgtctggcctccagaactgtgacaggatatatttctgttgtttgaggctacccaggttgtggtgatttcccgcagcagccctgggaaactgatacatttttatatctgaaaatccagggatttctggctttaggcatggttaaatgcaggtgcttatacataycatgtcatcagaaatataccagtcaccatctctgggttctgtttatcttggagttgacttcatttcaggtgagctcttcccaaggggagcaaaatggccccagaatataaattccaggcttaactttgaccaatttagttgtaaaaagcctgggtttggtcaatcttgagttctgtgtccattgccaaaccagttcctgccaccatagggatggagtgctgtaactggctaggcctgagaactttgtgcatccctggaactgggaacaagtggggaaatgggagaagagaggttctcaaa

SEQ ID NO: 168017 - DNA, 601 bp, Human
aggggtgggcaaaatatcaaaggccctgaattttcaggaagcgggtgtctaaattaccaccagaggagatggctgtaaattacatgccacgtgttcatctgcagagcccactgagccatgctaagaaagtgtttacagaatctaggaagaggcaggaaagaattcttccctagagccttcagaggaaacaccactctgctataccttgatttcagatgtctggcctccagaactgtgacaggatatatttctgttgtttgaggctacccaggttgtggtgatttcccgcagcagccctggsaaactgatacatttttatatctgaaaatccagggatttctggctttaggcatggttaaatgcaggtgcttatacatatcatgtcatcagaaatataccagtcaccatctctgggttctgtttatcttggagttgacttcatttcaggtgagctcttcccaaggggagcaaaatggccccagaatataaattccaggcttaactttgaccaatttagttgtaaaaagcctgggtttggtcaatcttgagttctgtgtccattgccaaaccagttcctgccaccatagggatggagtgctgt

SEQ ID NO: 168018 - DNA, 601 bp, Human
acccttggaaatatgactttgcttggctctccaacctcatctcgtgtagctgtcccattgccatgctctgttccagctacactgagttgccttctattctgcacatgaaccgtcacacaattatctttgcattcactattttctccacctggaaaaacctgtccttctcttttatcctgcctgtggccccatggtctacctttcactggccccataagactcagaggtcacatcctccaatgagcctttcttttttaaaaaattaaaaagatagttttttctttacagatggggtctcacygtgttgcccagattgctcttgaacatgtgggctgaagtgatcctcctgcctcagcctcccaaagtgctaggattacaggtgtgagccaccatgcccagcagcgagcctttcttgactgcccctactctggattcccatagcacacctgcaacccacactgtgtattgtgatgcctctcccactagaatgtcagtgcctgcagggtcaggaccatgtccttgactgcatcttcagcatcttgtgcagtgctgggtacagagtaggcactcaggaaacagttgttgaagaaatgaatggagg

SEQ ID NO: 168019 - DNA, 601 bp, Human
cctgttaacctgcttaatgcaaactctcacatctttgtgtaaaatggactctttgccttcagtttcatattttccagtgtattcactatgttttctaaaaatgtcattttttttcaagttcaacttcaaatttagtacggtagaaagacccttggaaatatgactttgcttggctctccaacctcatctcgtgtagctgtcccattgccatgctctgttccagctacactgagttgccttctattctgcacatgaaccgtcacacaattatctttgcattcactattttctccacctggaraaacctgtccttctcttttatcctgcctgtggccccatggtctacctttcactggccccataagactcagaggtcacatcctccaatgagcctttcttttttaaaaaattaaaaagatagttttttctttacagatggggtctcaccgtgttgcccagattgctcttgaacatgtgggctgaagtgatcctcctgcctcagcctcccaaagtgctaggattacaggtgtgagccaccatgcccagcagcgagcctttcttgactgcccctactctggattcccatagcacacctgcaacc

SEQ ID NO: 168020 - DNA, 601 bp, Human
agttctaatagtgatgctgaaaattctgtcagattagccattcaaaggatttcttccctgttaaaattcagctatcaggactgagtgtggtggctcgcgtctgtaatcccagcattttgggagtatatatataaacagcatccacctaataccatggttgtgagaactgaatgagattacccatgcaaagtgtctagtgcttggcacatgtacacactcaataaatattggctcttattatttccttattccttacatattaagcacctgctgttttgggaaaacagatgcatcagacacmactctgctcttcgatcacagtcttggtggggagttagatgtgcagacccacctacaagtagaggtcggcccactcctcagctctgtgacacatcctcattcttaaaattctggcctcagcctgcatgacaccctcttctctagaatttcctccttcctgctacctgccattggttctttttccatgggcgtgtgttgtgaacattggttctgacttcagctctctttcatctctcctccccagttcccctggtatcattgtcacccccagacctgtgcacacctagatgccaacaacttc

SEQ ID NO: 168021 - DNA, 601 bp, Human
agctgctcattaacgctgcacaggggctcagggtagggcagggccagctgtgtgcaccatggctgctgttagcatccctattttatagatggggatgttcaggtatggaaagatcaagtaacttgcatctaggtaagctgcagaaccaagatgctggcacacctccaggcatcatttcttctcagttctaatagtgatgctgaaaattctgtcagattagccattcaaaggatttcttccctgttaaaattcagctatcaggactgagtgtggtggctcgcgtctgtaatcccagcatttkgggagtatatatataaacagcatccacctaataccatggttgtgagaactgaatgagattacccatgcaaagtgtctagtgcttggcacatgtacacactcaataaatattggctcttattatttccttattccttacatattaagcacctgctgttttgggaaaacagatgcatcagacaccactctgctcttcgatcacagtcttggtggggagttagatgtgcagacccacctacaagtagaggtcggcccactcctcagctctgtgacacatcctcattcttaaaattctggcctc

SEQ ID NO: 168022 - DNA, 601 bp, Human
tgggtcaccagaaactgaagtaagaggacactccttttacttgcacgtcacagactttgtcagcgtgtgctccatgagtgggttcagctctgcggctgtttttttttttttttttttttttttttgagacgggagtcttgccctgttgcccaagctggagtgcagcggcgcgatctggactcaatgcaacctccgcctcccggattcaagctattttcctgcctcagcttcccgagtagctgggcctacaggtgcccgccactatgcctggctaattttttttatttttagtagagacggrgtttcaccatgttggccaggctggtatcgagctgctgatctcaagtgatctgctggccttggactcccaaactgctgggattataggcgtgagccactgtgcccggccttgcggctggttttaatgtgctgactgagctgtgctcctcactgtgtaaggctgaatagtcccgcacttccctgccttagtgagcttgataagtgcactaggaaattagcgccatctgctactttacttatctcctcctgctcttcagctcccacctatagccctccctggaggggaaggcccataacccca

SEQ ID NO: 168023 - DNA, 601 bp, Human
ataaatatttggggataatatttttttgagaccgactttcgctcttgttgcccaggctagagtgcaatggtgcaatctcggctcactgcaacctccgcctcctgggttcaagcgattctcctgtctcagcttcctgagtagctggcattacaggcatgtgccaccatgcccactaattttgtatttttagtagagacgaagtttctccatgttggtcaggctggtctcgaactcccgacctcaggtgatcctcctaccttggcctcccaaagtgctgggattacaggcatgagccaccackcccagcggggataatgattttttttggtaaactgaggctaaatggacatgaaggtgagcattgtgacagaaaagaagtcatataaagcagtagacagagtttttgaagtgcagggatatcttctatcttgcagatttatcagctgattgcatatggacctcaggtacaagctggtggatccctttcgaccccattcctcagatttcactggctgattgtgtgtcaggggcctgactttcctgctgtcccggtttttcagacttacaggctcgagtgctgcaccagccactacatgtggca

SEQ ID NO: 168024 - DNA, 601 bp, Human
actgcacctgacagccttgtgagattctaagcagaggatcctgctgagccatagctggaactcctaacccacagagatgatgaaatagtgtgtgtagttttaagctgctaaatttgtagccatttgttacatagtaatagataattgatacaccaacttctttgatttgtgttgagggctttgtaatctgcaatgcattgtagatgcagaatacattactggatccaatatctagcacagtgcaggcatgctgtactctcaataaatatttggggataatatttttttgagaccgactttsgctcttgttgcccaggctagagtgcaatggtgcaatctcggctcactgcaacctccgcctcctgggttcaagcgattctcctgtctcagcttcctgagtagctggcattacaggcatgtgccaccatgcccactaattttgtatttttagtagagacgaagtttctccatgttggtcaggctggtctcgaactcccgacctcaggtgatcctcctaccttggcctcccaaagtgctgggattacaggcatgagccaccactcccagcggggataatgattttttttggtaaactgaggct

SEQ ID NO: 168025 - DNA, 601 bp, Human
gggtggaagtacgtcctcacatcctcacagattaagctgcctgatcttaggctcacatttcaacagcttcaacaacttgcatttcaacgacttgcatgtccatgacaagccccagctgagcctccagatgaggacccagcccttgccaacaccttgactatagtcttgtgagattttttttttttttgagatggagtctcactctgttactcaggctggagtacagtggtgcaatcttggctcactgcaacccctacctcccaggtccaagcgatcctcctacctcagcctcctgaatagyagggactacaggtgtgcaccaccactcttggctaagttttgtatttttagtagagatggggtttcaccatgttggacaggctggtctcaaactcttggcctcaagtgatccgtctgcctcagatccgtctcccagagtgctaggattacaggcaagagccactgcacctgacagccttgtgagattctaagcagaggatcctgctgagccatagctggaactcctaacccacagagatgatgaaatagtgtgtgtagttttaagctgctaaatttgtagccatttgttacatagtaatag

SEQ ID NO: 168026 - DNA, 601 bp, Human
aatccagcagagagctgactctctgtcctacaaccacaaagaactcaatactgctaacaatcacgtgagtgatgagggtggaagtacgtcctcacatcctcacagattaagctgcctgatcttaggctcacatttcaacagcttcaacaacttgcatttcaacgacttgcatgtccatgacaagccccagctgagcctccagatgaggacccagcccttgccaacaccttgactatagtcttgtgagattttttttttttttgagatggagtctcactctgttactcaggctggagtacartggtgcaatcttggctcactgcaacccctacctcccaggtccaagcgatcctcctacctcagcctcctgaatagcagggactacaggtgtgcaccaccactcttggctaagttttgtatttttagtagagatggggtttcaccatgttggacaggctggtctcaaactcttggcctcaagtgatccgtctgcctcagatccgtctcccagagtgctaggattacaggcaagagccactgcacctgacagccttgtgagattctaagcagaggatcctgctgagccatagctggaactcct

SEQ ID NO: 168027 - DNA, 601 bp, Human
ggggcatgagacagggaacagtgggtggcctctgatcaaaatccagcagagagctgactctctgtcctacaaccacaaagaactcaatactgctaacaatcacgtgagtgatgagggtggaagtacgtcctcacatcctcacagattaagctgcctgatcttaggctcacatttcaacagcttcaacaacttgcatttcaacgacttgcatgtccatgacaagccccagctgagcctccagatgaggacccagcccttgccaacaccttgactatagtcttgtgagattttttttttttttgagatggagtctcactctgttactcaggctggagtacagtggtgcaatcttggctcactgcaacccctacctcccaggtccaagcgatcctcctacctcagcctcctgaatagcagggactacaggtgtgcaccaccactcttggctaagttttgtatttttagtagagatggggtttcaccatgttggacaggctggtctcaaactcttggcctcaagtgatccgtctgcctcagatccgtctcccagagtgctaggattacaggcaagagccactgcacctgacagccttgtgagatt

SEQ ID NO: 168028 - DNA, 601 bp, Human
gaatcagcatccgtggaccttagtgatgaatttttctcctacaagctgagtgactgttgccaatcattgtccccgaccctcactttcaaccaagtcacaggttttttgaagtgcagggatatcttctgtcttgcacatttatgagctttcaaccaatagaatatggccaaggtgatgggctgtcaattccatgattatgttaaattgtataaaacaaccttgcagcagactggaattagaagtactgccagccttgaagaagttagctgccatgtgaaccgcctatggggggcggggggggcatgagacagggaacagtgggtggcctctgatcaaaatccagcagagagctgactctctgtcctacaaccacaaagaactcaatactgctaacaatcacgtgagtgatgagggtggaagtacgtcctcacatcctcacagattaagctgcctgatcttaggctcacatttcaacagcttcaacaacttgcatttcaacgacttgcatgtccatgacaagccccagctgagcctccagatgaggacccagcccttgccaacaccttgactatagtcttgtgagattttttttttttttgag

SEQ ID NO: 168029 - DNA, 601 bp, Human
catctctgatgttcctgcctagctccaggaagggacagtttaagaacccagtggaggttccttacaacctattccctgggccaagtctctcacatgtgtggggacactgtggagttctgggtaagcttatttctagctgccatccccaattatttagccagctgcctgagagcaggagccacgtttcactgtcactctgtgttagaagggacattggccatggaatcagcatccgtggaccttagtgatgaatttttctcctacaagctgagtgactgttgccaatcattgtccccgaccytcactttcaaccaagtcacaggttttttgaagtgcagggatatcttctgtcttgcacatttatgagctttcaaccaatagaatatggccaaggtgatgggctgtcaattccatgattatgttaaattgtataaaacaaccttgcagcagactggaattagaagtactgccagccttgaagaagttagctgccatgtgaaccgcctatggggggcggggggggcatgagacagggaacagtgggtggcctctgatcaaaatccagcagagagctgactctctgtcctacaaccacaaagaa

SEQ ID NO: 168030 - DNA, 601 bp, Human
gacggggtttcaccttgttagccaggatggtctcgatctcctgacctcatgatccacccacctcggcctcccaaagtgctgggactacaggcgtgagccaccgcgcccggccgatgaggtttcttaaaacaggcagtcctactcctagacatgagcccatgatttcttcttgccaggccaaagtctcatgtctcatctctgatgttcctgcctagctccaggaagggacagtttaagaacccagtggaggttccttacaacctattccctgggccaagtctctcacatgtgtggggacacygtggagttctgggtaagcttatttctagctgccatccccaattatttagccagctgcctgagagcaggagccacgtttcactgtcactctgtgttagaagggacattggccatggaatcagcatccgtggaccttagtgatgaatttttctcctacaagctgagtgactgttgccaatcattgtccccgaccctcactttcaaccaagtcacaggttttttgaagtgcagggatatcttctgtcttgcacatttatgagctttcaaccaatagaatatggccaaggtgatgggctgtcaa

SEQ ID NO: 168031 - DNA, 601 bp, Human
ctcccgagtagctgggactacaggcgcccgccactgcgcccggctaattttttgtatttttagtagagacggggtttcaccttgttagccaggatggtctcgatctcctgacctcatgatccacccacctcggcctcccaaagtgctgggactacaggcgtgagccaccgcgcccggccgatgaggtttcttaaaacaggcagtcctactcctagacatgagcccatgatttcttcttgccaggccaaagtctcatgtctcatctctgatgttcctgcctagctccaggaagggacagttyaagaacccagtggaggttccttacaacctattccctgggccaagtctctcacatgtgtggggacactgtggagttctgggtaagcttatttctagctgccatccccaattatttagccagctgcctgagagcaggagccacgtttcactgtcactctgtgttagaagggacattggccatggaatcagcatccgtggaccttagtgatgaatttttctcctacaagctgagtgactgttgccaatcattgtccccgaccctcactttcaaccaagtcacaggttttttgaagtgcaggga

SEQ ID NO: 168032 - DNA, 601 bp, Human
atatagtaactttttacttaacgatataaacttaattaatttattatttttaataatgtttatgaagtggcttatattgtcttgcattcatcacttgcagtgtgcatatctcgccccccaaaacatggtgaacgttttataactccttcgcttttgtatgagaaaatttcactcaaaatttctcctctccactgtggccccagcagatgggctacaatctctggtagagccagagagaattaaattgagctaaccaaaatccccccagcctttttttttttttttttttgacagggtctcrctttgtcccccaggctggagtacagtggtgtgagcacggcccactggaccctcgacctcccagggtcaagcgatcctcctgtctcagcctcctgagtagctgggaatacaggttcatgccactatacctgactaatttttgtactttttgtagagatggagttttgccatgttgcccaggttggtttcaaacttctgagctcaagcaattcctcctgcctcggcctcccaaagtgctggcattacaggcgtaagtcactgcgcctggctgatctagccaaaattccttaagtttgacctt

SEQ ID NO: 168033 - DNA, 601 bp, Human
atcaagttacctgattctggttcagaatgggctcttctgtctgtgaaatgctaaggtgtttagtgtatatagtaactttttacttaacgatataaacttaattaatttattatttttaataatgtttatgaagtggcttatattgtcttgcattcatcacttgcagtgtgcatatctcgccccccaaaacatggtgaacgttttataactccttcgcttttgtatgagaaaatttcactcaaaatttctcctctccactgtggccccagcagatgggctacaatctctggtagagccagaragaattaaattgagctaaccaaaatccccccagcctttttttttttttttttttgacagggtctcactttgtcccccaggctggagtacagtggtgtgagcacggcccactggaccctcgacctcccagggtcaagcgatcctcctgtctcagcctcctgagtagctgggaatacaggttcatgccactatacctgactaatttttgtactttttgtagagatggagttttgccatgttgcccaggttggtttcaaacttctgagctcaagcaattcctcctgcctcggcctcccaaagt

SEQ ID NO: 168034 - DNA, 601 bp, Human
agatattgccaaatgtttcctgggaaacaaaattgccgtcacctgagaaccactgctctaaacctaggtctcttcctaagcccaaatcaagttacctgattctggttcagaatgggctcttctgtctgtgaaatgctaaggtgtttagtgtatatagtaactttttacttaacgatataaacttaattaatttattatttttaataatgtttatgaagtggcttatattgtcttgcattcatcacttgcagtgtgcatatctcgccccccaaaacatggtgaacgttttataactccttcrcttttgtatgagaaaatttcactcaaaatttctcctctccactgtggccccagcagatgggctacaatctctggtagagccagagagaattaaattgagctaaccaaaatccccccagcctttttttttttttttttttgacagggtctcactttgtcccccaggctggagtacagtggtgtgagcacggcccactggaccctcgacctcccagggtcaagcgatcctcctgtctcagcctcctgagtagctgggaatacaggttcatgccactatacctgactaatttttgtacttttt

SEQ ID NO: 168035 - DNA, 601 bp, Human
aaacctcttttctttgtacattatccaatctcaggcattcctttttttttttttttttttttttttttgagacgaagtctcactttgtcgcccaggctggagtgcagtgatacgatctcggctcactgcaacctccgcctcccaggttcacaccattctcctgcctcagcctcccgagtagctgggactacaggcacccgccaccacgccaggctaattttttgtatttttagtagagacggggtttcaccgtgttaccaaggatggtctcgatctcctgacctcgtgatccacccgcctyggcctcccaaagtgctgggattacaggtgtgagccaccgcgcccggccaggcattccttgatagcaatgcaaaatagactaatacaacccttcctccttccttgtgctgtgacagtcaaaaatgttttcagatattgccaaatgtttcctgggaaacaaaattgccgtcacctgagaaccactgctctaaacctaggtctcttcctaagcccaaatcaagttacctgattctggttcagaatgggctcttctgtctgtgaaatgctaaggtgtttagtgtatatagtaactttttactta

SEQ ID NO: 168036 - DNA, 601 bp, Human
cccctttgccttccaccatgattgcaagcttcccaaggccttcattagaagcagatgcctagcactgtgcttcatgtacagccggcagagccatgaaccaacaaacctcttttctttgtacattatccaatctcaggcattcctttttttttttttttttttttttttttgagacgaagtctcactttgtcgcccaggctggagtgcagtgatacgatctcggctcactgcaacctccgcctcccaggttcacaccattctcctgcctcagcctcccgagtagctgggactacaggcaccygccaccacgccaggctaattttttgtatttttagtagagacggggtttcaccgtgttaccaaggatggtctcgatctcctgacctcgtgatccacccgccttggcctcccaaagtgctgggattacaggtgtgagccaccgcgcccggccaggcattccttgatagcaatgcaaaatagactaatacaacccttcctccttccttgtgctgtgacagtcaaaaatgttttcagatattgccaaatgtttcctgggaaacaaaattgccgtcacctgagaaccactgctctaaacctaggt

SEQ ID NO: 168037 - DNA, 601 bp, Human
ctcccctctggtagtgagttctggatcatctgttaattaatgtgagagtgagttattgaaaggagcctggcatccctcacctcttgctccctcttttgccatgtgatatatgggcttcccctttgccttccaccatgattgcaagcttcccaaggccttcattagaagcagatgcctagcactgtgcttcatgtacagccggcagagccatgaaccaacaaacctcttttctttgtacattatccaatctcaggcattcctttttttttttttttttttttttttttgagacgaagtctcrctttgtcgcccaggctggagtgcagtgatacgatctcggctcactgcaacctccgcctcccaggttcacaccattctcctgcctcagcctcccgagtagctgggactacaggcacccgccaccacgccaggctaattttttgtatttttagtagagacggggtttcaccgtgttaccaaggatggtctcgatctcctgacctcgtgatccacccgccttggcctcccaaagtgctgggattacaggtgtgagccaccgcgcccggccaggcattccttgatagcaatgcaaaatagacta

SEQ ID NO: 168038 - DNA, 601 bp, Human
aaatatgacctctaatgttggaggtgggctagtgggagatgtttgggtcttgggggtggatccctcatgaatgtcttggctcctcccctctggtagtgagttctggatcatctgttaattaatgtgagagtgagttattgaaaggagcctggcatccctcacctcttgctccctcttttgccatgtgatatatgggcttcccctttgccttccaccatgattgcaagcttcccaaggccttcattagaagcagatgcctagcactgtgcttcatgtacagccggcagagccatgaaccaayaaacctcttttctttgtacattatccaatctcaggcattcctttttttttttttttttttttttttttgagacgaagtctcactttgtcgcccaggctggagtgcagtgatacgatctcggctcactgcaacctccgcctcccaggttcacaccattctcctgcctcagcctcccgagtagctgggactacaggcacccgccaccacgccaggctaattttttgtatttttagtagagacggggtttcaccgtgttaccaaggatggtctcgatctcctgacctcgtgatccacccgcct

SEQ ID NO: 168039 - DNA, 601 bp, Human
tgtataacagcgtccagtgtacagtggcctctattccctacatgctagttgcacctatccatacccccgatatgatttagatgtttggtcccctccaaatctcatgctgaaatatgacctctaatgttggaggtgggctagtgggagatgtttgggtcttgggggtggatccctcatgaatgtcttggctcctcccctctggtagtgagttctggatcatctgttaattaatgtgagagtgagttattgaaaggagcctggcatccctcacctcttgctccctcttttgccatgtgatatrtgggcttcccctttgccttccaccatgattgcaagcttcccaaggccttcattagaagcagatgcctagcactgtgcttcatgtacagccggcagagccatgaaccaacaaacctcttttctttgtacattatccaatctcaggcattcctttttttttttttttttttttttttttgagacgaagtctcactttgtcgcccaggctggagtgcagtgatacgatctcggctcactgcaacctccgcctcccaggttcacaccattctcctgcctcagcctcccgagtagctgggactac

SEQ ID NO: 168040 - DNA, 601 bp, Human
ctgtgggagggtttcgtgcattgtgggatgtataacagcgtccagtgtacagtggcctctattccctacatgctagttgcacctatccatacccccgatatgatttagatgtttggtcccctccaaatctcatgctgaaatatgacctctaatgttggaggtgggctagtgggagatgtttgggtcttgggggtggatccctcatgaatgtcttggctcctcccctctggtagtgagttctggatcatctgttaattaatgtgagagtgagttattgaaaggagcctggcatccctcaccycttgctccctcttttgccatgtgatatatgggcttcccctttgccttccaccatgattgcaagcttcccaaggccttcattagaagcagatgcctagcactgtgcttcatgtacagccggcagagccatgaaccaacaaacctcttttctttgtacattatccaatctcaggcattcctttttttttttttttttttttttttttgagacgaagtctcactttgtcgcccaggctggagtgcagtgatacgatctcggctcactgcaacctccgcctcccaggttcacaccattctcctg

SEQ ID NO: 168041 - DNA, 601 bp, Human
taaaatggatggtagagaagtacataatagatgctgtctgtccgatggcgataaaagggtattcaacgggctgtcccccaattcatgtgagtgtaaatagttcggccattaagattcagaataggcactgactcaatggttggaatattatggtttgttgtttagacgtgtgaagtacaggaataactgctagaatgagaatggagaatacaagggccagtacgcctcctagtttgttagggatggatcgtaaagttgcataggcaaacaggaagtaccactctggcttaatgtgggatgsggtgttgatggggttggctaaagcgtagttatctgggtcgctcaggaggtcaggtgaaaatagtactagggttactagtaggaggaggagaaaaattaaacctaaaatatctttggttgtatagtaggggtgaaaggtaattttgtcgcggtctgaagaaacctctgaaaggttattagatcttgtttcatgcaggaataaaaggtgaacaggaatgaaaggtgaaatgtaaaagggattcttatatttgttgctaatggagatcagtaagtcagaagataagttatcattagttggtgg

SEQ ID NO: 168042 - DNA, 601 bp, Human
ataaaatggatggtagagaagtacataatagatgctgtctgtccgatggcgataaaagggtattcaacgggctgtcccccaattcatgtgagtgtaaatagttcggccattaagattcagaataggcactgactcaatggttggaatattatggtttgttgtttagacgtgtgaagtacaggaataactgctagaatgagaatggagaatacaagggccagtacgcctcctagtttgttagggatggatcgtaaagttgcataggcaaacaggaagtaccactctggcttaatgtgggatscggtgttgatggggttggctaaagcgtagttatctgggtcgctcaggaggtcaggtgaaaatagtactagggttactagtaggaggaggagaaaaattaaacctaaaatatctttggttgtatagtaggggtgaaaggtaattttgtcgcggtctgaagaaacctctgaaaggttattagatcttgtttcatgcaggaataaaaggtgaacaggaatgaaaggtgaaatgtaaaagggattcttatatttgttgctaatggagatcagtaagtcagaagataagttatcattagttggtg

SEQ ID NO: 168043 - DNA, 601 bp, Human
gaaacctcgtctctactaaaattagctgggcatggtggcgcatgcctgtagttccagctacttgggaggctgaggcggaagaattgtttgaacctggcaggtggaggttgcagtgagccgagattgcgctactgcactccagcctgggcaacagagcgagacaccgtctcgaaataaagtaaaataaaataaaatagaataaaataaaataaaataaaaaatataaaataaaataaaatggatggtagagaagtacataatagatgctgtctgtccgatggcgataaaagggtattcaackggctgtcccccaattcatgtgagtgtaaatagttcggccattaagattcagaataggcactgactcaatggttggaatattatggtttgttgtttagacgtgtgaagtacaggaataactgctagaatgagaatggagaatacaagggccagtacgcctcctagtttgttagggatggatcgtaaagttgcataggcaaacaggaagtaccactctggcttaatgtgggatgcggtgttgatggggttggctaaagcgtagttatctgggtcgctcaggaggtcaggtgaaaatagtact

SEQ ID NO: 168044 - DNA, 601 bp, Human
tgcaatacaaaggagttgggctggatctctaagcttcagtggtaacattttaagattctaaaatggatggtagaagggtcgggcgctgtggctcacgcctgtaatgccagcacattgggaggctgaagcaggtggatcacaaggtcaggagttagagaccagcctggccaacatggtgaaacctcgtctctactaaaattagctgggcatggtggcgcatgcctgtagttccagctacttgggaggctgaggcggaagaattgtttgaacctggcaggtggaggttgcagtgagccgagaytgcgctactgcactccagcctgggcaacagagcgagacaccgtctcgaaataaagtaaaataaaataaaatagaataaaataaaataaaataaaaaatataaaataaaataaaatggatggtagagaagtacataatagatgctgtctgtccgatggcgataaaagggtattcaacgggctgtcccccaattcatgtgagtgtaaatagttcggccattaagattcagaataggcactgactcaatggttggaatattatggtttgttgtttagacgtgtgaagtacaggaataactgct

SEQ ID NO: 168045 - DNA, 601 bp, Human
caaacctctgaactacagaatagttttcaactcaacaggaacctcctgagattcctattgaattgaaaactattctgtagctcagaggtttgaatgtgagatgttcaaaaggttactgggctgttagatgtcaaaaataaaacagaagaaacaggactggccagtgagttaggggcctgcgttctgcagctggttctgctatttagaaacctctgtggccttgagcaatcaattctgtctttttagggttcagtttccacatctgcaatacaaaggagttgggctggatctctaagcttcrgtggtaacattttaagattctaaaatggatggtagaagggtcgggcgctgtggctcacgcctgtaatgccagcacattgggaggctgaagcaggtggatcacaaggtcaggagttagagaccagcctggccaacatggtgaaacctcgtctctactaaaattagctgggcatggtggcgcatgcctgtagttccagctacttgggaggctgaggcggaagaattgtttgaacctggcaggtggaggttgcagtgagccgagattgcgctactgcactccagcctgggcaacagagcgaga

SEQ ID NO: 168046 - DNA, 601 bp, Human
gggtcccagaggggagatggccatctcctaagaataaacagtttcaccagaggccgagcttggaccatctgctcactgtttgctttggacggcgctggccaagaggtctcagggttaggctgtccccagagatgagagctcccccgagcaggctgcaggctgcctgcagcctgtcgcctggggctgccctgatatttccggaattttatagaaaggggaaggctgagcctaaaacctctctcgaaggcggccaccctgccaggcccagctcctcgcaaacaaagaagtcagttgggcgccscgaagctgctggccttctgagtggcggaaggcgccaggctcggtgattgaaaccacatgtgctggaggtttcaagagcagcgacccagacaccaggggactggctgcggctgctttttacgtctcctttgtccttggggtttccaaagtcagatcctctaactagaccaccagtatcccagcagaaagagtagtaattttattttttttttaatttgacgaaatagcatttctcccctccctcccccaaaccataaaatgaccggaaaccctcagggcccggggctgcctcctggcgact

SEQ ID NO: 168047 - DNA, 601 bp, Human
gacggggtagacctttcttaaagctcaaaaatggcatcaaattcagaggactcgcgtttagaaggaggaaggaggagatgcggaagggaaagaggagcaaagcctggtggagccgacagggtcccagaggggagatggccatctcctaagaataaacagtttcaccagaggccgagcttggaccatctgctcactgtttgctttggacggcgctggccaagaggtctcagggttaggctgtccccagagatgagagctcccccgagcaggctgcaggctgcctgcagcctgtcgcctgggsctgccctgatatttccggaattttatagaaaggggaaggctgagcctaaaacctctctcgaaggcggccaccctgccaggcccagctcctcgcaaacaaagaagtcagttgggcgccccgaagctgctggccttctgagtggcggaaggcgccaggctcggtgattgaaaccacatgtgctggaggtttcaagagcagcgacccagacaccaggggactggctgcggctgctttttacgtctcctttgtccttggggtttccaaagtcagatcctctaactagaccaccagtatcccagc

SEQ ID NO: 168048 - DNA, 601 bp, Human
gctgacttttccttgcagacctttctctttttttctttttcttttttttttttttttttttttttgagatggagtctcgctctgtcgcccaggctggagtgcagtggcgcgatctcggctcactgcaagctccgcctcccgggttcacgccattctcctgcctcagcctcccgagtagctgggactacaggcacccgccaccacgcccggctaattttttgtatttttagtagagacggggtagacctttcttaaagctcaaaaatggcatcaaattcagaggactcgcgtttagaaggargaaggaggagatgcggaagggaaagaggagcaaagcctggtggagccgacagggtcccagaggggagatggccatctcctaagaataaacagtttcaccagaggccgagcttggaccatctgctcactgtttgctttggacggcgctggccaagaggtctcagggttaggctgtccccagagatgagagctcccccgagcaggctgcaggctgcctgcagcctgtcgcctggggctgccctgatatttccggaattttatagaaaggggaaggctgagcctaaaacctctctcgaaggcg

SEQ ID NO: 168049 - DNA, 601 bp, Human
ttggctctgtctaggtctgcttactccagttttattaagaatcctactgagagagtttagtggaatcctcctctcggtctgaccaccgtcaacatcttcttacccttgcttccttttagcagaaatcttgttaagtcagtttagcaaagagttaccctacttcctagtgattttgcatccattgattcccctaccttgtttcttggctataaacttccactttcgcttattgtccctagatttgagccccatctctagcccatactacaaaaccccattgtagtagccactactatgatgsggttcagaacatcctaccccaaaatatgacaccttggcatattgagtattttaagccgaagaaatctgagaaagagcaggtgcaggaaggactgtctgaccttcccctcaagaaggtcataagcccctgatatgagaggcaacctccttatgcccagaggaaggagtgttcttgtctgtgaagacaggaacactgagacgaatctgagcggggaggccttgctgtctcccccagcttattacccttagatcatacccttttcccatgattttttactcttcatcaaacctagtaaaaaca

SEQ ID NO: 168050 - DNA, 601 bp, Human
tggagggaatttctaactcttcttactttaattttatatatttaagattagaagcaaaacaaaacaaatgaacaataaccaaaaataagcccaaaactaaccttttccaaactcttaaatactgggtttcaaaacacagtgtggaggatggttacttgagtgggtttgggtcacattggagtcctgattctgaccttaatctatctttctttcttttttcttttcttttctattttttttgaaatggagtttcgctcttgttgcccaggctggagtgcaatggtgtgatctcggttcactgcaacccctgtctcccgggtttgagtgattctcctgcctcagcctcccgagtagctgggattacaggtatgcgccaccacgtccggctaatttttgtatttttagtagagacgtggtttcaccatgttggccaggctggtttcgaactcctaacctcaggcaatccacctgccttagcctcccaaagtgctgggattacaggcgtgagccactgcacctgaccaagatccttaatttttctaaacctacgtttatcatctataaaatgagccatcttttcacatggctctcataaggatta

SEQ ID NO: 168051 - DNA, 601 bp, Human
caaaattaaaaaggaagaaagattatttatcgtccacccagtgcaaattaagaaaaatggtatggtctggatggtttttaagcaagtcaggagggagaagaaaaattttaacacccttcctttgacacaagctgatggcccctaagtgatgtcctcgcccagatggacagaagcccaccttcactggcaggcacccactgggaactgcattgttcctgcctcctgcacatgccagggaatggacagcaggcattctgggagggtgagggttgagctgtggaaaagggttggggaaaaaaaagtagttcaggagtcagaaaatagttcacaaatctaaaattccattcagagctgcttctaaacaccgtcatagcaaaaagtgtggtaagttctttgttttccttccccaaatggaatcgtttttttcttttcctttttttttttttttttttgagacggagtctcactctgtcacccaggctggagtgcagtggcgctatctcagcttactgcaacccctgcctcccgggttcaaatgattctcctgcctcagcctcccaagtagctgggattacaggtgtgcaccaccatgcctggctaa

SEQ ID NO: 168052 - DNA, 601 bp, Human
ggaggtgctgggaaatggccccaggaccatcaaggctttgccctgctttctgggcagggttcggcaaaattaaaaaggaagaaagattatttatcgtccacccagtgcaaattaagaaaaatggtatggtctggatggtttttaagcaagtcaggagggagaagaaaaattttaacacccttcctttgacacaagctgatggcccctaagtgatgtcctcgcccagatggacagaagcccaccttcactggcaggcacccactgggaactgcattgttcctgcctcctgcacatgccaggsaatggacagcaggcattctgggagggtgagggttgagctgtggaaaagggttggggaaaaaaaagtagttcaggagtcagaaaatagttcacaaatctaaaattccattcagagctgcttctaaacaccgtcatagcaaaaagtgtggtaagttctttgttttccttccccaaatggaatcgtttttttcttttcctttttttttttttttttttgagacggagtctcactctgtcacccaggctggagtgcagtggcgctatctcagcttactgcaacccctgcctcccgggttcaaat

SEQ ID NO: 168053 - DNA, 601 bp, Human
tggcgtggtggtgggtgcctgtaatcccagctactcaggaggctgaggcaggagaattgcttgaatccgggaggcagaggttgcagtgagccgagattgtaccattgcactccagcctgggcaatgagtgaaactctgtcttaatatacatatatataaaatatatcatatgatatattatataaaatatatatcatatgatatattatataaaatatatatcatatgatatattatataaaatatatatcatatgatatattatataaaatatatcatatgatatattatagattatatataattaatttcaaaaatttcaaatatattctaattcaaaattgaatattcaatttcaaaaataattgaatatattatataattatataatatatattgtaattatatagtatataatatatattatatttatataatataatatatattatatgatatatagttcagtatataaattttatatatataaatattatatttatataaaataatattatatattatataatatatagatatagttcagtaccacttctcatttgaccactttatcttatacatcaggcagctaaatgacaag

SEQ ID NO: 168054 - DNA, 601 bp, Human
gtttggcgtggtggtgggtgcctgtaatcccagctactcaggaggctgaggcaggagaattgcttgaatccgggaggcagaggttgcagtgagccgagattgtaccattgcactccagcctgggcaatgagtgaaactctgtcttaatatacatatatataaaatatatcatatgatatattatataaaatatatatcatatgatatattatataaaatatatatcatatgatatattatataaaatatatatcatatgatatattatataaaatatatcatatgatatattatagattatatataattaatttcaaaaatttcaaatatattctaattcaaaattgaatattcaatttcaaaaataattgaatatattatataattatataatatatattgtaattatatagtatataatatatattatatttatataatataatatatattatatgatatatagttcagtatataaattttatatatataaatattatatttatataaaataatattatatattatataatatatagatatagttcagtaccacttctcatttgaccactttatcttatacatcaggcagctaaatgac

SEQ ID NO: 168055 - DNA, 601 bp, Human
aaaaaattagtttggcgtggtggtgggtgcctgtaatcccagctactcaggaggctgaggcaggagaattgcttgaatccgggaggcagaggttgcagtgagccgagattgtaccattgcactccagcctgggcaatgagtgaaactctgtcttaatatacatatatataaaatatatcatatgatatattatataaaatatatatcatatgatatattatataaaatatatatcatatgatatattatataaaatatatatcatatgatatattatataaaatatatcatatgatatattatagattatatataattaatttcaaaaatttcaaatatattctaattcaaaattgaatattcaatttcaaaaataattgaatatattatataattatataatatatattgtaattatatagtatataatatatattatatttatataatataatatatattatatgatatatagttcagtatataaattttatatatataaatattatatttatataaaataatattatatattatataatatatagatatagttcagtaccacttctcatttgaccactttatcttatacatcaggcag

SEQ ID NO: 168056 - DNA, 601 bp, Human
atacaaaaaattagtttggcgtggtggtgggtgcctgtaatcccagctactcaggaggctgaggcaggagaattgcttgaatccgggaggcagaggttgcagtgagccgagattgtaccattgcactccagcctgggcaatgagtgaaactctgtcttaatatacatatatataaaatatatcatatgatatattatataaaatatatatcatatgatatattatataaaatatatatcatatgatatattatataaaatatatatcatatgatatattatataaaatatatcatatgatatattatagattatatataattaatttcaaaaatttcaaatatattctaattcaaaattgaatattcaatttcaaaaataattgaatatattatataattatataatatatattgtaattatatagtatataatatatattatatttatataatataatatatattatatgatatatagttcagtatataaattttatatatataaatattatatttatataaaataatattatatattatataatatatagatatagttcagtaccacttctcatttgaccactttatcttatacatcag

SEQ ID NO: 168057 - DNA, 601 bp, Human
tgaggattaaaggtgtgagccactgcacctggtctcctgcctttctactcttgagctaagtttatgaagacagtaataagaaaacagaactaggctgggtgcagtagctcacgcctgtaatcccagcactttgggaggccgaggtgggtggatcacaaggtcagaagatcgagaccatcctggcaaacacggtgaaaccccgtctctactaaaaatacaaaaaattagccaggcgtggtggtgggcgcctgtagtcccagctacttgggagactcaggcaggagaatggcacgaacctggraggcggagcttgcagtgaaccaggatggcgctactgcactccagcctgggcgagagtgcgagactccatcttaaaaaaaaaaaagaaagaaaacagaactagtctcttccctcatgacacttataattgtatgaaaaagactcatagtaatgagagaaataattataagaatttaattatattaaatgtgataagttaaatataattaagtgtataaatgtgataaatgctataaaggaaaagtacaggaaactatgaacatataattccatctttaaataatttctttttttttctttt

SEQ ID NO: 168058 - DNA, 601 bp, Human
ctcccaaagtgttgggattacaggcatgaactaccacgcacagcttacggttttcccagttgattggtttgctaatctttgagattaatccagaggcaagcagagatctatttcacccctaccccacaaaacccctcttaaatatccaagatttttggtgggctgtggtgtcacaggtgagtgaattgaaatcattaggtagttggatgtatttcattcagcatgcaggactatctggcagcagagactagaagggccaaatcctacttctctggattttgcctctgcaataatctaacarccatctgcttacatcactttttagaataaccagtcatttaatgtcgttcattcatttaataaatacttattgaacacttgctatatgtcagtcaccatctgcagcgctgggcatacagcagtgaacaaaacggatattctccttattttgtccttctcagaaatgcgtacatatccctgagggtcttgggcagtgagacagaaacatatagcattctaaaataattatgtaatcaatattttcttggagtgtcagtttactaaataagtaattgaaaacactgccctgtatttaaatata

SEQ ID NO: 168059 - DNA, 601 bp, Human
ctctgctcaaaataactcgttcttgcaccctcatcccttttgctgtgtttgcagcttggaaaccctaccagacaccgaggccttcttaggaaaaatatttgtttaaatctttcgctttctctgtggtctttaaaagccactaagccactctggtttctagtccaggaatcagcttttctgggcgtatcatattgcccagctgtgacccttccaggcacgtgaactctgcagaattctagcagagatctgaagatttttttcttttctttctttctttctttccttttttttttttttttttaagacagagtcttgctctgtcactcaggttggagtgcagtggtgtgatcttggctcactgcagcctccacctcccgggttcaagccattctcgtggatcagcctcccaagtagctgggattacaggcatgtgccaccacactggctaatttttgaatttttgtagagacagtgcttcaccatgttggctaggctggtcttgaactgctggcctcaagtgatctgcccacctcagcctcccaaagtgctgggattacaggggtaatcccactgtgcctggccaaggtttttgtacatgaga

SEQ ID NO: 168060 - DNA, 601 bp, Human
tcatacacccatctttcagatgttggacctcctggattgatcctctatttttttttagatcttttctctcatgttgtttggttgagttgttccaagagtttgtcaagagatctcttggatggcattataagataattgttaaaatcagcaattcaaataccagaaaaattattttctagttctacaagcttgggcaagttctttatcctctcttagttttcttgtctataaaatggaggaaataattgtattcaattatttgatgattaaatgatgattattaaagcatgttatgagaatygagttagttttaatacatgtctgaaacatagtaaatgttcaataaattttgctattattgttgttattattatcctattcttgtttgatggatacagtgtcttccattatgtctctcaggatattaatcacagggttccttgcatagtctttgtttctattcgcttttctcttacttttctcaaacgtctcatgttatattcagagatactaaaaagctgtttggggccgggcgcggtggctcacgcttgtaatcccagcactttgggaggccgaggtgggaggatcacgaggtcaggag

SEQ ID NO: 168061 - DNA, 601 bp, Human
atctaattaattattagcatcccttaaaaagctttttcgaataacgtaatgtaagcatatggtaaacattcaaacagaacaaaatagtatacagtgaaaagtaagtctgtctcacagtgaccctcagttttcctcctaccagttcatatgcattttatgtctcacattattttgttgttttttttttgagactgagtctggctttgttgctcagactggagtacagcggtgcaatgtctgctcacagcaatctctgcctcctggattcaagcgattctcctgtctcagcctccccagtagytgggattagaggcacacgccaccaagcccagctaatttttgtatttttattagagacaaggtttcaccatgttggctaggctggtctcgaactcctgacctcaggtgatccacccactctggcctcccaaactgctggaattacaggtgtgagccaccgcgcctggcatagggtcttatctttattcctggagttgtaaaattttactatgatgggttttggtataagactttttcccattcacttattttgatgtgccttttaatctaaagactcatttaaatgtcaggaaatgttgtt

SEQ ID NO: 168062 - DNA, 601 bp, Human
ttcatcagagcatcaaaccagttctggctgactgcctttcctgtagacctggtgtgcttacaggggtaacgaagaacaagaaatcacccaagtactttaatatctaagatgggcagttcacaaatctaattaattattagcatcccttaaaaagctttttcgaataacgtaatgtaagcatatggtaaacattcaaacagaacaaaatagtatacagtgaaaagtaagtctgtctcacagtgaccctcagttttcctcctaccagttcatatgcattttatgtctcacattattttgttgttttttttttgagactgagtctggctttgttgctcagactggagtacagcggtgcaatgtctgctcacagcaatctctgcctcctggattcaagcgattctcctgtctcagcctccccagtagttgggattagaggcacacgccaccaagcccagctaatttttgtatttttattagagacaaggtttcaccatgttggctaggctggtctcgaactcctgacctcaggtgatccacccactctggcctcccaaactgctggaattacaggtgtgagccaccgcgcctggcatagggtctt

SEQ ID NO: 168063 - DNA, 601 bp, Human
tcccctgactttactttcttcctgtccttccctcacacccaaatgactcaaatggctgcctcacactcacgtactcattcattcactcatgtatttactcaaatgacctaactatgagtcttgagtttgtcttgccaggggattgtcttccaggtgatctttgcattttcttttcttttctttctttctttctttctttctttctttctttctttctttctttctttctttctttctttctttctttctctctctctctctctctctctctctctctctctctctctctctccctctccctctctctctctctctctctctctctctctctctctctttctttttttgagatggagtttcactcttgttgcccaggctggagtgcaatggcatgatcttggctcaccacaacctccacctcccgggatcaagcgattcccctgcctcagcctcccgagtagctggaattacaggcacgcgccaccacacccagctaattttgtatttttagtagagagggggtttctccatgttggtcagactggtctcaaactcccgacctcaggtgatccgcctgcctcggcctcccaaagtgctggga

SEQ ID NO: 168064 - DNA, 601 bp, Human
atttcccctgactttactttcttcctgtccttccctcacacccaaatgactcaaatggctgcctcacactcacgtactcattcattcactcatgtatttactcaaatgacctaactatgagtcttgagtttgtcttgccaggggattgtcttccaggtgatctttgcattttcttttcttttctttctttctttctttctttctttctttctttctttctttctttctttctttctttctttctttctttctctctctctctctctctctctctctctctctctctctctctctccctctccctctctctctctctctctctctctctctctctctctctttctttttttgagatggagtttcactcttgttgcccaggctggagtgcaatggcatgatcttggctcaccacaacctccacctcccgggatcaagcgattcccctgcctcagcctcccgagtagctggaattacaggcacgcgccaccacacccagctaattttgtatttttagtagagagggggtttctccatgttggtcagactggtctcaaactcccgacctcaggtgatccgcctgcctcggcctcccaaagtgctg

SEQ ID NO: 168065 - DNA, 601 bp, Human
catagggcaatttttacaaaagctgtaccatcctgatcttagcaggaaaaaaggaattatcttcaaagagtatggcaggtagaatatgaaaggcagtaattcactctctttatggcatttgtgtacagcactaaagaatgtggcggtcttcctccaagacactgatgctactcacctatgatcactggggagaaatctttggaatatattcttatgaatgtgttcatggaaagctgaccatatgcatcataccattcatttaatatacactttttaagtggctttaaaacaaccagtgtayaggttcgcaaagactgcaataaacttttttttctttttttgagatggagtctctctctgttgcccaggctggagtgcagtagcacaatcttggctcactgcaacctctgcctccggagttcaagcgattctcctgtctcagcctcccaagtagctgggattataggcatgcaccaccatgcctggctaatttttcttttgtatttttaatagagacaaggtttcaacatgttggccaggctagtctcgaactcctgacctcaggtgatcttcctgccttggcctcccaaagtgctgggat

SEQ ID NO: 168066 - DNA, 601 bp, Human
gcattttagagtaggctttcagaaactacatgtcattaatgtaatgctgatcagaaacaagtagacacaaaagagtacattctataggattccattctatatgattccagggtacagaaacagaaaaaaaaaatctgtgctgttagaagtctaggtagtggttactcctggagtaagcagtagtgaatataagggaacatggtggggccttccaaggtgccggttctatttcttgatttgggtgcttgttacttgggtgtgaccatttcacgaaatttgttgagctctttatgatggctgygttcttctgtatgtatattatattttatattatctattgctgcataccaaattgtcccagaacttagcagctcgaaacaataaacgtgttatctcatagtttctgtgggtcaggaatctgagcatggcttagctgggtggctctgactcagggtctctcatgaaatacaaactgttggatggggttgtagtctcatctgaaggctcgcatgaggtggagggagatttacttctaaactcactcatgaggttgttagcagctttcaatcctcaccatatggacctctccacagggctgcct

SEQ ID NO: 168067 - DNA, 601 bp, Human
attacaggtgtgagccactgcacctggcctagaaatgtttttcaatttatttttctttacttagactcccattttttacatatatataaactcacagtcttctttactgttatttggaatagattaaatattatgattcaacaatggcattttagagtaggctttcagaaactacatgtcattaatgtaatgctgatcagaaacaagtagacacaaaagagtacattctataggattccattctatatgattccagggtacagaaacagaaaaaaaaaatctgtgctgttagaagtctagrtagtggttactcctggagtaagcagtagtgaatataagggaacatggtggggccttccaaggtgccggttctatttcttgatttgggtgcttgttacttgggtgtgaccatttcacgaaatttgttgagctctttatgatggctgtgttcttctgtatgtatattatattttatattatctattgctgcataccaaattgtcccagaacttagcagctcgaaacaataaacgtgttatctcatagtttctgtgggtcaggaatctgagcatggcttagctgggtggctctgactcagggt

SEQ ID NO: 168068 - DNA, 601 bp, Human
aggctctcaaagtgctgggattacaggtgtgagccactgcacctggcctagaaatgtttttcaatttatttttctttacttagactcccattttttacatatatataaactcacagtcttctttactgttatttggaatagattaaatattatgattcaacaatggcattttagagtaggctttcagaaactacatgtcattaatgtaatgctgatcagaaacaagtagacacaaaagagtacattctataggattccattctatatgattccagggtacagaaacagaaaaaaaaaatcygtgctgttagaagtctaggtagtggttactcctggagtaagcagtagtgaatataagggaacatggtggggccttccaaggtgccggttctatttcttgatttgggtgcttgttacttgggtgtgaccatttcacgaaatttgttgagctctttatgatggctgtgttcttctgtatgtatattatattttatattatctattgctgcataccaaattgtcccagaacttagcagctcgaaacaataaacgtgttatctcatagtttctgtgggtcaggaatctgagcatggcttagctg

SEQ ID NO: 168069 - DNA, 601 bp, Human
gtgttgcccaggctggtctccaactcctgggctcaagcgatcctcttttctaggctctcaaagtgctgggattacaggtgtgagccactgcacctggcctagaaatgtttttcaatttatttttctttacttagactcccattttttacatatatataaactcacagtcttctttactgttatttggaatagattaaatattatgattcaacaatggcattttagagtaggctttcagaaactacatgtcattaatgtaatgctgatcagaaacaagtagacacaaaagagtacattctayaggattccattctatatgattccagggtacagaaacagaaaaaaaaaatctgtgctgttagaagtctaggtagtggttactcctggagtaagcagtagtgaatataagggaacatggtggggccttccaaggtgccggttctatttcttgatttgggtgcttgttacttgggtgtgaccatttcacgaaatttgttgagctctttatgatggctgtgttcttctgtatgtatattatattttatattatctattgctgcataccaaattgtcccagaacttagcagctcgaaacaataaa

SEQ ID NO: 168070 - DNA, 601 bp, Human
catactgtgcctggaagctgcactgctattctacagactgggggttgactatttgggagtaatgttttgtgttgatttctccagtaataattgtcaggataaggataacaatctggtccacaaagatcactccaccattcagaaatacagcaggtacctctctgaattctgtccttgataatatgctatttatggttccatgcatgtattcatgtttacacatgcagaaacacacacacacaactgcttgaacaccctggcaagaatgcctgtgccagtacacagatcaggcaagaatgtrtgcttttgattccgagactctcagagatccagatctcatgctaacctatttcattgacatgtctatttatagtcgctgtctcgttccaaatgtgaagtcgctttctaaatctaaatcttttattaccttcgtcagagagattcgaacagaggcagagggggcgggaattaaaaatagacacagacttactatgaaaaagaaaataatcgattgttagggatccatggccaggaagaattgagattatgttgataattaaaatccactgacaaatcctcaattcagcctttagttttatcc

SEQ ID NO: 168071 - DNA, 601 bp, Human
cactgtggacccttcgtcctgataggttctcaaagtctggtggtgggaaggaggatggtcagtaataaaacatactgtgcctggaagctgcactgctattctacagactgggggttgactatttgggagtaatgttttgtgttgatttctccagtaataattgtcaggataaggataacaatctggtccacaaagatcactccaccattcagaaatacagcaggtacctctctgaattctgtccttgataatatgctatttatggttccatgcatgtattcatgtttacacatgcagaaaaacacacacacaactgcttgaacaccctggcaagaatgcctgtgccagtacacagatcaggcaagaatgtatgcttttgattccgagactctcagagatccagatctcatgctaacctatttcattgacatgtctatttatagtcgctgtctcgttccaaatgtgaagtcgctttctaaatctaaatcttttattaccttcgtcagagagattcgaacagaggcagagggggcgggaattaaaaatagacacagacttactatgaaaaagaaaataatcgattgttagggatccatggcca

SEQ ID NO: 168072 - DNA, 601 bp, Human
tgaaatcacggcaaaacggttccaagatcttgacaggtctgttagtacccatttttttttttttttttttttgagacgaagtctcgctctgtcacccaggctggagtgcagtggcgcaatcttggctcactgcaagctccgcctcccgggttcacgccattctcctgcctcagcctcctgcatagctgggactacaggtgcccgccaccacgccctgctaattttttgtatttttagtagagacggggtttcaccgtgttaggcaggatggtctcgatctcctgaccttgtgatctgccckcctcgacctcccaaagtactgggattacaggcgtgagccaccacactcacccagtacccaatttttaattattgtatatcataacatattcaaggatactgatgctacaacattttcttaaacaccccttatgcttccagttgtgggtaccacaaattagcaggtacattgacaaaataattggcacccagaggtgagtaacctggagtgcatatttgttcaataaatgtgagcagcacctgttaccattctaggtgctgccagggatacagaaatgaatgacattgtcttttgtgtatc

SEQ ID NO: 168073 - DNA, 601 bp, Human
gtttttagtagagacggagtttcaccgtgttggcctggctggcatggaactcctgacctcaggtgatcggcccaccgcagcctcccaaagtgctgggattacaggtgtgagccaccatgcccggccatagttttgttccattattaacatgacttttcaagattgttgaagggacttttcaagattgttgaagcgctttttcaaagaactgaaaagaactggcccatccaactacagcatttctttcctttctgttgctcttttaatccacaagggggcagaatttacttagggaggattwgccaggcctcacctttaaggtagttattcttagtaacaaggattctaatggacaaagaatgacagactactttggatttaagcttataagcactttgctgccatttgtggttatgtgctaaatttccaaccacgtgcattgaatgttcaaaggcccatggaaaaaatgaaaatcttagaaaatacggttaggcatttgagaggaacttttcccaggaaatagaaacgtacactactttaataacttaagatcactgttttaacttattccaactgaagcagatgtttactttgtttgtct

SEQ ID NO: 168074 - DNA, 601 bp, Human
aattacagctgtgagccaccatgccctgctattatgagattttattgtgattttattctatttttttttttagctcatcagctgttgttagtgtattttatgtgtggcccaagataattcttcttcttccagtgtggctcagggaagcaaaaagattggacactcttgaacagtttattaaatttgtatgccttttctcctattaatctgcctcttgtcagtgcttttcaatgaaccttcagcgggcagacgggaagttttcccttcaccccagctacatatataattctgtaggaggtgtgtgtgtgtgtgtgtgtgtgtgtgtgtgtgtgtgtgtgtgcgcgcgcgcgcgcgcacgtgcctgccttccagattgtttatggaacactgtatgcagttcaagacacagcatgatgcaatagaaagaggatgagctttggagtctgagaggtctggacttgagtagtggctgtaagaccaattaattccctgattgctccaagttgtttacttttccgtaaaaggaaaataaaaacatcaactttggaagttattgtaagcattacatatgatgcatgaaagtgtctagcactggcgcatg

SEQ ID NO: 168075 - DNA, 601 bp, Human
ggaattacagctgtgagccaccatgccctgctattatgagattttattgtgattttattctatttttttttttagctcatcagctgttgttagtgtattttatgtgtggcccaagataattcttcttcttccagtgtggctcagggaagcaaaaagattggacactcttgaacagtttattaaatttgtatgccttttctcctattaatctgcctcttgtcagtgcttttcaatgaaccttcagcgggcagacgggaagttttcccttcaccccagctacatatataattctgtaggaggrgtgtgtgtgtgtgtgtgtgtgtgtgtgtgtgtgtgtgtgtgcgcgcgcgcgcgcgcacgtgcctgccttccagattgtttatggaacactgtatgcagttcaagacacagcatgatgcaatagaaagaggatgagctttggagtctgagaggtctggacttgagtagtggctgtaagaccaattaattccctgattgctccaagttgtttacttttccgtaaaaggaaaataaaaacatcaactttggaagttattgtaagcattacatatgatgcatgaaagtgtctagcactggcgca

SEQ ID NO: 168076 - DNA, 601 bp, Human
ctcctgacctcgtgatccgcccacctcggcctcccaaagtgatgggattacaggtgacagccaccgtgcccagccaggttttttttttttttgagatagtcttgctctgtcacccaggctggagtgcagtggctcgatctcctctcactgcaacctccgcctcccaggttccagtgattctcctgcctcagcctcccgagtagctttttttttttttttttttttgtatttttagtagagacaggatttcaccatgttggtcaggctggtctcgaactcttggcctcaagtgatccacccrcctcagcctcccaaagtgctggaattacaggtgtgagctaccacgcccagcctcctcctgcccaattttatgtggcttccaggatgtctggttctcccattatcctgtaagctctttgacatcaagtaccattcattgctgccttctcatagtactcagcccagggtctcacactgcaggtgttcaattaatatttgttgaatttatctgagtgtaacccacacgctcatttttaccaatgagcaaactaagacccaggggtaaaagagacagcccaaggtcctacaactcatttagcgg

SEQ ID NO: 168077 - DNA, 601 bp, Human
gtagctgggactacaggcatgtgccaccacacccagctaatttttgtatttttagtagagacagggtttcaccacgttggccaagatggtctcaatctcctgacctcgtgatccgcccacctcggcctcccaaagtgatgggattacaggtgacagccaccgtgcccagccaggttttttttttttttgagatagtcttgctctgtcacccaggctggagtgcagtggctcgatctcctctcactgcaacctccgcctcccaggttccagtgattctcctgcctcagcctcccgagtagctttttttttttttttttttttgtatttttagtagagacaggatttcaccatgttggtcaggctggtctcgaactcttggcctcaagtgatccacccgcctcagcctcccaaagtgctggaattacaggtgtgagctaccacgcccagcctcctcctgcccaattttatgtggcttccaggatgtctggttctcccattatcctgtaagctctttgacatcaagtaccattcattgctgccttctcatagtactcagcccagggtctcacactgcaggtgttcaattaatatttgttgaatt

SEQ ID NO: 168078 - DNA, 601 bp, Human
gggaggagccctcagaggcatctgaaacggccttggcaagtgttatatcagtgggaaaattataacagtaagctaaactaaccctccctggatcttccctttcccttaattattcctgggctattgggccaagctaactttggaagacatttaggttacagtttaaatgataacaggccttgcccaaaactcaaccgcttttgcaaagctaatgggaggccatcaggctgggaaggagagactaaatcctggtaaggcacaggcataagccattgtcagccattactccaaggttataagwtatgcaacttccaggccgggtgcggtggctcatgcctgtaatcccagcactttgggaggccagagtgggtggactgcttgagtccaggagttttgagaccagcctgggcaacatggccaaaccctatctccactaaaaatgcaaaaattagccaggcatggcggcccagcctgtagtcccagctacttggggggctgaggtgggaggatcacctgagcttggaaagtcgaggctgttgtgagccatgattgcaccactgcactccagcatgggtgacagagtaagaccctgtctctaaaa

SEQ ID NO: 168079 - DNA, 601 bp, Human
ttcttaagttatagagtcatagtcatttgaagctggagaaaaccttagagatgaaccttcttactttctttaagtctagtaacagttgttgctgaccagtagcatgtatttagaaggatgaaaagacaattacacaaatactgtagtataaagggaaattatttatgatcaaagggctatgcaaatttagaggagagaaattataggcaattaattatagggttcaggaaaagctgaaatccttccagggttttgtaaatattagaaacagagtatgtaaatcatctagcatagtgtttarcactgagtggctctgaataaaaggcaatttattttattatggagaaggtgacatttgatatggagcttggaaaatggaattcatgtggatagaatagaggaggaggaaaggtgttgagatgttgggggagatgatgggatcaaaagcacaggatgggagaggcggtggggggcagatattcagtgaatggtaatagttcagcttggctggtgtgaagaagaaatgtggaaaaataaaacaaattatgcgggaaaagtgaagcagttgatgggataaaagtcctttcttgccgcagtgagc

SEQ ID NO: 168080 - DNA, 601 bp, Human
tgtttacacacatgtgggcatacctcagctccttatttgtaaaatgggcccattaatcctagttatcagtattacattaacaaattttaaaaattgttttagaaatgggagttctcactctgttgctcaggccatctggaactcctggcctcaagtagtcctcccacctcaacctcccgagtagctgggactacaggcacaagctactgcaactggcacatattaaataacatgagataatacgtgctaaacagatttgcacctggcatatttattggtttctttgttcctacctttctamctaccccttcccctcctttcttaaaagaaaaattatttaagagatagaatctcactgtgtcacccaggctggtctcaaactcctgggttcaagcaatctacccacctcagcctcctgagtagctgagattgcagacactagccactgtgccaggctctttgtaaaaaattattaaatgtcttctcactataacctctaagaaggcaaggactatgatgtcttcttcactattgtatcctggtacctagcatggcatacagtaagtgctaaataagtttgtgtaatctgaatgattgaata

SEQ ID NO: 168081 - DNA, 601 bp, Human
cctcaagatcaagctcaaggaccactttctgtatatagcctttctcgactccccagttagaatggtgactccctgcttcaacctgtggtgtttggggcatactgctaccatagtgcacagtacgttcaggtaggtctgactccatctgcttttcctcgctttccctaaaatcttgtctccacacacacacacacacacacaaagacacacacttttttttctttttgagacggagcctagctctgtcgcccaggttggagtgcagtggcacaatcttggcccactgcaacctccacctccygggttcaagcgattcttctgcctcagcctctcgagtagctgggactacaggcacacaccaccacgcccggctaatttttgtatttttagtagagactgggtgtcaccatattggccaggttggtcttgaactcttgaccttgtgatccacccgccttggcctcccaaagtgctgggattacaggcgtgagccactgtgcctggccacatttttcttttcttttttgagacagagactctctcttttgcccaggctggagtacagtgatgcaatctcagctccctgcaaccttcgcctcct

SEQ ID NO: 168082 - DNA, 601 bp, Human
ctcggctttgattacacagttttttctttctgaaatgccttttcctcttctatttttgcctcaacaacacctatataaggcctcaagatcaagctcaaggaccactttctgtatatagcctttctcgactccccagttagaatggtgactccctgcttcaacctgtggtgtttggggcatactgctaccatagtgcacagtacgttcaggtaggtctgactccatctgcttttcctcgctttccctaaaatcttgtctccacacacacacacacacacacaaagacacacacttttttttytttttgagacggagcctagctctgtcgcccaggttggagtgcagtggcacaatcttggcccactgcaacctccacctcccgggttcaagcgattcttctgcctcagcctctcgagtagctgggactacaggcacacaccaccacgcccggctaatttttgtatttttagtagagactgggtgtcaccatattggccaggttggtcttgaactcttgaccttgtgatccacccgccttggcctcccaaagtgctgggattacaggcgtgagccactgtgcctggccacatttttcttttct

SEQ ID NO: 168083 - DNA, 601 bp, Human
tgatagatctcggctttgattacacagttttttctttctgaaatgccttttcctcttctatttttgcctcaacaacacctatataaggcctcaagatcaagctcaaggaccactttctgtatatagcctttctcgactccccagttagaatggtgactccctgcttcaacctgtggtgtttggggcatactgctaccatagtgcacagtacgttcaggtaggtctgactccatctgcttttcctcgctttccctaaaatcttgtctccacacacacacacacacacacaaagacacacacttttttttctttttgagacggagcctagctctgtcgcccaggttggagtgcagtggcacaatcttggcccactgcaacctccacctcccgggttcaagcgattcttctgcctcagcctctcgagtagctgggactacaggcacacaccaccacgcccggctaatttttgtatttttagtagagactgggtgtcaccatattggccaggttggtcttgaactcttgaccttgtgatccacccgccttggcctcccaaagtgctgggattacaggcgtgagccactgtgcctggccacatttt

SEQ ID NO: 168084 - DNA, 601 bp, Human
cacctatgccagcgcagtctggaccatgcctcatttttgactcctgccctcacatctctgaatctcgttgtccccaaacctgatgtttcttgattctgaatagtgtcttctgatagatctcggctttgattacacagttttttctttctgaaatgccttttcctcttctatttttgcctcaacaacacctatataaggcctcaagatcaagctcaaggaccactttctgtatatagcctttctcgactccccagttagaatggtgactccctgcttcaacctgtggtgtttggggcatacygctaccatagtgcacagtacgttcaggtaggtctgactccatctgcttttcctcgctttccctaaaatcttgtctccacacacacacacacacacacaaagacacacacttttttttctttttgagacggagcctagctctgtcgcccaggttggagtgcagtggcacaatcttggcccactgcaacctccacctcccgggttcaagcgattcttctgcctcagcctctcgagtagctgggactacaggcacacaccaccacgcccggctaatttttgtatttttagtagagactgggtg

SEQ ID NO: 168085 - DNA, 601 bp, Human
ccagatgcataatcacctacaatgaagtcagtttgtactttctaggagaatgaagagaggcaaaacctacaagacagtgaagcactgggtaatttttaggaactttggggttttgtgggctttgacaggtgggtgacctttttggcctgagagctttggaatttctttcttgtttattttatttatttatttttgagatggagtttcactcttgttgcccaggctggagtgcagtggcgtaatctccactcattgcaacctccgcctcctgggttcaagcgattctcctgtctcagcctcycaagtagccgggattacaggcattcaccaccacaccagctaattttgtatttttagtagagacggggttttaccatgttggtcaggctggtctcgaactcctgacctcaggtgatccacccgccttagcttcccaaagtgctgggattccaggcgtgagccatggcgcccagctgcttgtttattttagtatttgggttagcatccagagatgccttcgtcttgaaatatatatttgaatttgaagaatcttagtagctgtggtccaaagtagagtcaggctgctttggacgctagaaca

SEQ ID NO: 168086 - DNA, 601 bp, Human
caaatctcttctttggttcaagtgatttataatcaagtgagattaacaaggaaagactattaaacagagaaaaagaaatgatttatttgaaatagtatcaaggagagtgtcccagacaagttggtggcatttgagctaggctttgagaggcaaggagaaaaggcctggagggagcattccagctacacagaagggcactaaaaaaggcatgcaagcatatgggcatctcccaggcacatttcagctgcagctgttccaaattgtttcactcaagccctcaaccctgcctttgatcacgtgytgctccacagctcttcagagcctttcctgagaaggttctctcaatcagataaaacctatgaactctgacccagaaaaaactcacatattattttgcagataattccatggggttcctagcactcaagggaaagccctctgctttaggcacagatggggaagagctaggatcacagcccttctcctggatgtggtacttgtttgttctaaatatttgtgggggccagatgcgtggtggttcacgcctgtaatccaagcactttgggagaccaaggctggtggtttgcttgagcccaggagg

SEQ ID NO: 168087 - DNA, 601 bp, Human
ttctccagccatctgttttggtcaacttttgagtggggattcaactagccttgctttacactacccccaccaaaacatccacctccatcccctaagcacacatacccgcaactccagtggtgctgttttaatttttggggcagaggctgcctcattacttctcaaagaagacacattattattggacattttaggaaagttgagcatggttttactgatacagaagtgtattaatttggaagcaattaagtagaacttggtagctcttgctgtcaaaaaacagaaatgaatttgaatcatrtctgagagacttaaatatgaagatcccacttaaatattagagaatatgttttgtaatggacaactatggaaaattgctcttatattttcattttttattatggctataatacagaagatacacatttctttccagggaactggacgaggtgacctctgaatgtgtaatccaaagtactgaacatgatgttttgtaccaccgtgatgcatatggctatccctcttagataccttagaaataagctgtagacattcactttggcatcctatcttacctaagacttttaagatgacatggctc

SEQ ID NO: 168088 - DNA, 601 bp, Human
tcacaccactgcactccagcctgggtgacagagcaagaccctgtccagaaaaaaaaaaaaaaaggaaaaaaagaaaaactctatgagacagttaactattattctcctttatagattgggaaatatgcctaaggtactacagagttagtggtagctgtgattgaaatccaggcagttatctgactccacggctgatgctcttagtcgcctactactgtctctcatctgtacttgaagcaaatcaaattcttgattataacacatgtacacacgtgtgtgtgcatgagcacatgcacatacrcactcacaaacactctgtggaggggagaaatctcatctacttgcctagaatggtagtggcatataactaactagctgcacggttttgtttgtttttgtttttaggaatggtgtttatttagtactcccctggatatagtgaatttctttagggggctggctaattcacatgtttgtaaatacagagtcaactggtgtgtttttgttttttttggttggagtctcgccctgttgtccaggctggagtgcaatggcaccatctcggctcactgcaacctccgtgtctcaggttaaagcaatt

SEQ ID NO: 168089 - DNA, 601 bp, Human
ggcgttgcgcatgccggtaatcgcagcactctgggaggtgaagaagggtggatcgcctaagtccaggagttcaagaccagcctggccaatgtggcaaaaccctgtctctacaaaaattagccaggtgtgacggcatgtgcctgtaattccagctactcaggaggctgaggcaggagagtcgcttgaacccgggaggcagaggctgcagtaagccaagatcacaccactgcactccagcctgggtgacagagcaagaccctgtccagaaaaaaaaaaaaaaaggaaaaaaagaaaaactctrtgagacagttaactattattctcctttatagattgggaaatatgcctaaggtactacagagttagtggtagctgtgattgaaatccaggcagttatctgactccacggctgatgctcttagtcgcctactactgtctctcatctgtacttgaagcaaatcaaattcttgattataacacatgtacacacgtgtgtgtgcatgagcacatgcacatacgcactcacaaacactctgtggaggggagaaatctcatctacttgcctagaatggtagtggcatataactaactagctgcacgg

SEQ ID NO: 168090 - DNA, 601 bp, Human
agaaataataataatagctaatgttactgaacacccactgtatgtcaagccctgttcctaggcagttgtaagtaaatgtgttcatttactaacttttcagaaaaactctaagaggccaggtggcgttgcgcatgccggtaatcgcagcactctgggaggtgaagaagggtggatcgcctaagtccaggagttcaagaccagcctggccaatgtggcaaaaccctgtctctacaaaaattagccaggtgtgacggcatgtgcctgtaattccagctactcaggaggctgaggcaggagagtmgcttgaacccgggaggcagaggctgcagtaagccaagatcacaccactgcactccagcctgggtgacagagcaagaccctgtccagaaaaaaaaaaaaaaaggaaaaaaagaaaaactctatgagacagttaactattattctcctttatagattgggaaatatgcctaaggtactacagagttagtggtagctgtgattgaaatccaggcagttatctgactccacggctgatgctcttagtcgcctactactgtctctcatctgtacttgaagcaaatcaaattcttgattataacac

SEQ ID NO: 168091 - DNA, 601 bp, Human
aatgtatatagaaacaagtacatggatattgcctatattttggaagtctaatcaacagaatttgctatttattcttttttttttttttttttttttttgagatggagtttcgctcttgttgcccaggctggagtgcaatggcgcgatctcagctcactgcaacctccgcgtcccgggttcaagtgattctcctgcctcagtttcctaagtagctgggattaccggcgtgcaccaccatggccagctaattattgtatttttagtagagacagggtttcaccatgtcagccaggctggtttsgaactcctgacctcaggtgatctaccccccgccttggcctcccaaagtgctgggatttcaggcgtgagccactgcacccagcctatttattcttataaaaacaaaatgatacaattatttatttatttttaagacagagttttgctcttgttgcccaggctggaatgcaatggtgcgatcttggcttaccgcaacctctgcctcccgggttcaagtgattctcctgcctcaacttcctgagtagctgggattacaggcatgcgccaccactcctggctaattttgtatttttagtagaga

SEQ ID NO: 168092 - DNA, 601 bp, Human
agtaatgtaaattgaactgttttatgtatatacatatgtacatactttttttttttttttttttgagacatgctctttctctgtcacccaggctggagtacagaggtgcaatcatggctcactgtagtcttaaactcctgggctaaagtcatcctcctgtctcagcctcctgagtagctgggactacaggcatgggctaccatgcctggttatttatttatttatttttcttttgtaaagatggagtctaactatgttgacaaggctggtttcaaactcctggcctcaagtaatcctcccrcctcggcctcccaaagtgctgggattacaggcatgacctaccacgcccagcctaatttaacttttaagtgtttgttgaggataagatagtttcacaataaagtccaggtaaaccataccctctgtccctaggctggaacttcctacctaccaggataatccttttaacagattcatggttaagagaaaactgggaacatttatgttggctggtcactatagtgctggccctaaaacagaagccccgtaaaagtagggatgtgggaggtttaccgaatttcattaggtctctcttcttcct

SEQ ID NO: 168093 - DNA, 601 bp, Human
aagagaagtgcagtatcattgctaagacttgaacagtttatctctcagaatcttcagttcctttgaatttctcagctcttagtgtaatctgttttatgtgtttgttgtagacttccattatggatagatttccaaaataatttgggtaatcaactggtattttagcattctggtaactaacatgtttaaaaatctaaggctctttttcatgcaaaggagactgatttttgctttcaaaagcataggcaggaaaccttaggttcaaaggtagtaaataatgatgagcaaattgctagtgatgatacagctgcagcttccgttgtgtatttgtttggctcaggtactctagaaatgagaattcttagaattacatagcagaagtgatatgttgcctggataccacactaccagaggaataaaaatgtagttagagtaaggggttttatattttacaatgagacagtgttagtgtaagaagcattccaaatacgccagttctcttaaacccatagcagacatttatatgttaattcctcaatgtctcatttcccaccttttttagaggaagaaaatactcaggctaaaactttcacccaagcat

SEQ ID NO: 168094 - DNA, 601 bp, Human
cgggcacagtggctcatgcctgtaatcccagcactggaaggctgagatgggcggatcatgaagtcaggagattgagaccatcctggctaacggtgaaacccgtcgctactaaaaatacaaaaaattagccaggcgtggtggcaggcgcctgttgtcccaggtactcgggtggctgaggcaggagaatggcgtgaacccgggaggcggagcttgcagtgagctgagattgtgccactgcactccagcctgggcgacaaagctagactcggtctcaaaataaaaataaaagtgaaaataaatsctggctctactactgacttaacctctttgagccttacatttctcacttgtagaatgtgaatacaaatatttccttatagggttgatgtgagtatgacattgagacaaaatgtataatgtacttagtgtgactggcacgtgatggctcagtaagtgatgattactattattgctgctattttgcaatgacctctgtgaagttttttccagatgtatttgaatctcttagtgcatacttttcagatttatttgaaccccttagtgtgtgcttctctgttggcacttcacctaggcacaaaat

SEQ ID NO: 168095 - DNA, 601 bp, Human
ctgagtgtaaaagtttgaggatttcaggagggaagatgatgatgaatcaggatctgtcagttctgatggaatatactaacagtggctgggtttaaatcctggctccagggccgggcacagtggctcatgcctgtaatcccagcactggaaggctgagatgggcggatcatgaagtcaggagattgagaccatcctggctaacggtgaaacccgtcgctactaaaaatacaaaaaattagccaggcgtggtggcaggcgcctgttgtcccaggtactcgggtggctgaggcaggagaatggygtgaacccgggaggcggagcttgcagtgagctgagattgtgccactgcactccagcctgggcgacaaagctagactcggtctcaaaataaaaataaaagtgaaaataaatgctggctctactactgacttaacctctttgagccttacatttctcacttgtagaatgtgaatacaaatatttccttatagggttgatgtgagtatgacattgagacaaaatgtataatgtacttagtgtgactggcacgtgatggctcagtaagtgatgattactattattgctgctattttgcaatgac

SEQ ID NO: 168096 - DNA, 601 bp, Human
gtcaaggaagaaagcaaagaggagagaaagcctatagctgagtgtaaaagtttgaggatttcaggagggaagatgatgatgaatcaggatctgtcagttctgatggaatatactaacagtggctgggtttaaatcctggctccagggccgggcacagtggctcatgcctgtaatcccagcactggaaggctgagatgggcggatcatgaagtcaggagattgagaccatcctggctaacggtgaaacccgtcgctactaaaaatacaaaaaattagccaggcgtggtggcaggcgcctgtwgtcccaggtactcgggtggctgaggcaggagaatggcgtgaacccgggaggcggagcttgcagtgagctgagattgtgccactgcactccagcctgggcgacaaagctagactcggtctcaaaataaaaataaaagtgaaaataaatgctggctctactactgacttaacctctttgagccttacatttctcacttgtagaatgtgaatacaaatatttccttatagggttgatgtgagtatgacattgagacaaaatgtataatgtacttagtgtgactggcacgtgatggctcagtaa

SEQ ID NO: 168097 - DNA, 601 bp, Human
tatgcatttttaaaaaattagtattaaagaatagtaaacttacagtcccttgctttaaaaactcagatattaaaaacaatcctcctgtgacccggtgacatgactaaaagatgcaatatatgtatgccctgattgcccaaatactggagtgtatgtactgcattgcatcagggaaatttgaaaccagaatgatgtaagctgttattaatattttgatttctaactgcagccatgtataaattattgcaactggagaacagcatacataaacatagccccaatatctttttcctgcattatrctttaccttcctaaaccagattatacgctttagaacattctcatgcctattgtatttctggtagtagagcccttgccattgatgttttattcagtgctttatgcagggcaccatgctaagcatttgacatatattctcttacatgaccctcacaactatttttggcagatcatattgtccgcattttcaggtaaagaaattgaggttcaaataggtcaaataatttgcttaagatctctagctgaccctgaatttttcaaaatcagattttattctacagcttatgcttctaactcaggc

SEQ ID NO: 168098 - DNA, 601 bp, Human
tccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcgcctcgacgagattctcagaacccccaagcctcagcaagcccaacaggcctgtgtggaggctgcacgctcccagacccacaacccaactcttgagcagaggttttacctgggrtgtaggcctggctccaataacgaaggaagccacaaaaaacccaagagctgcaggcgagttcaatgagaccggtttccgcccgccaccctgcctcttataccctatcttagaaccttccagaaggggcccgcccctgctgcctgccattacggcttccccggccaatagacgcccggctgcccttacaagacccaatcacaagcccggctccactcctcgggcctcgcccccttccgcacccaccccaccgcgctccgcctcacgataacgcactcaccgcagcgttctggaactttcaag

SEQ ID NO: 168099 - DNA, 601 bp, Human
aattcaattaatcaaaatatttccctcatcccttaacagaacacttaaccaggaaaaacgtatggccactgccaagaggtaatagtgcccatcacctcctgtctaagcacgcgcgaggtccagaactagtgctgcagtccaggttgccgtgccaaccgcagcagagcacgccctagatgaaggacccatctacccagacggcgtggggcgttgctcaacacgtggtcttaccccgaactgagcactgtctgttcccctccctcgccaggtgccagtgcccccgggagtcaacgggcttttmactactccggaatgtacccccatactggaagcacgccaagaacagctctgaagaaccacggtgggactggactaagcagggaactgggtgaaagaaaacgctggctccacttccccgcgcgccaggcaaaccgatgcagcaaccctcccccgccacgcggccgccgggcgtctcccagcctcccctggggccactgcggcccactccctacatttccgtcctgccggctgcaaccaaataccgctgccatcccaccgaaaactgaggccctttaagccggtagaaggagccgcacactcg

SEQ ID NO: 168100 - DNA, 601 bp, Human
caccttgtccctctgcttctcatcttcagctttgtacttctcagcttcctggaccatacgttcaatgtcttccttgctcaaacggcctaggaaagaaattaactctaagtaaaagccttaaattacctgtgtatgtgtaactctagtttctcttagctagacgcccttaggcaccagtaactcaattgaaataccattatccctgtcaagaccagatgacagtgcctccttacccttgtcattagtgatagtaatcttgttctcttttcccgtactcttgtccacagcagagacattgagkataccattggcatcaatgtcaaaagtgacttcaatctgaggaacacctcggggtgcaggaggtatgcctgtgagttcaaacttgccaagcaggttgttatcctttgtcatggcacgctcgccttcataaaccttggtaggaaataaaacaaattactacaatggactccaggtctgtgacagtgctagggtcctgctaaggaagaatggtcgctcagacatccaaggaaggaactggccaacataagactttctggtggaaactacgaatggttttggaatccatcatcatagcgagtca

SEQ ID NO: 168101 - DNA, 601 bp, Human
ggccagctcctgaccgctgcgccctcagctccccaccccgagacaaagcgtaaagacggggattcctttgtttccggccacacccagggacgcagcccggctgttctgcctccaccaccgtccccaccctctcgcggcccagcgtcgggaacattaacccttcccgggccgcagccgccagcgtcgccccattaggttatttttagctgcggggaggggtggaccgagcttccatcatggcgctgtccctaggtccggacttccactccatcagtaaaggcggggagtggggagcgctggwtgatctttttccctcctccagcgggggaggtaccgggctgtggggtgcatgggccggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggct

SEQ ID NO: 168102 - DNA, 601 bp, Human
gccctctttcccaggaactaagcataacttacagcctctctccttcccatgctcattgaaaccacctttagaggctgctggaaccacccatttgatttctctttacacacaagttgactaattgtttcacaggaagaactaaagcagcaagacctgtcggcagatctgaagcccttaccatgcacctagcacactaaatgctttggagggtcacctaggatgttcaggagtcctgtgaaggggcctacatcgtacagcagagcactgaggttcagagaggcatcagacacccagctccatyggctggaaaagcctaggcatctccactccagagggcaacaggcagtaggcctggtgaccacttcagcttagcagactgggactgcacactttcagaggcagcatcccacagacctgccttgcaggccatcctattaagtttccaccttggagactggggacctgagagcagcagagaccttctgtgggcacacagcctcaaacccagaactcctgactcctgagtcactgcatcaccccgaccccatcacctgcctcagttcccttgggaggcagggttagagggtcccaaggcagggac

SEQ ID NO: 168103 - DNA, 601 bp, Human
gtggcatgatctcagctcactgcaacctctgcctcccaggttcaagcaatttctcctgcctcagcctcccgaatagctgggattacaggtgcccgccaccatgcctggctaatttttgtatttttagtagagacagggtttcaccatgttggccaggctggtctcaaactcttgaccttaagtgatctgcccaccttggcctcccaaagtgctgggattacaggcaccctttagtctttcttaagttgttttatgtgcatgcactttgtcacttagatggcaagataattaaggtcagggccacacacacacacacacacacacacacacacatgcttgcccaccacacctgctggttagctaccattctgaattttcatttcctcaaagacacagcctgagttttcagaacagagctatgacctgttagatatttactatgtgccatgcacactcatgtatgttgtattgtgtgtgctccatgtattcagtcttggccatgtttattagaagaaatgggcattcacggttaaggtggtatagttatgtcactttcacttttatgtcccctctgagacatttttaagaatttgatttaaac

SEQ ID NO: 168104 - DNA, 601 bp, Human
aaatttagccacacatcggcagagaatttttttgagtacaccactgtgctcacagcacacaggctgagaaccactggttgttgaaatagcttgcatttttctgtcttctaccaataccttttgtacatgggcccctaatatctatctctgtcctttgcctctcaccctcattccaatctattccttattgtccattgagacacctcaatttcgagcttgctaccaaatccaatacaacctaagaaccaatggtgggatttttcttccaaacccaatcgctgtgcttcctgaccacctcatyatcagcttccacgggtgtgtattagcatcttttacatgtcagaactttcacattcaatcctcacatctcctctagaaagactgactttgtgcttctctcccaccgatttagagcttgatcatacaacttgctttggccagtacactatcagcagatgtgaaatatgctacatttgagtagaagttcttaaagatatttcaggttgctgccaatctcttgtgcttttcttctccttcagcctgggtctcaaagtgaggagatgcacagagtagactcactacccaccagtaaacaggggca

SEQ ID NO: 168105 - DNA, 601 bp, Human
acataaattttaaacgctgatcaaaatttagccacacatcggcagagaatttttttgagtacaccactgtgctcacagcacacaggctgagaaccactggttgttgaaatagcttgcatttttctgtcttctaccaataccttttgtacatgggcccctaatatctatctctgtcctttgcctctcaccctcattccaatctattccttattgtccattgagacacctcaatttcgagcttgctaccaaatccaatacaacctaagaaccaatggtgggatttttcttccaaacccaatcsctgtgcttcctgaccacctcattatcagcttccacgggtgtgtattagcatcttttacatgtcagaactttcacattcaatcctcacatctcctctagaaagactgactttgtgcttctctcccaccgatttagagcttgatcatacaacttgctttggccagtacactatcagcagatgtgaaatatgctacatttgagtagaagttcttaaagatatttcaggttgctgccaatctcttgtgcttttcttctccttcagcctgggtctcaaagtgaggagatgcacagagtagactca

SEQ ID NO: 168106 - DNA, 601 bp, Human
attagactctattcaacatctctctgcttgtgaatactcagggctccacctgagagatgctacaataatttgtagacttggttgtagcaaacataaattttaaacgctgatcaaaatttagccacacatcggcagagaatttttttgagtacaccactgtgctcacagcacacaggctgagaaccactggttgttgaaatagcttgcatttttctgtcttctaccaataccttttgtacatgggcccctaatatctatctctgtcctttgcctctcaccctcattccaatctattccttaytgtccattgagacacctcaatttcgagcttgctaccaaatccaatacaacctaagaaccaatggtgggatttttcttccaaacccaatcgctgtgcttcctgaccacctcattatcagcttccacgggtgtgtattagcatcttttacatgtcagaactttcacattcaatcctcacatctcctctagaaagactgactttgtgcttctctcccaccgatttagagcttgatcatacaacttgctttggccagtacactatcagcagatgtgaaatatgctacatttgagtagaagttct

SEQ ID NO: 168107 - DNA, 601 bp, Human
ttgttcatgacactcattttccagctcattgtaatatatcttatttcccccatgagactgaaatccttggcaccagagatggcagcttattcccacatagcttcttagcggggtgatctttggcaagatacttaatctctgttggcttcagtttcctcatctataaatggaacccatcaaaatacctacctcacaagattacttgaaataatatgtaaaagcacccaatacactgaacactgtcctatgaagtttaacattctatgccaaatgctctaacattctatgccaaatgttcatscatttgaggatgcaggaaaaagcttcaattgcttttatcagcttctcagaggagttgatggccttaggaagcctttaaactcgtttaagaggttcccagtaattaaagttttatttggattcctttttattctgcatgttcagaaataaaatatagcaaaaaaaaaaatgagacgaaaggaaaggaaaatgaaagaaagtaaaggaaaacctaacaccgtatgcggaaatcatgatagaggaggaataaagaattggagtggttttggaaaagagaaggtcctaagtaatggagaaacat

SEQ ID NO: 168108 - DNA, 601 bp, Human
tgagccctgctaagcatctaccacccacaaacctattgccataaataaatattggttgctgtaaggcacagagtctagagggggtgtttgttaggcagcatcatcgcatcaaagcaaattaatacatcgtaaaggttctgtgctgggagccacaggggttgctgcataagaggttttatagctcaaatacgtcaaacttccatgacttggtccctaccttgaataaccagagccttccccttgagcaagctccccactctggcctccttgcaacggcaagtgctgccatcccatccagctrcacactcatatttattcacagaaaccatccatttgcctttgattttgcctccggggacgacagcctgtcagccagtggccctttgccacactatccaggaatgcaacccacgaagtggcaaccggtatgagcctgaatctaattaacacacattcgttccccctctcacgggtaggggacagggcggctttccccctttcatgaatgggagatacaggtagtccccatggactgcaggactttttttccccccgatattatgcctgtttccatgacaactgcagttataagtgcacaatt

SEQ ID NO: 168109 - DNA, 601 bp, Human
ctgaggcaggaaaatggcatgagcccgggaggcaaagcttgcagtgagccgagatcacgtcactgcactctagcctgggtgacagagtgagactccatctcaaaaaaaaaaaaaagttttgtttcaaaacttcttcttttggccttgcagagtcaaaataatcatgacttatgtttccgagtggacatagttggcaagtacatttcagtgttggtagatgaagaccttacactacttccaatacttaattctcccaccccaggaagttggggtgagggcaagcaactcccatggcccccaytagagcagtcattgcaatcacgaagaggtgggtgtcaacatagggtctcagaggccacgcaaattcagatgaggttacctgattcctcagtgggaagggcaggaaagctcagggtaactaactgaccagtctcttctggaaagatgaagaaaccctttctttccaaagagcaagcagggaaatgagcctcaaaaagatcaagggagcccattttgtagaaatgtgcttatccaagcattgaatgcagggggaactgctttcttttagaacaaaggaaatgtcaaggtgggttttgaaagt

SEQ ID NO: 168110 - DNA, 601 bp, Human
aggagcagccaggcaagagaaagggattcttctccaaacctactgtcatctcccatccagcccccactgggaggagacagctgacattggcaggacgcttttgttctttttcacaaacattaagcattaggttgagctctgcttacaaaaactagcctttaaagcttcaggcatttttatccacagaacaaaaaaacaaacagcagcaaccacagtcagcctcagctcagaggggaggttctggatgacagtgaatgttctgcatcactgtctattcctgagtgaggcattaaacctcccygggttctgttctccctcctgcatggtgggaataaatctgtcatctccaccatgaaggtggatgtcagaaggcatacaaaatctattaaggtctagattttagaaaaaaaaaaaaaaaagagatgggatgctattcttatccaatcaacctctatccaaaaatcactggtttagcaaccttggctatctgaaaaatagcagagaaccaaagctgttattacggtgacagagaaaagactgtgactatgtcatcaaggaggggaaatttgagctgagttccacaatataaataggagttcag

SEQ ID NO: 168111 - DNA, 601 bp, Human
ctgcactccagcctgggcaacagagtgagattccccgctccccgcccaccaaaaaaaagaaaaaaaaagaaatctctgggttaagcagaagcaatgatgtctttatgacagaacttttcagatccttgcctctgctgatatttgatacgaatactcaagaggagaattgagttgatatcttttccaaactcaggtccctttgtggtgtggaaaatctgaagggatactttcccacagaagagaccgtaggaaatgggctttgaagttacgtgctttgtgaccatttgcacagaatggtccrtgtggaatgttaggtctgatcccacctcgcagggaaatgaggtccacgaacaggtgtgacctccaggttcacacaaccagtaaggatgcaggctagagccaagggttcctaatggcctgtccagcattccagccaccaagccatgcttctgtcccatgtttaaacattcccaaactctagaatccatgacacctcataagaagatagaacttagaaccctcccccacccaagtaataagatcaacgggccttgccttctaaggctgcctttctcatgcaggaaatatgagtgcacagaac

SEQ ID NO: 168112 - DNA, 601 bp, Human
caagctcagagagattttagtaggtacaggcccagacaggggttacccggtgccgtgagtttagaaatctctaggttaaggctgggtgcggtggctcacacctgtaatcccagcactttgggaggctgaggtgggcggatcacgaggtcaggagatcaagaccatcctggctaacatggtgaaaccccgtctgtactaaaaatacaaaaaattagccgggcgtggtggcgcacgcctgtggtcccagctactcaggaggctgaggcaggagaatggcatgaacaagggagaaggaggttgyagtgagccgagatcgcaccactgcactccagcctgggcaacagagtgagattccccgctccccgcccaccaaaaaaaagaaaaaaaaagaaatctctgggttaagcagaagcaatgatgtctttatgacagaacttttcagatccttgcctctgctgatatttgatacgaatactcaagaggagaattgagttgatatcttttccaaactcaggtccctttgtggtgtggaaaatctgaagggatactttcccacagaagagaccgtaggaaatgggctttgaagttacgtgctttgtga

SEQ ID NO: 168113 - DNA, 601 bp, Human
ccgcaggcacccgtctgtcttgtcactattaatagggggcttttcgggctcagcccgaaaggtggtattttaatgcactgtgtgccagaagattggcccaacctgctatgcttttcctagaatcagatggtggagctcatgttcaaatccactccctccccaactaccaatagacactgcaagcaggggcgcccaggctccaagcccttagtgtctctcaggtgctggtctacttctgaaaaaataagcccacaggaagccaagcactgattcaacctcttcatgttctttcttaaaattwgtagttcctttgcctcttaaacaggcattttcaaagccatgtgcttcagaactcaagctcagagagattttagtaggtacaggcccagacaggggttacccggtgccgtgagtttagaaatctctaggttaaggctgggtgcggtggctcacacctgtaatcccagcactttgggaggctgaggtgggcggatcacgaggtcaggagatcaagaccatcctggctaacatggtgaaaccccgtctgtactaaaaatacaaaaaattagccgggcgtggtggcgcacgcctgtggtcccag

SEQ ID NO: 168114 - DNA, 601 bp, Human
ggatcacgaggtcaggagatcgagaccatcctggctaacacggtgaaacgccatctctactaaaaatacaaaaaaaattagccaggtgtggtggcagacgcctgtagtcccagctactcaggaggctgaggcaggagaatgtcatgaacccggaacgcagagcttgcagtgagccgagatagcgccactgcactccagcctgggcaacagagcaagactccgtcaaaaaaaaaaaaaaaaaaaagaaaaagaaaagaagtaaactgacaagaacaacccacagtaggtggtgctctgacakcagagcctaactcaagaacctggaggcaggtggtacatctgggaggtggttccagggtctggagggagggtatcctgttcaataaatgaatccaataaagagtgcatattgacctggctagcactgtgggcaaccagagcttgatcttgccaaggccatctgaggaagtgcacagaaggcacttcagtggtcccctggaccaggtcccatggtcttatggcatcagccacaatggccctgcaagcccagagaagaagagtttaacccaaactaaggcatcagaaacacatcatgcagtcg

SEQ ID NO: 168115 - DNA, 601 bp, Human
gctccaggacctacaggtgctgggccccagggcggggggccacgaggcaaggccctggtcaaggagcgatgcagtgtgacagtggctgcaacagacagcagctcacgtgctgtggggacagagggatgcaccccacaccgtcttggggtcaaggaaggcttcctggaggaggagtcgcatgagcagggcccacaaggacaaataagagatgaggggaaggcagagggacaggggaaaaggtgttccaggcaggggactgatgggtgcaaggctctcaggtgacagcagcctggcaagtccygtgagtcccaagttttcattatggctggaagagcaagcaaggaatgaagccagaggaggggaggcccgggctggatttgaaatggtcaaagtctgggactagaattggggggtgggctggggggaggcagggagggctcaactgttctgggtatccctcttcactgggtgatttgcatatgtggtccctttcaatgcccccaatactccacagcccctttcccccagcctcctcctcctcctccatcatcatctccaaagcccacacgggccccaggatgatcctgttaacagtatcaat

SEQ ID NO: 168116 - DNA, 601 bp, Human
gctgagtgagttaaatggaaacctcgatgaatcataattcaatgaatcacacaacagctgaacggctcttaagaaaacttggcaaatggccacagaattaaaggattcttggggtttcattcaagtgaaggaaagtaattgtgcctctgtacccgaggtggtccccggctcttccacacctacccttctcagcctgcaggatgcacgttcagaataaacacccaagggccctgtgaggcctcagtcaccgtcactcactcagcttcacaagtccggagtaggactgccaacacgcagagarcttctcagcaacgggttcaagtaaaaggggattacaaccaagaggggctgacagataatgaatttagggaaactgcatttttcctcaacagcctggttagccggagtcctaggactcttgatgttgacacataacagcaggcacttaatgaatgcagctcaacccatggccacttgctccttctgtatactccgggattgcggagctctataagggggcctggcccaggaaggacgggggtgggtgtggtcagatcaaacttctagcagcaggtggtgtgtgggatgggggagcccacga

SEQ ID NO: 168117 - DNA, 601 bp, Human
caacttgacttagggaaatcctttcttccccagtccttctgccatcctctccaaacgtgtgggcttgccaagagctgaagggaaaggggttgggaagacactcgacccttaacttaaaaggaacagcaactggagaacagcgtcttctaagcgcatcacggcttctctcattgaaggctcacaaccagctctaacagaggacagggtcgcaccccaaatgccatctcaggcaaaggcctgggcacggtccaggcagaagggccgctggctgtagacatgcacgtggtgtgtctacacatgsgcacggacctacacgtgagtgtcagcggaatcacagctcagtctgattcaagcctgtgaccgagtcaccattcagtgggggccaacaagtactctaatgagaggttcttttaattattttggagatagggtctctgtcagccaggctggagtacagtggtacaggtcatggctcactgcagcctcaacttgctgggctcaagcgatcctcccgcctcagcctctcaagtagctggaactacacaggcttgcaccaccatgcccaggtaattttgtttttaaattttttgtagagatggga

SEQ ID NO: 168118 - DNA, 601 bp, Human
gatcccttacccccagaatgtccactgccattgcttataataaccaatcccttacccccagaatgtccaccgccgctgcttataaccaatcccttacccccagaatgtccaccaccactactaataataacaccagaatgtccaacttgacttagggaaatcctttcttccccagtccttctgccatcctctccaaacgtgtgggcttgccaagagctgaagggaaaggggttgggaagacactcgacccttaacttaaaaggaacagcaactggagaacagcgtcttctaagcgcatcayggcttctctcattgaaggctcacaaccagctctaacagaggacagggtcgcaccccaaatgccatctcaggcaaaggcctgggcacggtccaggcagaagggccgctggctgtagacatgcacgtggtgtgtctacacatgggcacggacctacacgtgagtgtcagcggaatcacagctcagtctgattcaagcctgtgaccgagtcaccattcagtgggggccaacaagtactctaatgagaggttcttttaattattttggagatagggtctctgtcagccaggctggagtacagtg

SEQ ID NO: 168119 - DNA, 601 bp, Human
cctacgaaatgagaaacgaagcccccggggatctccatgggtgacttattgatgacggtggcttctggtttttatttgctggcaccagagtcaggaggtccctcaaggcgctgggggaagaggctcagccagaaccaggaaaggaaccctgcagcatccaaggttaaggtctggctcagaccatgagatctgactgtgggtgatttttattctaaaaaaaatccaattgttgtgaacgcttgagattgggcagcatattaattttctaagtcacaaaaaaccctagtaataaagacacagraagatgctgcttcagtgaccaaaagtgcagctctagacagaatccacagccaggcagccaagacagcagcctctgccctcctgggctcctgtgagaagctgggccagcaagcaggtcccagctggggctcccccaaagaagtgggtgccacacactgtcctcttaacccaggaaataagcctaggaccgcatagtgccagggacaaggtggacacccagaaaatgttaccacacatgtccacctccaccaggatcaccaccaccgctgcttttaataaccaatcccttatccccagaatc

SEQ ID NO: 168120 - DNA, 601 bp, Human
attttgtttctaaaaatctaaatgtgacttcagtctcatgctaagcgattatatcaatgagatgttgttttatttcaatattttaaaaataattttttaaaattggtacctataaaaccgtattgtttattaagccatcttctgtggccccagtggcacacacggtatgctctgtaaaacagtgacctgtgtcatagggctggggggagaatgaaatccaatggcaccctgggcagagagcctcgaacacactgagcacttgtgatgctggtgatggggaggagacctcacagtctatgtccctaaggcaggggacagtgtcactcactgatcatcgtggtcccgcccaccagtgccgccctggtcccttggaagaagtcatcagccgcagtcatcccctgggagggcttctgcaggtacgtgttgacatcaatacctccgggaataaccatccgcccgttggcttcaatggtcttcactccaccaggaacgattaagttctctcctatttgtctggaggcaaacaacagagacagccttggttcttaaaggaaaagtagaatgggcagtcaacccgcagcttcagttccatgaaataaac

SEQ ID NO: 168121 - DNA, 601 bp, Human
gtgtgggagtatcagcaagtcaatgggcaaagacaacttagtctgatgatccctatgtgggggatgcatgggggggttgcatctgtcagggggcttcagggaaggcttcccaggggagtacagctcagcacgaacaggagaatcgctaggaaaaggcagggagactgttcctgaaggggccagtgctcactcacacagccccaagagccagaggcagcctcgagcagatgggaaacggaggtgcagggggctggggctctgggccccaggaactggaacaagccagtctggaggagcaggmgcatcctgatgagccaggcagacagcttgcaatttattctggggataatgtggaattgctgagagcatttaagctgattagaaaataaaaacacaggtgggagcagtggctcacgcctgtaatcccagcaatttgggaggccaaggcaggtggatcacctgaggtcaagagttcaggaccagcctggccaatatggtgataccccgtctctactaaaaatacaaaaattagccgggtgtggtggcaggtgcctgtaatccaagctacttgggaggctgagggggaagaatcactttaacc

SEQ ID NO: 168122 - DNA, 601 bp, Human
agtgtttatctgaaaggaaggacataaagtgcttctcccgttgcccatctatcttcatggtaataaccaattaccctgctaactgatgcctgtatggcaccattctctgctaggcaccatcctagcactttactcttcttatgaaatcattcaactgcctctataaggtagggctatcatgagcctaaagcacagagaagttgggaaagctgcccctggctgcagagcaagcacctggcttggctgtagcctccatgattttctccaccacactaacaagcagagcaagggaaactgacartgaaacaaaactaggagacccagtagtataagaaggccaggtgtcctgtaagtcgtaaccactcctcctgaagaacaacttgcggctccatatcccttgacttggtgcatgtacataataattgtttgctgttggcagggccagaaatgttccatcttacaaatgtgaggagatgacttgcccagcatgttgcagttgctgtgagggaaggccaggcagtctctcttcctgtgtcagagctcataaatggtccccatccttgcctgaataccaggatcaaacgcagagctttcgggaagt

SEQ ID NO: 168123 - DNA, 601 bp, Human
aacaggtgaaaatcacaattatgccagcacatcacatgctatgttttctatgtaactgaaccaattttcagctctttgaatgtcttttgttgactgtatcaaaggcctccaggacatcttgggataagttattttctgtaaccccaagtgtttatctgaaaggaaggacataaagtgcttctcccgttgcccatctatcttcatggtaataaccaattaccctgctaactgatgcctgtatggcaccattctctgctaggcaccatcctagcactttactcttcttatgaaatcattcaastgcctctataaggtagggctatcatgagcctaaagcacagagaagttgggaaagctgcccctggctgcagagcaagcacctggcttggctgtagcctccatgattttctccaccacactaacaagcagagcaagggaaactgacaatgaaacaaaactaggagacccagtagtataagaaggccaggtgtcctgtaagtcgtaaccactcctcctgaagaacaacttgcggctccatatcccttgacttggtgcatgtacataataattgtttgctgttggcagggccagaaatgttcca

SEQ ID NO: 168124 - DNA, 601 bp, Human
aatgctcttttatcaaaccttttgcaacaaggagaatcagactgaggtagaaggagtggaaattcttgccactcacctgagctatcaaatctccattttctgcatggaccaagatcacagctcccaggcccttaaggaaggtaaaggcttcatagagctatggagagataaacaggggttggtgtgagatttaaaaaaaaaaaaaaatcacagcgtgtgcattcatgaagaccgttccgatcacacccattcggtcattcacctgccagcctctgcaaacacattcatgtggatggaataygctgctacacaagtcagacttggaaggatcattccttgaccctgacatcttgcagacccaaaagcaggaagctgaggatggggcacaactggtccaagtcaccccagggcatgaagacagactcaatctcagtgcctatctatgccttttgctgtctttttgggttggcttttttgaaacacctgtaggtgttaatggcagcaactggtcctgagaagtcactgttagttttacagaaattatctaactaaatctgctaagcctgtaccatagccacctacatgccacagaatatgtgtg

SEQ ID NO: 168125 - DNA, 601 bp, Human
taggtttgcaaagcattttcattcatatctgatgtgtctgatatgacacccagttcctggcttgacctttcattgtacagcctcctcactaaccaatgctcttttatcaaaccttttgcaacaaggagaatcagactgaggtagaaggagtggaaattcttgccactcacctgagctatcaaatctccattttctgcatggaccaagatcacagctcccaggcccttaaggaaggtaaaggcttcatagagctatggagagataaacaggggttggtgtgagatttaaaaaaaaaaaaaaatcacagcgtgtgcattcatgaagaccgttccgatcacacccattcggtcattcacctgccagcctctgcaaacacattcatgtggatggaatacgctgctacacaagtcagacttggaaggatcattccttgaccctgacatcttgcagacccaaaagcaggaagctgaggatggggcacaactggtccaagtcaccccagggcatgaagacagactcaatctcagtgcctatctatgccttttgctgtctttttgggttggcttttttgaaacacctgtaggtgttaatggcagcaact

SEQ ID NO: 168126 - DNA, 601 bp, Human
gagccacaactcccagctttcattcttttcccaacaaattctccactccacagctagaattatcaaaatatgttcatgtctcattttatccaaaacttttgcatggctgcagtccattatgtgtcagattctgaacctcacatacacgatgtcttactctgttttctgatgctattacagaataccatagacttggtaattttacagaaaataagtgtatttcccatggttctggaggctgggaaatctaataacaaggtgccagcatctggtgagggccttcttgctgcatcatagcatkgcggtgggcatcacatgagacagcaggtgcatgccagctcaggcctctcttcttctccttataaagccactaatcccgtcataaggcccccaccctgatgatctcatctaatccaaattacctccctaaggcctcacctccaaataccatcaacatactagcttgtgcattaagttttcaacatatgaacttttgaaggacacattcaagccatggcacataatatcatttgatccacacaataacactgccaggtggttgtttctggaagaaaaataagagtgttcatgggaaaaagtt

SEQ ID NO: 168127 - DNA, 601 bp, Human
cccagctaatttttgtattttttagtagagatggggttttgccatgttggccaggctggtctcacactcttggcctcaagtgatcagcccacctcggcctctcaaagtgctggtattacaggcgtgagccacaactcccagctttcattcttttcccaacaaattctccactccacagctagaattatcaaaatatgttcatgtctcattttatccaaaacttttgcatggctgcagtccattatgtgtcagattctgaacctcacatacacgatgtcttactctgttttctgatgctatwacagaataccatagacttggtaattttacagaaaataagtgtatttcccatggttctggaggctgggaaatctaataacaaggtgccagcatctggtgagggccttcttgctgcatcatagcattgcggtgggcatcacatgagacagcaggtgcatgccagctcaggcctctcttcttctccttataaagccactaatcccgtcataaggcccccaccctgatgatctcatctaatccaaattacctccctaaggcctcacctccaaataccatcaacatactagcttgtgcattaagt

SEQ ID NO: 168128 - DNA, 601 bp, Human
gagacagagtctcactctgttgcccaggctggagtgcagtggcgtgatctcagctcactgcaagctccaacttccaggttcaagcaattctctgcctcagcctcacacctgataatggctgtattctcacctgtaatacctgtattcccacctgtaatagctgggattacaggtgtgctccaccacacccagctaatttttgtattttttagtagagatggggttttgccatgttggccaggctggtctcacactcttggcctcaagtgatcagcccacctcggcctctcaaagtgctggkattacaggcgtgagccacaactcccagctttcattcttttcccaacaaattctccactccacagctagaattatcaaaatatgttcatgtctcattttatccaaaacttttgcatggctgcagtccattatgtgtcagattctgaacctcacatacacgatgtcttactctgttttctgatgctattacagaataccatagacttggtaattttacagaaaataagtgtatttcccatggttctggaggctgggaaatctaataacaaggtgccagcatctggtgagggccttcttgctg

SEQ ID NO: 168129 - DNA, 601 bp, Human
tggcttgatttacaacattataaccaatccatgcctctgcaccagagacccaggagcctgcctgacttctttctcttcttcctccacccaatccgtccatgggtcctgtagattgtgtttccctcctgtcatgctcacctcttccatctcctatctcctctcttcatttcttatgagacttgctgaaatagaacctagctagtcaccctgacttcatttttttttttttttgagacagagtctcactctgttgcccaggctggagtgcagtggcgtgatctcagctcactgcaagctccamcttccaggttcaagcaattctctgcctcagcctcacacctgataatggctgtattctcacctgtaatacctgtattcccacctgtaatagctgggattacaggtgtgctccaccacacccagctaatttttgtattttttagtagagatggggttttgccatgttggccaggctggtctcacactcttggcctcaagtgatcagcccacctcggcctctcaaagtgctggtattacaggcgtgagccacaactcccagctttcattcttttcccaacaaattctccactccacagctaga

SEQ ID NO: 168130 - DNA, 601 bp, Human
caccgtgcctggctgatccctgaaattctactgagcaagaagcaggctgagaaaaccactcagctgcagacatgtactacctttcacgaaaaaggatggatgactcagaggatggaagcaggagctcagaaggtagagccaagagctatggagacttattctcaggctttgaaacccagtcaaggaactgccaacatttcccagccagatttcagaaccgccatgaaccaataactccttggtgccttctatttttccctttttgaataggaatgtcaggtccaccactgcatgttgtatrtcaggagggtcagggagatatcttccttctttagcttcatagacctacagattatgggaaatacagccaaggagcctcatccacacctggacctggtttggatgatgagattccagactgtgaactaatgctgttatgagattttggagaaccatgggaaggggtgattgtaatttgcatgggagaggaacatcaatcatgggggccagaagacagattgggaggaagtctcagatgtggccctaataattctcacttcctgacattcctgcccttgtataatcccttctttttgagtgt

SEQ ID NO: 168131 - DNA, 601 bp, Human
cgagaggctggatgcaaatcctgcaccagttgagccttgagatgctcaccgcccccaacctgccactcactatggcctgtgagaccctcagccagaaatagctgagctgcacctggagtccagacccacaggaccatgagataatttgctttaagacgctatgttctgaagtaatttgttatgcaatcatggatgactagtacaggttttgttaccagaagtagggtgttaccataaaagatatctaaatgtgtggaagaggctctggaaccaggcagcaaatgaattcccaaacagcaayttaaatagccttgaatggactcttagaagaaatagggcctctgaggacattgagtcctcacaggaggcaagaagcagccataaacagtcttgcgaagaaaccaaggatgtgagtctacagccccttgttaagaactcagaaagatgaggggtggtgcctcccagtattatcagccacaagaaagagatcctttaaatagggaccttttaggctgggcatggtggctcacacctgcaatcccagcactgtgggaggccgaggcgggcagatcacttgaggtcgggagttcaagaccagcct

SEQ ID NO: 168132 - DNA, 601 bp, Human
cagctagcaaggagctatatccagaaatacaccacctacgagaggctggatgcaaatcctgcaccagttgagccttgagatgctcaccgcccccaacctgccactcactatggcctgtgagaccctcagccagaaatagctgagctgcacctggagtccagacccacaggaccatgagataatttgctttaagacgctatgttctgaagtaatttgttatgcaatcatggatgactagtacaggttttgttaccagaagtagggtgttaccataaaagatatctaaatgtgtggaagaggmtctggaaccaggcagcaaatgaattcccaaacagcaatttaaatagccttgaatggactcttagaagaaatagggcctctgaggacattgagtcctcacaggaggcaagaagcagccataaacagtcttgcgaagaaaccaaggatgtgagtctacagccccttgttaagaactcagaaagatgaggggtggtgcctcccagtattatcagccacaagaaagagatcctttaaatagggaccttttaggctgggcatggtggctcacacctgcaatcccagcactgtgggaggccgaggc

SEQ ID NO: 168133 - DNA, 601 bp, Human
gtcactcccgaggtcaggttacagagactctggcttccgacctgctcacctactgctttttggttaatctgctctgaaggaagccgcctcgctggggctgcccatgtgcaaggaaccgagggaggcctctggccagcagccagcaaagaacagaccatcacattagcctgacagctagcaaggagctatatccagaaatacaccacctacgagaggctggatgcaaatcctgcaccagttgagccttgagatgctcaccgcccccaacctgccactcactatggcctgtgagaccctcagycagaaatagctgagctgcacctggagtccagacccacaggaccatgagataatttgctttaagacgctatgttctgaagtaatttgttatgcaatcatggatgactagtacaggttttgttaccagaagtagggtgttaccataaaagatatctaaatgtgtggaagaggctctggaaccaggcagcaaatgaattcccaaacagcaatttaaatagccttgaatggactcttagaagaaatagggcctctgaggacattgagtcctcacaggaggcaagaagcagccataaacagtctt

SEQ ID NO: 168134 - DNA, 601 bp, Human
gactcctccaaccccctggttagacagagggggcagctgggtcccaaagaggcgagtggcttgcactaggttaacagtgtgcggggtgggggcagtgaactgtgtcccctccactacacacccatccaccttcccctttgtagccctgcatggctccatctgcacctgctttatattgaatctcccgggatcaatgagaggaagcagggttataagacacgagcttccaaggccacccaccactctctgaatctcggagtctccctgcaggcctctcctctgggaagaaacgtggtgtttsggtacaacatggatatcttcaactaggaatcctactctagtctttgatgttgaaatcaaagatcccgaaactgggagtccagatccagaacagccgtctctgtgactttgggcaggttggtcaagctctcttgacctcagtctcctcttctgtacactggggataacggtgcttgtactgcagagttactacgctgatcagatgagcgagcatacgaaacatgctcagcacaaaacctggagctgagcgagcacacgctcattaattggcagccggctctcatacctacttcagctgcct

SEQ ID NO: 168135 - DNA, 601 bp, Human
aagacaagaacaagtgagttaacgattagagggtgtcagagctgggagaagtgactcctccaaccccctggttagacagagggggcagctgggtcccaaagaggcgagtggcttgcactaggttaacagtgtgcggggtgggggcagtgaactgtgtcccctccactacacacccatccaccttcccctttgtagccctgcatggctccatctgcacctgctttatattgaatctcccgggatcaatgagaggaagcagggttataagacacgagcttccaaggccacccaccactctctsaatctcggagtctccctgcaggcctctcctctgggaagaaacgtggtgtttgggtacaacatggatatcttcaactaggaatcctactctagtctttgatgttgaaatcaaagatcccgaaactgggagtccagatccagaacagccgtctctgtgactttgggcaggttggtcaagctctcttgacctcagtctcctcttctgtacactggggataacggtgcttgtactgcagagttactacgctgatcagatgagcgagcatacgaaacatgctcagcacaaaacctggagctgagc

SEQ ID NO: 168136 - DNA, 601 bp, Human
cctacaagacaagaacaagtgagttaacgattagagggtgtcagagctgggagaagtgactcctccaaccccctggttagacagagggggcagctgggtcccaaagaggcgagtggcttgcactaggttaacagtgtgcggggtgggggcagtgaactgtgtcccctccactacacacccatccaccttcccctttgtagccctgcatggctccatctgcacctgctttatattgaatctcccgggatcaatgagaggaagcagggttataagacacgagcttccaaggccacccaccacyctctgaatctcggagtctccctgcaggcctctcctctgggaagaaacgtggtgtttgggtacaacatggatatcttcaactaggaatcctactctagtctttgatgttgaaatcaaagatcccgaaactgggagtccagatccagaacagccgtctctgtgactttgggcaggttggtcaagctctcttgacctcagtctcctcttctgtacactggggataacggtgcttgtactgcagagttactacgctgatcagatgagcgagcatacgaaacatgctcagcacaaaacctggagc

SEQ ID NO: 168137 - DNA, 601 bp, Human
gaaaagaaaagaaagaaagaaagtaaaaagaaggtgtcctcaactcaaaggatggctgccagggtgcccactctattccatgcccgatcagcttgccttcctccttccacactccctgcaggtgcatgcacatgcacccacactcacacactctctcacacacacacacacacactcactcacacacacacacacgcactgtctctctcacacacacacactaacatacacacactcacacacacacatacacacacagccagtccaggggaagtcatcctttttcaaggcttgggaacasggcaggcagtgggagttgtctcctgggtgctgggcttgggcatgcggctccactttcctattatccactatgccatgtcctccatgagaatccgtatccacttgggacactgaagcacccacggggccttggagtgaagttccaggaccctgggagaggcagcacctcttcctgtcttctccagccagcagtccccagggttcccggggaaaacaagatggtttgggatggtctgggagaggacacgggaagaggccgggtcctggctgggctactccagctggaacagcatcaaggtga

SEQ ID NO: 168138 - DNA, 601 bp, Human
acttggccaggcacggtggctcacacctgtaatcccagcactttgggaggccaagacggatggatcacttgaggtcggaagtttcagaccagactggccaccatggtgaaacccagtctctattcacgaggtcaggagatcgagaccatcctggctaacacggtgaaaccctgtctctactgaaaatacaaaaaattagccagtgtggtggcaggtgcctgtagtcccagctacttgggaggctgaggcaggagaatggtgtgaacccgggaggcagagcttgcagtgagccaagatggcrccacttcactccagcctgggcgacagagcgagactctgtctcaaaaacaaacaaaacaaacaaacaaaaaacacaaattagccaggcgtggtggcacaggcctgtgcctagtgctcctagctacttgggaggctgaggcaggagagtcacttgaacccaggaagcggaggctgcagtgaaccgagatcataccactgcactgtagcctgggcaacagagagagactccatctcaaaaaaaaaaaaagaaaagaaaagaaagaaagaaagtaaaaagaaggtgtcctcaactcaaaggatg

SEQ ID NO: 168139 - DNA, 601 bp, Human
atgaggacatcagaaaatgtcctcaacttggccaggcacggtggctcacacctgtaatcccagcactttgggaggccaagacggatggatcacttgaggtcggaagtttcagaccagactggccaccatggtgaaacccagtctctattcacgaggtcaggagatcgagaccatcctggctaacacggtgaaaccctgtctctactgaaaatacaaaaaattagccagtgtggtggcaggtgcctgtagtcccagctacttgggaggctgaggcaggagaatggtgtgaacccgggaggcrgagcttgcagtgagccaagatggcaccacttcactccagcctgggcgacagagcgagactctgtctcaaaaacaaacaaaacaaacaaacaaaaaacacaaattagccaggcgtggtggcacaggcctgtgcctagtgctcctagctacttgggaggctgaggcaggagagtcacttgaacccaggaagcggaggctgcagtgaaccgagatcataccactgcactgtagcctgggcaacagagagagactccatctcaaaaaaaaaaaaagaaaagaaaagaaagaaagaaagtaaaaa

SEQ ID NO: 168140 - DNA, 601 bp, Human
catacagctcgtggccatccctgggctgtggagctcatgaagagcactgggtgggatctcaagcccctcaggacacggaacctgtccactcatgtggactcatgtctgtgtcccctgtgtccagcagacaccaggcccagggcatgggcccagaagactcggtaatgacctgatgaggacatcagaaaatgtcctcaacttggccaggcacggtggctcacacctgtaatcccagcactttgggaggccaagacggatggatcacttgaggtcggaagtttcagaccagactggccaccayggtgaaacccagtctctattcacgaggtcaggagatcgagaccatcctggctaacacggtgaaaccctgtctctactgaaaatacaaaaaattagccagtgtggtggcaggtgcctgtagtcccagctacttgggaggctgaggcaggagaatggtgtgaacccgggaggcagagcttgcagtgagccaagatggcaccacttcactccagcctgggcgacagagcgagactctgtctcaaaaacaaacaaaacaaacaaacaaaaaacacaaattagccaggcgtggtggcacaggcct

SEQ ID NO: 168141 - DNA, 601 bp, Human
tgcatacctttcttcctggccagagcgatgatgtcggctgcactcttgctcatgaccttggtgatgtacacagggcagttgatccggcccgcaatggtgatggcccggaacaccgcctcggcctccagctgaacacggcacacacagtgtcacaggagggaaggctggtgtaacagctaccacccatctccattttccttaattgaatgtgatcagaagggaaatctgctccattgaatgagaaggacatactgagtccaacagcgcttgacagtgccccctgctctccggggtggagcaytggtctcacgctgggatacggcagcaacatccaagcgctatacaagtttatagcactgcctcccagttctgtcctgacctcaccatgggccaggaacatacagctcgtggccatccctgggctgtggagctcatgaagagcactgggtgggatctcaagcccctcaggacacggaacctgtccactcatgtggactcatgtctgtgtcccctgtgtccagcagacaccaggcccagggcatgggcccagaagactcggtaatgacctgatgaggacatcagaaaatgtcctcaacttggc

SEQ ID NO: 168142 - DNA, 601 bp, Human
cagggccggctgcatacctttcttcctggccagagcgatgatgtcggctgcactcttgctcatgaccttggtgatgtacacagggcagttgatccggcccgcaatggtgatggcccggaacaccgcctcggcctccagctgaacacggcacacacagtgtcacaggagggaaggctggtgtaacagctaccacccatctccattttccttaattgaatgtgatcagaagggaaatctgctccattgaatgagaaggacatactgagtccaacagcgcttgacagtgccccctgctctccgkggtggagcattggtctcacgctgggatacggcagcaacatccaagcgctatacaagtttatagcactgcctcccagttctgtcctgacctcaccatgggccaggaacatacagctcgtggccatccctgggctgtggagctcatgaagagcactgggtgggatctcaagcccctcaggacacggaacctgtccactcatgtggactcatgtctgtgtcccctgtgtccagcagacaccaggcccagggcatgggcccagaagactcggtaatgacctgatgaggacatcagaaaatgtcc

SEQ ID NO: 168143 - DNA, 601 bp, Human
acttgaacctgcaggacacccccttccaggccccagctgcccccagaaggcccagggccggctgcatacctttcttcctggccagagcgatgatgtcggctgcactcttgctcatgaccttggtgatgtacacagggcagttgatccggcccgcaatggtgatggcccggaacaccgcctcggcctccagctgaacacggcacacacagtgtcacaggagggaaggctggtgtaacagctaccacccatctccattttccttaattgaatgtgatcagaagggaaatctgctccattgaaygagaaggacatactgagtccaacagcgcttgacagtgccccctgctctccggggtggagcattggtctcacgctgggatacggcagcaacatccaagcgctatacaagtttatagcactgcctcccagttctgtcctgacctcaccatgggccaggaacatacagctcgtggccatccctgggctgtggagctcatgaagagcactgggtgggatctcaagcccctcaggacacggaacctgtccactcatgtggactcatgtctgtgtcccctgtgtccagcagacaccaggcccaggg

SEQ ID NO: 168144 - DNA, 601 bp, Human
cttgtgtcaggagcatccccgctccacccctccctcctccggctgcctgtctgagttcgggagggagtgaacttgaacctgcaggacacccccttccaggccccagctgcccccagaaggcccagggccggctgcatacctttcttcctggccagagcgatgatgtcggctgcactcttgctcatgaccttggtgatgtacacagggcagttgatccggcccgcaatggtgatggcccggaacaccgcctcggcctccagctgaacacggcacacacagtgtcacaggagggaaggctggkgtaacagctaccacccatctccattttccttaattgaatgtgatcagaagggaaatctgctccattgaatgagaaggacatactgagtccaacagcgcttgacagtgccccctgctctccggggtggagcattggtctcacgctgggatacggcagcaacatccaagcgctatacaagtttatagcactgcctcccagttctgtcctgacctcaccatgggccaggaacatacagctcgtggccatccctgggctgtggagctcatgaagagcactgggtgggatctcaagcccctcagg

SEQ ID NO: 168145 - DNA, 601 bp, Human
tctacttgtcagcttgcccttaaaaacactaaaacaacatatttggggtccacagctgctctgtccaataaggcagtcctgagccgcatgtggccaccaataacctgaggctgtggttagtctgaactgagttgtgtacatgtaagatactgaattttgaagagagtacagaaaacatcatgcaaaatattaatgatttttacattgatgacatgctgaattaatatgtggatccattagattaaacataatatattattaaaattctctttaaatggagctgagcttatcgaggtgaatrtcctaaggtcattgggaccaaagaattccagccaccatccttgtgtcaggagcatccccgctccacccctccctcctccggctgcctgtctgagttcgggagggagtgaacttgaacctgcaggacacccccttccaggccccagctgcccccagaaggcccagggccggctgcatacctttcttcctggccagagcgatgatgtcggctgcactcttgctcatgaccttggtgatgtacacagggcagttgatccggcccgcaatggtgatggcccggaacaccgcctcggcctccagc

SEQ ID NO: 168146 - DNA, 601 bp, Human
gtaacctctctgagccccggtttccttatcttcaaaatggagctagtttcaggcaagctgtgctgttctagcctctacttgtcagcttgcccttaaaaacactaaaacaacatatttggggtccacagctgctctgtccaataaggcagtcctgagccgcatgtggccaccaataacctgaggctgtggttagtctgaactgagttgtgtacatgtaagatactgaattttgaagagagtacagaaaacatcatgcaaaatattaatgatttttacattgatgacatgctgaattaatatktggatccattagattaaacataatatattattaaaattctctttaaatggagctgagcttatcgaggtgaatatcctaaggtcattgggaccaaagaattccagccaccatccttgtgtcaggagcatccccgctccacccctccctcctccggctgcctgtctgagttcgggagggagtgaacttgaacctgcaggacacccccttccaggccccagctgcccccagaaggcccagggccggctgcatacctttcttcctggccagagcgatgatgtcggctgcactcttgctcatgac

SEQ ID NO: 168147 - DNA, 601 bp, Human
gttcccatgagtgtaaaggccccgaggcagggtcctgcctggggttcagggtcagcatgaagctgggactggaccgagggagccaagggcagaggaggcccagggagggaggttggtcagggcgtgtgcaccggattgagttctgccttgttggatgttgcagggacttgggtttcactggcagaggacttactggttccaagcagaggggtgcttgatctaatctaggttctaaatgtctgacagcagactgtgatgggtagggtggggtgggcccgtgtggaaatagaaagtcttggtmggaagccagggatgatggtggcctgagccaggatggccacagcagacaggtgaggcgttgtcagactctagggcctctggtccgtgttcctgacattttcttagatgggcaagactgtgggactagcagctttatgggggaagatctgcagttctttgtaaacgtgagctgcccaccagacattggactgcagatgttgagtaagcccttggctacgctagtcaaaggtttctgtatcatcagggggatggtgatttccacgtgggcgcacaccactgccccctcctccaaggttccttc

SEQ ID NO: 168148 - DNA, 601 bp, Human
gaaggtgaggctgtcctccaatccagaggcccaggaaatgttagcaattgcctagatgcagaggagtatatttagaagttttcttcactcatttattcaacaaaattgtgttgcatgcttcctatgtgcccggtacaatttaaggaatggggactgcatctaagatcagaaagagagagcttctgcatgtgtcagctatactgagggatgggggagactggcaataagcagaggcgaatggggcacatgggcgctgttagagtgagtgtcagggattcaaccaaagcaggtggggatgagrcgtgctggggacaggctggagatgccatttccaggaggataatcagaaaattacgtcactgaggagccttctagcaaagatctgaaggaagtcacagagcaaaccatgtggcgtctaagaaagagggaactagccaggggttcccatgagtgtaaaggccccgaggcagggtcctgcctggggttcagggtcagcatgaagctgggactggaccgagggagccaagggcagaggaggcccagggagggaggttggtcagggcgtgtgcaccggattgagttctgccttgttggatgttgc

SEQ ID NO: 168149 - DNA, 601 bp, Human
aaaatgaatggaccattattagtggttctaaatgcaaggtgaggaaggtgaggctgtcctccaatccagaggcccaggaaatgttagcaattgcctagatgcagaggagtatatttagaagttttcttcactcatttattcaacaaaattgtgttgcatgcttcctatgtgcccggtacaatttaaggaatggggactgcatctaagatcagaaagagagagcttctgcatgtgtcagctatactgagggatgggggagactggcaataagcagaggcgaatggggcacatgggcgctgtyagagtgagtgtcagggattcaaccaaagcaggtggggatgaggcgtgctggggacaggctggagatgccatttccaggaggataatcagaaaattacgtcactgaggagccttctagcaaagatctgaaggaagtcacagagcaaaccatgtggcgtctaagaaagagggaactagccaggggttcccatgagtgtaaaggccccgaggcagggtcctgcctggggttcagggtcagcatgaagctgggactggaccgagggagccaagggcagaggaggcccagggagggaggttggtc

SEQ ID NO: 168150 - DNA, 601 bp, Human
aaaataaaataaaataaaataaataaaataaaataaaataaaaaatgaatggaccattattagtggttctaaatgcaaggtgaggaaggtgaggctgtcctccaatccagaggcccaggaaatgttagcaattgcctagatgcagaggagtatatttagaagttttcttcactcatttattcaacaaaattgtgttgcatgcttcctatgtgcccggtacaatttaaggaatggggactgcatctaagatcagaaagagagagcttctgcatgtgtcagctatactgagggatgggggagwctggcaataagcagaggcgaatggggcacatgggcgctgttagagtgagtgtcagggattcaaccaaagcaggtggggatgaggcgtgctggggacaggctggagatgccatttccaggaggataatcagaaaattacgtcactgaggagccttctagcaaagatctgaaggaagtcacagagcaaaccatgtggcgtctaagaaagagggaactagccaggggttcccatgagtgtaaaggccccgaggcagggtcctgcctggggttcagggtcagcatgaagctgggactggaccga

SEQ ID NO: 168151 - DNA, 601 bp, Human
accgagattgcaccattgcactccagcctgggcgacaagagcaaaacgcagtctcaaaaaataaaataaaataaaataataaaataaaataaaataaaataaaataaataaaataaaataaaataaaaaatgaatggaccattattagtggttctaaatgcaaggtgaggaaggtgaggctgtcctccaatccagaggcccaggaaatgttagcaattgcctagatgcagaggagtatatttagaagttttcttcactcatttattcaacaaaattgtgttgcatgcttcctatgtgcccrgtacaatttaaggaatggggactgcatctaagatcagaaagagagagcttctgcatgtgtcagctatactgagggatgggggagactggcaataagcagaggcgaatggggcacatgggcgctgttagagtgagtgtcagggattcaaccaaagcaggtggggatgaggcgtgctggggacaggctggagatgccatttccaggaggataatcagaaaattacgtcactgaggagccttctagcaaagatctgaaggaagtcacagagcaaaccatgtggcgtctaagaaagagggaact

SEQ ID NO: 168152 - DNA, 601 bp, Human
gcactttgggaggctgtggatcacctgaagtcaggagatcgggaccagcctgaccaacatggcaaaaccttgtctctactaaaaaaaaaaaaaaaaaattagccaggcgtggtggtgggcgcttgtaatcccagctactcaggaggctaaggcaggagaattgcttgaacccaggaggtggaggttgcagtgaaccgagattgcaccattgcactccagcctgggcgacaagagcaaaacgcagtctcaaaaaataaaataaaataaaataataaaataaaataaaataaaataaaataaataaaataaaataaaataaaaaatgaatggaccattattagtggttctaaatgcaaggtgaggaaggtgaggctgtcctccaatccagaggcccaggaaatgttagcaattgcctagatgcagaggagtatatttagaagttttcttcactcatttattcaacaaaattgtgttgcatgcttcctatgtgcccggtacaatttaaggaatggggactgcatctaagatcagaaagagagagcttctgcatgtgtcagctatactgagggatgggggagactggcaataagcagaggcgaat

SEQ ID NO: 168153 - DNA, 601 bp, Human
taatcccagcactttgggaggctgtggatcacctgaagtcaggagatcgggaccagcctgaccaacatggcaaaaccttgtctctactaaaaaaaaaaaaaaaaaattagccaggcgtggtggtgggcgcttgtaatcccagctactcaggaggctaaggcaggagaattgcttgaacccaggaggtggaggttgcagtgaaccgagattgcaccattgcactccagcctgggcgacaagagcaaaacgcagtctcaaaaaataaaataaaataaaataataaaataaaataaaataaaaaaaaataaataaaataaaataaaataaaaaatgaatggaccattattagtggttctaaatgcaaggtgaggaaggtgaggctgtcctccaatccagaggcccaggaaatgttagcaattgcctagatgcagaggagtatatttagaagttttcttcactcatttattcaacaaaattgtgttgcatgcttcctatgtgcccggtacaatttaaggaatggggactgcatctaagatcagaaagagagagcttctgcatgtgtcagctatactgagggatgggggagactggcaataagcag

SEQ ID NO: 168154 - DNA, 601 bp, Human
gacaccctcggggatcagggtaaagttgtccttgcccaccgccttctgggcagtgctgtagggacagtggccgctgcctgtgacctgcaagtccccactggcaaggacaaaacaaggtagagttcagaccctagttcattttgaaggcaaatcctgacttcagacaggtacatgcagcacagccagtgaatgaatgaatagataaggaagccagtgggtaagagagactctctagcgtgtgcctgcacgtgtcacaagtcagggatgccccatttatgtcactggcctcatgctttgcacrttacaaagtgagtaatgtgtgctgacatttgtcttcttgacataaggcagttggcttaagggctggccagagtgtttgtgctgtgcttgcagaacaaacactattcattggttacagcaaagtggcacaagttcactgggatttacccttttgtcccctggtgttttaaaaacaaatactctttgatatatcaggtgccctgagctgaacacctaagacaataaaatgaatggaccaggctgagtgtggtggctcacacctgtaatcccagcactttgggaggctgtggatcacctgaag

SEQ ID NO: 168155 - DNA, 601 bp, Human
ctgtgcacgcatctttggtaggttgctggatgagtggagaaatcaaaggcatataagatacaaagcagagaaggcccataactatgggcatggaatgtgaaaaagtgtgcactttagggccaaccctttcctgtctattagcagccagccacaaaaccgagtgggaggtttccgacataccaaatcaaatcctttccagcttgataattaaattgagaaccttagatctaatactttccctcgctgagccctgaagcttacacattataagcagtgtcagatggctgggaacacatgcatmcatgggcaggagcaaagagacagagagagaggagaggaagagagagagagaaagagaaggagaagcagcttagttgagcctgctcagatccctcctcccaatctctccaactggaggagaaatgggaatgactgagtcaggctagatatcagatcacatcctagttggaaaattcataaatcatttttaaccagtctttaaaaatgattacaacgaagaatcacttatctcagcagcacaaataggccaggacttaccgacttgtgacttttggctgttatggtcttcaacttgtcgggg

SEQ ID NO: 168156 - DNA, 601 bp, Human
aagtgtttcctgtggctttcttatgaaacttccttgtgcctcatgtcctgtccccacacctgtggtctccttctccagtatgtgagcccatactccttctccagtatgtgagcccatactccttctgcagtatgtgagcccatagcccatggggccatgggaacacccactgcagctccatcacggtgtgcacatgcactacttctggcctgtgtgcttgcacagactccagtgaaccagggaccactgtggcctcttgggtctgtgcgtgtagttgttaatccagacccaaggccactcytggccatgcaggagggtgttaaagcaagcccttcagggaggcacagttgtcttctgccatctctgcatgcaccctctctgtgcacgcatctttggtaggttgctggatgagtggagaaatcaaaggcatataagatacaaagcagagaaggcccataactatgggcatggaatgtgaaaaagtgtgcactttagggccaaccctttcctgtctattagcagccagccacaaaaccgagtgggaggtttccgacataccaaatcaaatcctttccagcttgataattaaattgagaacctt

SEQ ID NO: 168157 - DNA, 601 bp, Human
atagaattgcaagccctgctggactgtacatgtgcgtggcataaacctttctccatgggaagatgatctcaggcaccccgttccctggagatgggggctgtgggaagcaagtagtgttaccagggagcattgtgtattataagaatgacctggattggtgagccggacaaggtcagtgagcagctaccgagacctctgcttctgcaggccatgtctgtggcagccaatggatactccagggccatggccgtgagctgctacaagtgtttcctgtggctttcttatgaaacttccttgtgcytcatgtcctgtccccacacctgtggtctccttctccagtatgtgagcccatactccttctccagtatgtgagcccatactccttctgcagtatgtgagcccatagcccatggggccatgggaacacccactgcagctccatcacggtgtgcacatgcactacttctggcctgtgtgcttgcacagactccagtgaaccagggaccactgtggcctcttgggtctgtgcgtgtagttgttaatccagacccaaggccactcttggccatgcaggagggtgttaaagcaagcccttcaggga

SEQ ID NO: 168158 - DNA, 601 bp, Human
ccccaagcagtgtgtacacacgtgaaataattcataataaataatagaattgcaagccctgctggactgtacatgtgcgtggcataaacctttctccatgggaagatgatctcaggcaccccgttccctggagatgggggctgtgggaagcaagtagtgttaccagggagcattgtgtattataagaatgacctggattggtgagccggacaaggtcagtgagcagctaccgagacctctgcttctgcaggccatgtctgtggcagccaatggatactccagggccatggccgtgagctgytacaagtgtttcctgtggctttcttatgaaacttccttgtgcctcatgtcctgtccccacacctgtggtctccttctccagtatgtgagcccatactccttctccagtatgtgagcccatactccttctgcagtatgtgagcccatagcccatggggccatgggaacacccactgcagctccatcacggtgtgcacatgcactacttctggcctgtgtgcttgcacagactccagtgaaccagggaccactgtggcctcttgggtctgtgcgtgtagttgttaatccagacccaaggcca

SEQ ID NO: 168159 - DNA, 601 bp, Human
gtggttgctagggaatgggggtgagagagagggactgattgttcatgggtacagggtttcttttctggaggtgatgaaaacattctggaattatgattgtacaaccttctcaatatactaaaagccactgaattgtacacttcaaaatggcaacacttatggtatatgaattatatctcgataagaaacttaaaaacatccagatagtctatgatatacaaacatgtatgcatacccatgatgtggcactttgatgtgaatgttttccacaaagataggaaagaataaaagttgtgttttrtagaaaagtagatttaaaatctaatcactggtcaatatataaggaatgatctcttttcattgttaaaagtaacatttttttaaaacatataaaaacaaaacgaacctctaagcatttctcaatccatgttctgaaaaaattgcaattatgtggatggcattgctttggacagagaaaatgaaacagacaaaatcctttggtcaaaccacctcacggaatcctcaactgtcctcttgctgctatgaaaagaattcaaatcttgcctcacacagagaggggatgcttccccaagtttaccct

SEQ ID NO: 168160 - DNA, 601 bp, Human
ccagaataggcaaatccatagaaacagaaagcagattagtggttgctagggaatgggggtgagagagagggactgattgttcatgggtacagggtttcttttctggaggtgatgaaaacattctggaattatgattgtacaaccttctcaatatactaaaagccactgaattgtacacttcaaaatggcaacacttatggtatatgaattatatctcgataagaaacttaaaaacatccagatagtctatgatatacaaacatgtatgcatacccatgatgtggcactttgatgtgaatgytttccacaaagataggaaagaataaaagttgtgttttatagaaaagtagatttaaaatctaatcactggtcaatatataaggaatgatctcttttcattgttaaaagtaacatttttttaaaacatataaaaacaaaacgaacctctaagcatttctcaatccatgttctgaaaaaattgcaattatgtggatggcattgctttggacagagaaaatgaaacagacaaaatcctttggtcaaaccacctcacggaatcctcaactgtcctcttgctgctatgaaaagaattcaaatcttg

SEQ ID NO: 168161 - DNA, 601 bp, Human
ccatttccctggtcccctccagggagaactggtttcttttataccctttaaagagcagccactcaagctcatgtgtgcataaactaaacgtggtccatccctacaagggggtattattcagccatcaaaggaacatggtacccatccatgatatagcacggatgatcctcaaaaatatgatgctaagtagaagccagacataaaaggccacatattggatgattccatttatatgaaatgtccagaataggcaaatccatagaaacagaaagcagattagtggttgctagggaatgggggwgagagagagggactgattgttcatgggtacagggtttcttttctggaggtgatgaaaacattctggaattatgattgtacaaccttctcaatatactaaaagccactgaattgtacacttcaaaatggcaacacttatggtatatgaattatatctcgataagaaacttaaaaacatccagatagtctatgatatacaaacatgtatgcatacccatgatgtggcactttgatgtgaatgttttccacaaagataggaaagaataaaagttgtgttttatagaaaagtagatttaaaatc

SEQ ID NO: 168162 - DNA, 601 bp, Human
ggacctgggctgctgtccctactcctgggtgaggaacgtgctgtgctttggtgagaatctcaagctgcagaggtgtgaggaggccctggtcatatcacaaatgccacaccctgcatttcacaagaacactgaattgtaaacatcaattccttcatttcttaaaggtaacatacaaacaatgtaaaaatttaaacaacacaaaacaccatgatgaaaaaacctcttgccatccatgagccccatttccctggtcccctccagggagaactggtttcttttataccctttaaagagcagccastcaagctcatgtgtgcataaactaaacgtggtccatccctacaagggggtattattcagccatcaaaggaacatggtacccatccatgatatagcacggatgatcctcaaaaatatgatgctaagtagaagccagacataaaaggccacatattggatgattccatttatatgaaatgtccagaataggcaaatccatagaaacagaaagcagattagtggttgctagggaatgggggtgagagagagggactgattgttcatgggtacagggtttcttttctggaggtgatgaaaacat

SEQ ID NO: 168163 - DNA, 601 bp, Human
cacccatctcccagctgaaactggccagcccttggggacctgggctgctgtccctactcctgggtgaggaacgtgctgtgctttggtgagaatctcaagctgcagaggtgtgaggaggccctggtcatatcacaaatgccacaccctgcatttcacaagaacactgaattgtaaacatcaattccttcatttcttaaaggtaacatacaaacaatgtaaaaatttaaacaacacaaaacaccatgatgaaaaaacctcttgccatccatgagccccatttccctggtcccctccagggagractggtttcttttataccctttaaagagcagccactcaagctcatgtgtgcataaactaaacgtggtccatccctacaagggggtattattcagccatcaaaggaacatggtacccatccatgatatagcacggatgatcctcaaaaatatgatgctaagtagaagccagacataaaaggccacatattggatgattccatttatatgaaatgtccagaataggcaaatccatagaaacagaaagcagattagtggttgctagggaatgggggtgagagagagggactgattgttcatgg

SEQ ID NO: 168164 - DNA, 601 bp, Human
cattattctatttctcagggtcttggcattcttcttactgatttctaaaagtacacactcaatgttaaagaatttatcctttgttatgtgtgttgcaaatatgtcctccctccctggtcctctgtctctggaactcaaatgaagtaattgtttttgccacacagattattttgtataatttttgtgtagtcagtggtcaaacagaccattctttaccatttctaagttttgtgtcttgcttagcaagatcctttccccttcaaaattatcattctttcaaaaaatgtgtgttgtattctartcctttcatagctttattttatcttaatctttgaaccatggtttgatttgtttgatagtaaatagtagggcagaggttaagcctcttgggccaggtgttctaacacaattggatgagtaactatcgtttcctaattctaattgtctcctttattgtaaaccaaattctcatatgcagtcagtctattccttggctctcttttcttgtacccctgccaaactgtttggtttattgcagctttatgacacgttttaataactgggatgactgatacccccgggcccagtcttcccttttttc

SEQ ID NO: 168165 - DNA, 601 bp, Human
gaagtcactttgcctgacactaccacctacccacccccggaaaggacccctgagtcccagacaaggcagcagcaacgggcccatcttcatgtatgttcttgtagaagtcaacagcgaggcaaagattcggggggcagatagtttgttgggagatggttccagaaagggggaaggagtggggagctgagacagggagggagaaaactcagtacagagggacaaggagtgggccaggtctatggggggcagggctggggatgctgtggggaggacacctccacaccagcctgcaggaggacgrggaaggagggcaatggagccacagccctagccccactgggaaagggttgtgggggcagagaccctgaaagcagcagggcttccaggcaggaggctgtcagcctgctgggaactgctgacagcagcccaggtgacctcagggatggccaaggttgggagggcacctgctccaggcactggagaacagcatgtgttcagggacctgtacagggtcccagcatgagtcagtggcagtgccctaacccaacacggggcttcatcctccatatcaggtgacagtgccctgaccccaggcctggct

SEQ ID NO: 168166 - DNA, 601 bp, Human
atatgcatgcacatgcagtaacaaaacaggcctacacagtagcatacacgcgtgaacacgcacacacacttaaatcacatacagatcttcacaaaggcatactcacatatgtatacacatgcatacatgcccacacacacactcatacaggtatacacacccatatatacacttacacacacgcatactcatacacacaaagcttcatgcaggaggaccccaaatcccttccaaagagaagtcactttgcctgacactaccacctacccacccccggaaaggacccctgagtcccagacaaggcagcagcaacgggcccatcttcatgtatgttcttgtagaagtcaacagcgaggcaaagattcggggggcagatagtttgttgggagatggttccagaaagggggaaggagtggggagctgagacagggagggagaaaactcagtacagagggacaaggagtgggccaggtctatggggggcagggctggggatgctgtggggaggacacctccacaccagcctgcaggaggacgaggaaggagggcaatggagccacagccctagccccactgggaaagggttgtgggggcagagacc

SEQ ID NO: 168167 - DNA, 601 bp, Human
attgaccaaatccggcccaccgcctgtttctgtacgatccatgacctgagaatagtttgtacattttcaaatggctattgaatataacatcctagatgttgacatcctagatgttgcctcttagcttacaaagcctaaagtatttactatccggccttctaagaaaaaaaatcaccatactcttagtacccagcacggtgtgcaacccatgcaacgcctcaaagagtttgcaggacaaaattccagttcaactttctcaacgtgtgcgtgcctgccctcatgtggccatctcaccaaatcrcagatacactgccctgagaccttaagaaagtcaggagggatcaggtcaacatctaattttgttcccacacatttgttgagcaccaagtcctggtattttgacactggatttcttggggcttccgtttcctctttaaataaatagggtataatgttactttatggagtagtgaggataaaataaaatcatgggttatgaaagtgcttagtacactgcagtgggtgaacaggctaaagacttacacagagcacatgccctgcaaatggcagctactcccatctcttgttcatccccaccact

SEQ ID NO: 168168 - DNA, 601 bp, Human
tccctggcctccacagagtccactgctccctcttctgtgcccctcagtccctgggctccccccaccttcagccctgaccaccttgtggtgttcttgtcaaaatccccagtaaaatccgacattcctgagacaggtgatcaaacacttactgagtgcctactgtgtgcaggcgcacatttggtgctttaacatgttactgcatttagggcacacaatcatactatgaagggggtgtttgtactcccaacttacgggtgagcaatttgaggttcaggccacgtgtcttgcgggacacaggtgytgggtggggaagccaggattgaagcccaaactggttggttttcaaagcccatgatcttaggcacactgtcccacactccaaaggtattttacatattgtgtgtgtacacatttgtatatgcatgtgcatatgtgtgtgcatgtgcatgtgaactccgcaagctggatttacttccctcattggcgataggtggatctgaagggggggggggtggtgtgcagaggttcttaattttaatctttcaaaaccaaccatccattctacttttacctattctcttgcataaagatgtaaaattct

SEQ ID NO: 168169 - DNA, 601 bp, Human
aaggcccaacaggagggaatcaatgcaagatttgagcctattttgtggaagcccgcccatcagccgtcttccctctcttcgcctccttgggtctcaggaactcagccttcagaagtcatgaactgaatctctcctcccacccccacatccaccagtctctaccaagagtgagtcctcaggaagcagccaccaccattcgttatcacgcggggggactgccaagcattcgtacccaatccagacaccaccactgaaatgaaagtgccctagtcaggtcagtgggcagttcattttctttatattttcacaagctttgaattcagaaataagagccacaacaagttggttgttaagtaaaaatgggagtgattacaaaggaaaactttgtacaaaactttaaaaatctgactgccccgtcaactgcctcagagggaccaggactcaggccacgcaggggcagccatcagccccccatcgtcagccccgaatggggatggggagacctctttctgagtgtgaacctggctcggcctgaagcctagagctggcttgaagaacacacacagaccagaagacagcacggtgagttacaagtgccacg

SEQ ID NO: 168170 - DNA, 601 bp, Human
gaacttccagtgtctgtggtaacatcacttgataaacagactcctttaaacagcaagtgcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagactttgtaagtttgttcagagtctcactttgtgaattttaacaarttatctttaatggcagaaggattgagaatgaatggaagagagtgtgagcatttagtttagccagatcagaggagttaattgcctgttgtgagtaataagtaatattcagctgcattaaaaaataaatcttgatatggcattaaattgggtaggagtttttctctacacaggctcataaaaatgggttctatagcaaaatgttgtatcaaccatttttagtattgccttattccttagagaaatttattctatgtctttttacaaataaaatgaattctgaagaaatatgaatattcactt

SEQ ID NO: 168171 - DNA, 601 bp, Human
gatatgaaagcatacctgagatctatgatcccacatctggaatctggaatgaaatcttccaagtccaaggatgtgtaagtacactaatacactaaactatcattatcatttacaagagaagcctatgcattatctctatatcccagcaagggataaatactgcgcacagtagacttcatttcttttaagtaacatgccaaataaaattagactatcagtaccaatgtaaattgaatacaaatgtgtacacacacatattggactttatctatttggattttttcaaattttattggcaggttttttttttcataactatagtaactctaagggaagttttgcattttgtgaataaattttaacatatttattagaactacagtttcagtttgtgaagttatcaaagtgtaacagccattcttatttcatttgtgcttacattttaaaaattgactaatgtatgtacattttgtcccctgcagactttctgctgctgaagtaatgcaatggtctcaatctctggaaaaacttcttgccaaccaaagtaagtataactattgaatgtttctgggttcagctaaatactctaaaaaattgaatg

SEQ ID NO: 168172 - DNA, 601 bp, Human
ttatttcatttgtgcttacattttaaaaattgactaatgtatgtacattttgtcccctgcagactttctgctgctgaagtaatgcaatggtctcaatctctggaaaaacttcttgccaaccaaagtaagtataactattgaatgtttctgggttcagctaaatactctaaaaaattgaatggcttcactaaatatagtattctgggtaggatagtatgcaaaaggttgtattctagtttgtctgtagttactgataacttcagcatagtatgcctcttaataatgctgacttagcactcarttctgccaactccttttagacaaatttgccaagacaattaggtattttcatagatcattatggagataaaattaaacattgtgctgggattctgatatgtaaaaattttaaaagtaagccaaatattttaatatgtacattgccattttgaaatctgcctaaagaatgtatttttctacacttggatgtaacaagtatgattcattcattcaattaattaaattatctttcatacattcatcattcatctcacccttatgtagaggacattgtagaggtaccaaggattcaaaatcaaag

SEQ ID NO: 168173 - DNA, 601 bp, Human; identical to SEQ ID NO: 26252

SEQ ID NO: 168174 - DNA, 601 bp, Human; identical to SEQ ID NO: 26253

SEQ ID NO: 168175 - DNA, 601 bp, Human; identical to SEQ ID NO: 26254

SEQ ID NO: 168176 - DNA, 601 bp, Human; identical to SEQ ID NO: 26255

SEQ ID NO: 168177 - DNA, 601 bp, Human; identical to SEQ ID NO: 26256

SEQ ID NO: 168178 - DNA, 601 bp, Human
aatttttagctcatataatcttcacaaagattatttaaggtaaatattattcctgtttcacaaatgaggaaattgaggcactgagcggttacctacctgcctaagatcacatccctggcaagtgctgaagctggtatgcagtttgagtccggctccagcacacattcctttaaccgttatactacattgtctctctataggtttcaaatatttgttcttgatatgcctcttgatggaacagaggtaatccatataccactccaacaatttccatcacttcccttacatatgaaatactcaytcattcacccaggaggtatttactaagcatctacttttgcaccaggcataaaggagtccacaggacaattaaatgtggtgccttccctagctaagtatatacagtctagttcaggtgatttctttctcctcttttgctactgctgttaggttgagtctcacttgttctaaaatgtgcccaaggtaacagaagaataatttacctgacgcctttattgatgtgtccatagaatagagagtaatagaaccttcaacctcctcaagactccctatatcatattttttcattattcgtttctac

SEQ ID NO: 168179 - DNA, 601 bp, Human
ttgcaatactttgcaaaatatatgtttgtatatattgagttctttcactatgttatggaattgtctgtgattccaaaaactaattgcttcttctgccttttgttaatggtaaataattaatggttaatatttgcttggtggagtctttttaaaaacagatgcattgcaaagcaactctattcatgctgaattctgaaaaatctcagaatggaaaaaataagtaattgagtaaatttcagtgaaaagcacattctggatatgcctgatttatggctctgatcaaggtggtcactgctattcrcaatgtttatattattgccttgactgtttgaggccagtgtgactgatgaaggtagctgttcatagaagatggtttgacttaaatactgccctagtttgtgagtgccagctgctatttgtaaaatttagtagaggccttttttcactcattcaacaaatattcaatgggctattctcacttcaagtactctattagacattaaaaatatagaagtgaacaggacaagtacttacagatgcttccaagctatggagaaaaattgcataactaattataacagaaaatcacataactaattat

SEQ ID NO: 168180 - DNA, 601 bp, Human
tggtcatcttcaggatatttccctcatttcctgtgttatttctattatcatcatcatagcagataaattttgtttgttcattgtatgtgccaaacactattataagagtttggtttttgttgttgcttttgagacaggattttactctgtcgcccaggctggagggcagtggtgtgatcatggctcactgcagcctccacctcccaggctcaagcgatccaaccacttcagcctcccaagtagctgggaccacctgccaccatgtccaactaatttatatatatatttatatatttatatatatatatatttatatatatatatatttatatatatataaaattttgtatattttttgtagagatggggtttcgctgtgttgcccaggctggtctccacccctgagctcaagtgatctgcccacctcagcctcccctcgtgctgggattataggggtgagcccctgcacccggcctctaagagctttaaccctcattaaaatccccttaggagatatcatagtagcccattttcttagaaggaaactgcagcatctaaagataatagctgcccaatatgcatttcctacttgttcctagca

SEQ ID NO: 168181 - DNA, 601 bp, Human
gtcatcttcaggatatttccctcatttcctgtgttatttctattatcatcatcatagcagataaattttgtttgttcattgtatgtgccaaacactattataagagtttggtttttgttgttgcttttgagacaggattttactctgtcgcccaggctggagggcagtggtgtgatcatggctcactgcagcctccacctcccaggctcaagcgatccaaccacttcagcctcccaagtagctgggaccacctgccaccatgtccaactaatttatatatatatttatatatttatatatatatatatttatatatatatatatttatatatatataaaattttgtatattttttgtagagatggggtttcgctgtgttgcccaggctggtctccacccctgagctcaagtgatctgcccacctcagcctcccctcgtgctgggattataggggtgagcccctgcacccggcctctaagagctttaaccctcattaaaatccccttaggagatatcatagtagcccattttcttagaaggaaactgcagcatctaaagataatagctgcccaatatgcatttcctacttgttcctagcatg

SEQ ID NO: 168182 - DNA, 601 bp, Human
aaccctcattaaaatccccttaggagatatcatagtagcccattttcttagaaggaaactgcagcatctaaagataatagctgcccaatatgcatttcctacttgttcctagcatggaaggatcgtgttgcagttatcttcccaggtgtatggtatctttgatgcaggctgttggagttcatatttcagttctacctctactagctgtgacatcatgggcaggttacttcacctctaaagggtccaacacaatttcagtacctatgtaaatgtttattaatattagctgcattactattgktattctatatcttcccatatcatattatttccttcagggtgccttataggaaatcttgatgatgtgttgacatttataactgatccaactttgtaactttctcgaacctaactatttcagaatgcctgtctaagtgatctgttgattttcaaaatttaaaatacagtttcctgatcagtcagcatagtcctcatcataggttgaattcggagcagaattcaaccacaactgtcagttctgtactgctgatcaagacagttgtgtctgtgggaactctctgacatgcaggctagtgtgctt

SEQ ID NO: 168183 - DNA, 601 bp, Human
atacttccgtggtgtccacagtatttactacagcactaattccaaagtaggtgttcagtaaatacctgatcactaattgcataatgataagtatttttggtgggtgaaggttttatctaccatagatattatgatattaaatttatcccatgttgggatgctatgattacattaacttaacattgaatgtaatagttatttgtaacttcaaaagataagttaaagcattagaatacagtaaaagtgtcaaattaacctacaggtgtaagatgccattgtattccattaattccacaaaaartcattgctcctggcacaagtggtgcaatgataggcaaaagaaaggtactatctctaccctcttggagcttccaggcatacagaaagtctgactttaaacaaaattttaattatggcaataagtacaaaggagatgctcttttcacaaagaccatgtatacccactggtcttaccaagtttgaaaagtcagagaaggcaccacagggcaattgtggcgaggagcttaattttccatattcatgcatctgcatgatgcctcacaagtgaagggctcaggtgaagtctgtaactttgcctttg

SEQ ID NO: 168184 - DNA, 601 bp, Human
gcagggacacaacttaccaaaatctctgggatgcagctaagttagtgtaaagaagaaagattatagcattaaatgccttcatcaagaagttagaaagatctcaaattaacaatctacctttgtacctaagggaactaaaataaaggaacaaacatacccccacagctggcagaaaaaaataaataactaatattaaagaagaattaaatgaaattgagatgccaaaatccatataaaagaccaatgaaaccaagagttgtttcttagaaaaaaataaacaagaccgatagaccactagctrgaataacaaagaaaaataaagagaatatccaaaaaagaacaatcaaaaatgacaaagataacattacaactaatcccacagaaatagaaatatccttaaaaatactatgaatatctctactcacatgaattagaaaatctagaggaaatggataaattcctggaaatgcaatctcccaaaactgaatcattaagagattgaaactctgaaaagaccaatatcaagctctgaaactgaatcagtaataataataaaaaaaaaaaaccctacccaccaaaaaaagcactggagcagatggat

SEQ ID NO: 168185 - DNA, 601 bp, Human
caaataaatgaaaatacttttcatgctcatggattagaagaatcagtatcattaaaatggccatactgcttaaagcaatttacagattcaacactactatcatattacaaatgctatttttaaataaatataaaaaaactgttctaaaattcacatgaaccaaaaaagagcccgaatagccaaagcaattctaagcaaaaagaacaaagccagaagcatcagactacctgacttcaaactatactacaaagctacagtaacccaaacagcatggtactggtacaaaagcagacacatagaycaatggaacacaatagaaaactcagaaataaagccacacacctacaatcatctgatctttggcaaggccaacaaaagcaagcaataggtaaagcactccctattcagtaaatggtgctgggataaatggctagccatatgcagaagaatgaaactggacccttaccttttaccatatacaaaaattaactcaaggtaatttgcctaggctgtaatcctaagcaaattaagtaagcaagttaattcaaatgcaggacatcaaactataaaaattttagaagtaaatctaagaaatactgtt

SEQ ID NO: 168186 - DNA, 601 bp, Human
aagataaaaacttgcttattttaatgctgcaaactgactgttttatattcttttctatttttcagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatyatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaa

SEQ ID NO: 168187 - DNA, 601 bp, Human
gataaaaacttgcttattttaatgctgcaaactgactgttttatattcttttctatttttcagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattattatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaata

SEQ ID NO: 168188 - DNA, 601 bp, Human
atgattttggtgagaaatgttttcaatatgaatatatttctgaagtgaaattgtttgaaactgtcaaatatatattgttatagaattttaaaatatggtaaataaatccctgagttttgtatgtagccccctgtttcccctaatattatacaaaatacaaaatgccatttgtgctccagaagttaagccagttttcaggggtatgaaaaattagaggcttattgaacacattaaagaaaaatttggcatgtctactttatgaactgctcatatttagatagaaatatattttctaaactamctaaatgcttttttaaaaaatgtgttttgaataatctgggttttttaattacttctaaattgcatctgtgattgtgtctcaaaacactaatttactacagtcaattgccctgagagtataaacagtcattcatgtattcattctgtaactagttattaagcgtgtactacatgtgaagcactttttggaacttacagatagaatcttgaactgtagtccattccagagaagaggggcaggggagagtagagtcataggaaagcacattgtgctgagcatctatccgttcagttcttgata

SEQ ID NO: 168189 - DNA, 601 bp, Human
atatatattgttatagaattttaaaatatggtaaataaatccctgagttttgtatgtagccccctgtttcccctaatattatacaaaatacaaaatgccatttgtgctccagaagttaagccagttttcaggggtatgaaaaattagaggcttattgaacacattaaagaaaaatttggcatgtctactttatgaactgctcatatttagatagaaatatattttctaaactaactaaatgcttttttaaaaaatgtgttttgaataatctgggttttttaattacttctaaattgcatcygtgattgtgtctcaaaacactaatttactacagtcaattgccctgagagtataaacagtcattcatgtattcattctgtaactagttattaagcgtgtactacatgtgaagcactttttggaacttacagatagaatcttgaactgtagtccattccagagaagaggggcaggggagagtagagtcataggaaagcacattgtgctgagcatctatccgttcagttcttgatatggctatatcccattccaggcatagaggcaggctttagggatacaatgataaagcgggggtgataaa

SEQ ID NO: 168190 - DNA, 601 bp, Human
atgtgttttgaataatctgggttttttaattacttctaaattgcatctgtgattgtgtctcaaaacactaatttactacagtcaattgccctgagagtataaacagtcattcatgtattcattctgtaactagttattaagcgtgtactacatgtgaagcactttttggaacttacagatagaatcttgaactgtagtccattccagagaagaggggcaggggagagtagagtcataggaaagcacattgtgctgagcatctatccgttcagttcttgatatggctatatcccattccagrcatagaggcaggctttagggatacaatgataaagcgggggtgataaataggtaaatagcttgcaacatggtaagcacaatagcaaacatatcgacacagtttcatataaattatgctgtgggaaacactacagtgtgtgctgtgtacctgtaacttaagtatgtacttaagtatgtacttaagcatgtaggacagagttcaaaggcaagactagattgatgtgatgatttggaaagatgtagcagtaattcagacaaagacagcaatttcttgaaaccaggaaattggagtaagaatgga

SEQ ID NO: 168191 - DNA, 601 bp, Human
tgtgattgtgtctcaaaacactaatttactacagtcaattgccctgagagtataaacagtcattcatgtattcattctgtaactagttattaagcgtgtactacatgtgaagcactttttggaacttacagatagaatcttgaactgtagtccattccagagaagaggggcaggggagagtagagtcataggaaagcacattgtgctgagcatctatccgttcagttcttgatatggctatatcccattccaggcatagaggcaggctttagggatacaatgataaagcgggggtgataartaggtaaatagcttgcaacatggtaagcacaatagcaaacatatcgacacagtttcatataaattatgctgtgggaaacactacagtgtgtgctgtgtacctgtaacttaagtatgtacttaagtatgtacttaagcatgtaggacagagttcaaaggcaagactagattgatgtgatgatttggaaagatgtagcagtaattcagacaaagacagcaatttcttgaaaccaggaaattggagtaagaatggagaaggaaggaccaaattaagatctatttaggaagtaaaattgaacaa

SEQ ID NO: 168192 - DNA, 601 bp, Human
tttttaaagtggccccagaagaaagggaagttcttaaatttttaatacaatgtcatgagtggctatatcattattttcctctctaatggaagatcccagagtacctagagaaaagaaagtgctgaaaatagaagtgggaagctagaaaactgtgaaaaataagaggtatcaagctcagaagataaactcagctgacttttcagtcttgcttggggctgactgtgggaagctctaattggaatgtaaaggtgcgctctgtgctgcttgacttcaccacgaatattcaccaccccagctaagcggaagccagaggcttcataaaatcactaaaaaataacaacataccaaatattgggaggaggaggaaaacacaactgcaatcaattattctgtcataagtacacataaaagggtagcaaaaatttctccagacagttcactattcatgtgctctgtatgaatgtcaagatctgtacattgtacatagtattaatgttttgtcatttttctcctaaactcatatttcttgagttcctttccattatatctgatgtttcttatctcttatttactgatattcatttaattttattatgctata

SEQ ID NO: 168193 - DNA, 601 bp, Human
atgttatctttttaactttattaatgttgttttgcctttgttttgcttaatgctaatacagctataccagctttcttttgattactatttgagaaatatatcttactccttttttatatatttttaatctctctcctgtctttgcactgtaaattagctttgaaaacagctcctaggtgaactttgcttttggtctactctgtcaatatttgtcttttaattaacaagatcaatctacatatagttaattggattatcaatgtatatggatttatttcagctactttattttgtgctttayatttgccccacttgttatatttcttctcttctttctctctcttcctttttaccttcatttgaattgtcagtttctttcttttttctatccattcctggtttaaatgaatgtattttatctctttttttttagtagtttctccaaaaatttaaacacatgcactaaacaagtgccaatatcttcatacctcagtcaaaaggtacaaagttctttatctccaataatgctctctctcctttggcggttgggttattctggttctagatgttaatgttgctgtttaacaccggatattaggca

SEQ ID NO: 168194 - DNA, 601 bp, Human
acttactgagtatgtacgttgttttaagtgctttgcttcatcatttaattatcgtagaaatcctataaaacaaagattataagcagcatcattttacataaagaaactgaggctgatagattatgactaacttgcccaagatcttacaactagtaagtggcattcctagaatacaaaatgcagatctacctggctccaaaatctgagcttttccacctcatgtgcttcacagttatgagcttaacacaactggtgttaggtggtgtccataaaaatttcttcctaccaagctccaccttayggtaaattacatcctatcagattctgttatagtttgatgggttgtatctaaagctttgccctagatttaccgataagtctggaacaaaaattagtattagtcacttcttgaaatgtcttgggctgaaataaattttggatgaattagagtggcagagtgacagcatagtgacaggcccttctggcgctcaatcaattaaagaaccaaaattgcccataattctgataatctcactttttctatctgtatgtactcagattttaaagtctgtgtgatgttgtaaagtgctttatgaaggca

SEQ ID NO: 168195 - DNA, 601 bp, Human
agtggcattcctagaatacaaaatgcagatctacctggctccaaaatctgagcttttccacctcatgtgcttcacagttatgagcttaacacaactggtgttaggtggtgtccataaaaatttcttcctaccaagctccaccttacggtaaattacatcctatcagattctgttatagtttgatgggttgtatctaaagctttgccctagatttaccgataagtctggaacaaaaattagtattagtcacttcttgaaatgtcttgggctgaaataaattttggatgaattagagtggcakagtgacagcatagtgacaggcccttctggcgctcaatcaattaaagaaccaaaattgcccataattctgataatctcactttttctatctgtatgtactcagattttaaagtctgtgtgatgttgtaaagtgctttatgaaggcattcctaacatttttttaaagcacacaaacaaaatagaaaaagtcaaggaaattctgacatattgtcacttagtctctgggaaacatgaattagtagctaaagcacttttttattcttaacttttataggcttccatgaataatgaaactggagac

SEQ ID NO: 168196 - DNA, 601 bp, Human
gaaagaaaaatattgcgtgtagaaattagaccaacttgttgaggcactgaacaaagatctatcctcaaaaataataataataagttcttcactattcttttggattaaaatatatattttatatataacatattatatattatatatattatataatatattttatatattatatatattatatattatattttatatattatatattatatattatattatatatattatacataatatattatatatattatatattatatatattatatattatatatattatatatattatatatawtatatattatatattatatattatatattatatattatatgttatatattatatgttatatattatatgttatatattatatgttatatgttatatattatatataatatgttatatgttatatattatatataatatgttatatgttatatatacattatatatatgttatatgttatatatacattatatatgttatatattatatatacattatatataatatgttatatattatatatacattatatataatgttatatattatatatacattatatataatgtatatattatata

SEQ ID NO: 168197 - DNA, 601 bp, Human
cctatataacaaacctgcacgttctacacatgtatcctggaacttaaaataagtaaataaataaataaaaagaaaaaagaaaaaaaagaaaagaaattgacacaatttcagtgcaacatcctcaaaagcaaggaaagtctatgagagtaattaattatctttgttttcaagccatcagcagacttcagattgtttctctattgtaattgaatgtctctaaggagcaaagttattacttaattaaaactaatccttctggtcacttacatatgacatagtcaacagcttatacttgatctcytttttttttttttttttttttttgaggcagagtctcaccatgttgcccaggctgaacttgaactcccgggctcaagctcagccttccaagtagttaaaaccacaggcccatgccagcacacccaagtatacctgtacttttattattgatgaacctaaaacacagatattactgggcaccagtgatgaatctactgttaacttgtaaatgaacagaaagcaaagtcctactgtattttttttaaagaaatggttcaagaattcgtcactagtttcttcttaatcattcttttactctgtg

SEQ ID NO: 168198 - DNA, 601 bp, Human
atgcacatttggggaaacataggtttaaatagactacatttgatattattgtaaaatatgaagacctgggtcctattattttttcctgtagaaagtatcttaaaatcatgttgtataaaaatatttaattttacatatataagcaaatatataatggaaagaggtcacaatagaattaatagttttgtgactgagtttaatctgatgctggaagagttcttacatttagttattttgaaccatgtaccaagacagtgtgataatattttggcaaatatgtgtacatgtgaaaactgcctawggagatcaatatagtggattttacatgaagggacagaaacagaagattgaagaaagtaattccaataagtggatgacttgttagtattgcctagtaagaggacactggataattttgacaaagtaatgaaaggtacattgcttctgtgatctttcaggaacctgtgcatcagatcagtcagaagaaagattccagcagagaaggttatgatcaggaggtgtaagagttaggatagagaaatgggaattgttttcctaaaggggaaggaacagagagagagagaggttaattatacttcag

SEQ ID NO: 168199 - DNA, 601 bp, Human
gatagtttgctgagaatgatggtttccagcttcatccatgtccctagaaaggacatgaacttatccttttttatggctgcatagtattccatggtgtatatgtgccacattttcttaatccagtctatcattgatggacatttgggttggttccaagtctttctattgtgaatattgccacaataaacatacgtgtgcatgtgtctttatagcagcatgatttataatcgttgacctcaaccattcttaccttgactttcatattttcttataacttttatttcagcttcaagggtacatrtgcaagtttgttatatggtatagtgcatgtcacaggggtttggtgtacagattatttcaccactcaggaaataagcataatacccaatagttagttttttgatcctcaccctcctcctaccctccaccctcaagtaggtgctgttgtctattgccttcttctttgctttcatatgtactcattgtttagctcccattaataagtgagaacatgcagtatttggctttctcttcctgcattagtttgcctaggataatggcctccagctccatccattggggtgttctacaaaggacatga

SEQ ID NO: 168200 - DNA, 601 bp, Human
cagatggttgtaagtgtgaggctttatttctgggtgctctaacctgttccattggtttatatgtctgttttagtaccaataccatgctgtttgggttgctatagccttttagtattgtttgaagtcaggtaatgtgatacctccagctttgttctttttgcttaggattgctttggctattcaggcacttttttttgtttcatatgatttttagagttttttttctaattctgtgaagaatgtcattgatagtttgatagaaatagcactgaatctgtaaattgctttgggcaatatggcmattttaacaatattgattcttcctattcatgagcacggaatgctattcctttctttgtgttgtttttggtttctttcaacagtgttgtacaactctccttgtagaaatctttgacctccctagttagctgtactcctaggtattttggtttgtgaatggctattgtgaatgggattgtgttcttgatttggcactcagctttgatgttgttggtgtacagaaatgctacttatttttgtacattgactttgtatcttgaaactttgctgaagttgttcattagatctaggagtttttagg

SEQ ID NO: 168201 - DNA, 601 bp, Human
gtggatgatatcctcaaatatgatttctaagttgctcattttctctctgtttcaggaatgccagcgagtcatagatgtggtctctttacataatcccatatttctcagaggttttgttcattatttttattatttttcctgtaattttatctgactgagttaattaggaaaaccagtctttgagctttgagattctcttcacagattggtctattctgctgttaatactttcaactatattatgaaattcttgcagcgagtttttcagctctatcagatcagtttggttctttcttaaaayggctgttttatcttttggatcctgtattgttttgttgtattccttagagtttttggattcagtttctactttcttttgaatctcaatgatcttcattcctatccatattctgaattctacgcctgttatttcagctatttcagcctggttaagaaccatttctggaaaactacttcagtcgttttgaggtaagagggcactggttttttgagttatcagagtttgtgcactcgttctttctcatctgtgtgagctgatgatcatttagtctttgatgttgctgatggggtttttgctttt

SEQ ID NO: 168202 - DNA, 601 bp, Human
ttaggaaaaccagtctttgagctttgagattctcttcacagattggtctattctgctgttaatactttcaactatattatgaaattcttgcagcgagtttttcagctctatcagatcagtttggttctttcttaaaatggctgttttatcttttggatcctgtattgttttgttgtattccttagagtttttggattcagtttctactttcttttgaatctcaatgatcttcattcctatccatattctgaattctacgcctgttatttcagctatttcagcctggttaagaaccatttcyggaaaactacttcagtcgttttgaggtaagagggcactggttttttgagttatcagagtttgtgcactcgttctttctcatctgtgtgagctgatgatcatttagtctttgatgttgctgatggggtttttgcttttatcttctttgatactctttgaggtttgattgtggtataaggttggttcaattgactggcttcaattctgaaagatttcagggggccaaggctcagttcagcactcttgggctacatgctctaactctgaggaactggtacagggcccttggctttgttatctg

SEQ ID NO: 168203 - DNA, 601 bp, Human
cagtttagaagtgtgggggatggagcgggcatggaggagagccaggggattttttcattcccagtcttgcacaggaccccacggggctctcactcacttgccttttcccattttggagaggttcttctggcctctgcactcagcccagacaggctggtgcccagcttcactcctctctgctctctatgtctccctgctgccttgatggatcccaatgtggttttttaggtgatcagcttgtagggtcagtgttcactagtcagtgaaaatgacacacgtgaactgcttctagtctgccatrctgacccaaactccccaacttccacatttttatagactgaaaggcttctcatcatttcatctttctgattatttacattttctagccagttgcataggtgaatataatattcctgctgaaaatagcttgagagttaagatcagtggccgggcacggtggctcacacctgtaatctcagcactttggaaggccgaggtgggtggatcacgagggtcaggagctcgagaccagcctggccaacatggtgaaaccctgtctctactaaatacaaaaattagttgggcgtggtggcggatgcct

SEQ ID NO: 168204 - DNA, 601 bp, Human
ttcatctttctgattatttacattttctagccagttgcataggtgaatataatattcctgctgaaaatagcttgagagttaagatcagtggccgggcacggtggctcacacctgtaatctcagcactttggaaggccgaggtgggtggatcacgagggtcaggagctcgagaccagcctggccaacatggtgaaaccctgtctctactaaatacaaaaattagttgggcgtggtggcggatgcctgtaatcccagctactcaggaagctgaagcaggagaatcgtttgaacctgagaggcrggggttgcagtgagccaagactgcaccattgcactccagcctggccaacagagccagactctgaaaaaaaaaaaaaaaatcagtgtgggtccaaatctcaagtctgcccctttccatttaagtaaccctaggcaagtgtttaacccacttcaccatcagtttccatatctttaaaataagaatcacacttacttcatagcatgaaagtgagaatgacactctatgtcaaatgcctaatacaagttggccctcaatatttacactattttttttactgtgaacataacatgtactgggaga

SEQ ID NO: 168205 - DNA, 601 bp, Human
atctcccatctatataagttgtgaagccagaacaatttacttatgcatgtgaatccatctcatctttaaaataggaatgataataatacctacctcatggagtttgaaaaggtctaaatgagttttgtgatgtgaacagggtcaggtgatgcatgcacatgcaatgtgtggcattatagaagaagaaccctaaagttcgagaacccatatcttttatggcataaattggatactcacatattagtttccttatctctcctaaaaaatacactatatttttatgcaaggtttttgcacttatgaattcattatgctcaggacatagctcacaattatgtgcatataaaactcagtttattttttaaatgatgcatacaatgcaagtgattgtgtgtgtgtgcgagagagagatctgttgatacaaaagtacattgcagtataaaaaatgtacttagttttacatacataaatttacttctttcttaatgaaaatatgtgtgacaagatccttcatatgtaacaggagggatttcttacactgtagtaatttgctgcttttaaacagacttagcagcatccagaggcaaaggctgttatggtc

SEQ ID NO: 168206 - DNA, 601 bp, Human
aagcacacacacaaattcctatcacaaagtctctctggtacgtcacaaaacacagcctttgggggtgattatttttcccgagtatttttacatcctcgtgccaatgcttcagatagtaccctaaattaactgtatcttttgctgtccgtggatacttacaagtttccttttgccacttgtcaagagcagtgaagagtcttgagatttcacttgcaaactaacaagtcaccctgacatagtttcatggttgctggcagaaggtgcaacactcttagatcaaagagaaaaggactttattackcacagcattagcgttagccagagtagcagcatgtactccaagttctaattcctacagggtgatgtgaagagtgccagatgatacctgcacatacagtgggttgcattataggagatgaactctaagcttagggaaaccaaatattttataatggacagtaagcctgagtgacctttgccacagaagtaaatattgtctttttatgctgcaaaataaacaaaattgttctttactacaaagaaagacactatctctatcttccaaggctgtttttacagatgtcctcaaaacaacagtaca

SEQ ID NO: 168207 - DNA, 601 bp, Human
aacttgtgttttacttttagagatagactcttactattacactaacacaaacaaataaaggttaaaaacatgcctttttaacttagttccataggaattttgtttcttaccaactctgcacgaaagccaattaaacattatttaaaaacaactggaatgggccaagcgcggtggctcacgcctgtaatcccagcactttgggaggccgaggtgggtggatcatgaggtcacgagatcgagaccatcctggctaacatggtgaaaccccgtctctactaaaaatacaaaaacaaaattagcygggcatggtggcaggcacctgtagtcccaggtactccggaggctgaggcagggaattgcttgaacccaggaggcagaggttgcagtgagctgagatcacgctattgcactccagcctgggcgacagagcgagactccgtaaaaacaacaacaacaacaacaacaactggaatgaaaaccaatatagggaaataatcttaacattagaatcaagtatgcggaattaagttttgtatctcctaaaatctttattgacagtagcagaccatatcaaaagtcttctgaaatgcttctagcgctc

SEQ ID NO: 168208 - DNA, 601 bp, Human
ccacaaagggttagagtgccaatagaaaaagaccacctgccacttaccacaaatgaataaaacaaatatatatccatagtccatggggcaaccatagcaaaggaccatctgatcctcacgacattgtcttaaagcattccttacatccccattaggaataagaagccgttaaaaccacctatacctacacctatataactagcacattcctgctgacagagcttggaaggcattgagcagttctgcatttgatcctacttttttcacaaagaggtgaatatcaaatattttaaacagcaarctaaagtttcagagcaaatataatttaaaatttggttctgctttgggaaatctgtttaggaggcatttgtaaacagttgaaaggctcattctaaactggaatggattgccccatcctatcaatgcccctgagatgaatatgaagtcagcaatgggagttttttaattctatgataattggctgggagttctttgacctttaattaaacaaaatatgaattaatgaactttctttctatttacagcagaggcttgaaatggtacaagttgggataacaatcaaaacaagatgctatttttt

SEQ ID NO: 168209 - DNA, 601 bp, Human
cagacaaaaattctagagcctttataacatagaagagttttatgaaagggtctgattggatgagatgtaaagagataaaatatgtacatagttacaattatattttacaaattaaacaaaaaactttttttcttgttttgcttttttggttttatgccttaactggtgaacatttaaaaatatgctgttagatgagatcgtgccactgccctccagcctaggtgacagagagagactccatctcaaaaaaaaaacaaaaatgctgttagaatatggacacaaagaagagagcagtagatayagataccagatatagatacttgagggtgaagagtgggagtagcgtgaggatgaaaaactacctattgggtaccatgctcattacctggatgatgaaataatttgtaccccatagccccacagcacacaatttacccatgtacaaacctacacatgtatcccctggacctaaaataaaagttggaaaaaaaaatttagggatcattagcagatcattgcaaaatctgctaggattttgcagataaaccataagatccctcgaaaatatttttctttgtagaaaccatgtgagtctatacag

SEQ ID NO: 168210 - DNA, 601 bp, Human
tggattcctaaaattgcttgactcatctataattcattcaagaatggcatttgacttctaagatagccatttttcagaaaatttattttagattatattaattttttatacatatgtttatcgcttcacagaataaaaaaggcttttcccagatattatctccttttctcctcaaaacatgctgtcactggatcatgggtctaatttgatttgattatcccagcaactgacacaagacatgatgcatagtaagcactcaataaatgtatatggaattaattagttgatgtattaattctgyggcacaatttctaatttttcacctttaccatgttcattattattgaacatcagtgatgggactataattcagtgaagcttcagaagctataaagatttatctagccatttgcctgtaccctaacttatatatgtatctaatttttgtgctgatttacactttttctgcctaactcttccattaagttctttaacatctttcttcgcaatcagtttatgtatattcctaacttatcgtatctaatctgctatattcttggaaaccagatcacaggcctgttagacctatatgtatgtaaaa

SEQ ID NO: 168211 - DNA, 601 bp, Human
attaattctgcggcacaatttctaatttttcacctttaccatgttcattattattgaacatcagtgatgggactataattcagtgaagcttcagaagctataaagatttatctagccatttgcctgtaccctaacttatatatgtatctaatttttgtgctgatttacactttttctgcctaactcttccattaagttctttaacatctttcttcgcaatcagtttatgtatattcctaacttatcgtatctaatctgctatattcttggaaaccagatcacaggcctgttagacctataygtatgtaaaataaagtgacttttaagtgagagcatgaaaccctttcttaaagaataaatttgccttagttcatttgtactgctacaacaaaatgccacagactgggtaatttataaataatagaaatttagttctgggagctggaaattccaaggtcaaggcaccagcaggttcagtgtctagtaagggttaagtgtctctgcttccaaaatggaaccttgttgctgcatcctccagaggggacaaacactgtattttcacatggcagaagggatgggaagaagcaagcccacttcctca

SEQ ID NO: 168212 - DNA, 601 bp, Human
gcatgaaaccctttcttaaagaataaatttgccttagttcatttgtactgctacaacaaaatgccacagactgggtaatttataaataatagaaatttagttctgggagctggaaattccaaggtcaaggcaccagcaggttcagtgtctagtaagggttaagtgtctctgcttccaaaatggaaccttgttgctgcatcctccagaggggacaaacactgtattttcacatggcagaagggatgggaagaagcaagcccacttcctcaagcctttttataaggtcattgatcccaatcaygagagctccactgtcatgatttaatcacctcctgaaggcctcacttcttaatactaccacactggcaattaagtttcaacatatgtattgtggggaacacattcagaccatagcaaaattcactaactttactacttgcttcctaacagctgttctgatctcataggcattttgcttattttcgcatctgcaatgtaattctagtggattaaagttgttaggcacagtatacaattgtgcctttcccccaacttgcatccaaagaaaattataacgcatttcatcccatcaaacttataa

SEQ ID NO: 168213 - DNA, 601 bp, Human
aaccttgttgctgcatcctccagaggggacaaacactgtattttcacatggcagaagggatgggaagaagcaagcccacttcctcaagcctttttataaggtcattgatcccaatcacgagagctccactgtcatgatttaatcacctcctgaaggcctcacttcttaatactaccacactggcaattaagtttcaacatatgtattgtggggaacacattcagaccatagcaaaattcactaactttactacttgcttcctaacagctgttctgatctcataggcattttgcttattttygcatctgcaatgtaattctagtggattaaagttgttaggcacagtatacaattgtgcctttcccccaacttgcatccaaagaaaattataacgcatttcatcccatcaaacttataatctatggtataatctaaagccacattaagaggttattcatcacaccaaactgatctcatttaccagaagtagccacagcttacaggtttgtctgagcccttctttttcctcactgaagcaagggttcccaaccaatattgattatctacccacttggtgcaacatgattgtaaatgtgcccct

SEQ ID NO: 168214 - DNA, 601 bp, Human
ggttacctttattctgttagctaaatgaatagctctaagggtaagagctaaatagatggctataaataaaggtacaccaatagtaatagcgataaattctatgaaaaaataaagcagagaatccaggtatagcgtgataggctgagcatttatttaaaagagggtggtcacaaaaaatatataagcatgtgaagtgatggacatgttaattagcttaatttcaccatttcacaagtacatttattaaaacatcaccttgtacactataaatacatgcaatttttatttgtcaattataccktaacagagctgggtgaaattttaaaaaaaagaaaaaagagtggtcaaggaaagcctcaccaaagaggttatgtgtaagtggagacctgaaagagtaaggaagtaaaccacatgagtatttggggagagcatatccttaagaggaaacagaaagactaaaaccttgaggtgtgaacaaacttgatatgttctaggagtagcataaaggcaagtatgtctagagcatagtgagtaggaaaggaaatgatacaatataaggcctaaggcaaggaccaagtaatgtaaggatttttgaacatca

SEQ ID NO: 168215 - DNA, 601 bp, Human
agtcaaaacagtttatgaaaataaaatagtaaataagtgttctacaatggccattttcaaatctttatgagtttattgccttactagatcaatcaaaattcattcatgttcccattcaataaatacttactttcccttctgttcttgacatcacgctgggttttgggaatgcagcagtgaataggatagacattgctcatggagtttacagtccagctttaatctcacattttgtttttaacacataacacaaacctttttttggaagggggtgggttgctgaacatttaattactgtggtttttttttaagtatttagcattttcatgtcttgagcagaacagatgcgctacttaaggagtttcatacctctgcaactaaaaggaaatctatttgttctgcaataacagtaagtggattgagacacctcagtcccctcatgtgaaatcttacagctctgcttccttttctgctttcctgttaaaagcaagtattttaaattaaggtattaaaattatgtttatagtaatatataaacatcccttttctgcacaattgaatgaatgagatttaactaatagtttcctagagatactatata

SEQ ID NO: 168216 - DNA, 601 bp, Human
gactaatcatgtcaaccataagctaaatagcatatgcataacaatttcaagtgaatacttcgtgatggtagcacttacttaatagttttctcttttccccactaacctgtcattatttgccaatttcagctcaagaactcctctgggaaaatcattcttcaccgctgtaatttagaggttatatataatgtatgctcaagaccagttaaagtatgtaacagaagtaactcaagattgctctataactcttttctctgctttcacacaaacctttgtccttactctgttattacaatagaamcaataaaatacataagcattcaggtgaagaatgaaaattcactaatgtcatttagaaaaaataccaagaagggtttatatgaaggatataaagccctgtgaagttactataatacagctacttggattatcttcctgtttagtgctgattaactccaaaagtgttacggctcaatttaaaaatatagtttaaaattttaggcatatgcctgatgttttcatgtgagtaacagaaagtaatggaacatggaattttctgacaggacaataaggaccttttaaagttggcagaattacaaag

SEQ ID NO: 168217 - DNA, 601 bp, Human
actcttttctctgctttcacacaaacctttgtccttactctgttattacaatagaaacaataaaatacataagcattcaggtgaagaatgaaaattcactaatgtcatttagaaaaaataccaagaagggtttatatgaaggatataaagccctgtgaagttactataatacagctacttggattatcttcctgtttagtgctgattaactccaaaagtgttacggctcaatttaaaaatatagtttaaaattttaggcatatgcctgatgttttcatgtgagtaacagaaagtaatggarcatggaattttctgacaggacaataaggaccttttaaagttggcagaattacaaaggatttcattcacaaagctaaaactcaacttctgtgtattaggaaaggatttaagaccatatatccatttctcatttgatcttcatacaaaacctgggagttacatattgttattcttgttttccaagggggaactgtgatttggaaaggttcagtaacttgtccaagcctcgtattattactgcatagtaatcaagtagcagagccagagtcctaagtcactcggatttcaatctgctgctgtt

SEQ ID NO: 168218 - DNA, 601 bp, Human
atgaaaattcactaatgtcatttagaaaaaataccaagaagggtttatatgaaggatataaagccctgtgaagttactataatacagctacttggattatcttcctgtttagtgctgattaactccaaaagtgttacggctcaatttaaaaatatagtttaaaattttaggcatatgcctgatgttttcatgtgagtaacagaaagtaatggaacatggaattttctgacaggacaataaggaccttttaaagttggcagaattacaaaggatttcattcacaaagctaaaactcaacttctgtgtattaggaaaggatttaagaccatatatccatttctcatttgatcttcatacaaaacctgggagttacatattgttattcttgttttccaagggggaactgtgatttggaaaggttcagtaacttgtccaagcctcgtattattactgcatagtaatcaagtagcagagccagagtcctaagtcactcggatttcaatctgctgctgttctgccatggtcatgtatgttggtgaggccaagcacaagaactgcgcattcagcagatggtggccttggcctaaggcaatttaacaag

SEQ ID NO: 168219 - DNA, 601 bp, Human
aagctcatagaaaacacagtccagcctttggtctttaagactattttaatctggcaggacaaatacagtttctacatttttatatgtagacttcacatttagaatatgggcaactgagagctgagtgattgttttgccattaggagtgttaattaagttagataatgcagtgctatgtctatagatttcttgtcaagggagtttaaatactgttgcaaaaactgactgggtattatgcttcccactagcttacctatctttcctgcattctttcttatttccctgctgaatgtcaattgtrtaggtaggtcaaatagtaaagttgatcctggccttattatttattttcctctaagggtatctttcctctaattgttcctgaggccctactctaatattaacctaattaactgttttcagcatatttcaatgtttttcttgtctaagcacaagtcttgtatagtctttccagttctaaacctggtcagagagagactaaggtggtcattggagcacttcatggtgctccagtgtcctgcagtccaactctgcagattgtacagtgagtaagtgttctttaatctggatgccagtgggtaaa

SEQ ID NO: 168220 - DNA, 601 bp, Human
tctgaaatgggaataataatctctagtatactaagtatatctgatgcctggaggaggtatgagtgcgtgtacacgcgtgtgtgtagatagacacataggcataggagcttatcatttgctgcttaattgatttcatttactctagcaaatatagacatttatatttctaaatagtatatgattgactataaaatattaactctaaaagtactgtgctcaaacaaaaatatttttatctgctaaaataggccaaaatataatctaagaagcataaataagaaacaaaaaaattatcaagacrttccaccaagaatgccacacgtgtcatcaatactaacataaatcttcatgtaaaacttctttgcaattacttttaatttcaatttctgcctcttcatctatttgatttattctgctaacaaaagttagagaaaattcaaaggctatcattttgctcagttctcagaactcagattctttaaattagttcttttttgtcttcaactagatattttaatgcctgcaaactttcttagctttacagaatgaagacttgaaaaaaaaaaaaaaactaagttagtggggtagcatacagattaaa

SEQ ID NO: 168221 - DNA, 601 bp, Human
atgagtagactacttcagtttaaaatagaataatgctgaataaaatcattctagtaatgaagggtttagtgaaaaggatatgacctaagaatattgctgggtacttaagctttttacaagggttaggccagtaacaaatatatttttaaaaggtgggaataatggatgaatgtataataatgttctcataaacatctgcaaaatctggtttacaaaaacaacataaaagatgacaaatatcactgtttatcttaagtatataaaatatcatctagaaataattttcccctctttaccatayataggcataattagtatctgccatctgtttcaatgtatcttttatgtgtttagtgtttatttctagaatatcaaataaataggtaaaatggaaattcaaatctgcaaattcagggctaatttagtaacttaaatcattgtattctagttgactaagaggttagttcgcaggaactttatttagcttctaaggcctaagaagaagacaggtttcttatatatagtttttcttatcaagttttgtaaatgtacattaaaaatgcaatcaaggatcacaaagcaaagttcgaattccaattaa

SEQ ID NO: 168222 - DNA, 601 bp, Human
gcacatattacatggttcagctgtgcacaccaaaaagcttgcttatgttaagagagtagtgataccaaaagaattagatagctaaatttcaaaaacttaccattggctagatgagtctaaatttgaacccagaagttctctacctctgcttttaaaatcaggaagaatctcttgcattcagataaagcatacaatcatggggtagtcaatgaataaaaaactctatctgcttatgatccaaaaaagttgggaccataaacatgatgaggcagaccttccagatgtcagctttataattaasaaaataagatttagttgtgggcccaactgtattaaggaaagggagaaagaagataaggtgtgatagagtagaaggaatgcctaatttggatctatatccgtaagctaggataccactaatttcatctatgaaagatcatttacaaatctaacagcattactttctgcctagttgaagtgaacactcaactaccgtgtgtgtgtatgtgtatgtgagagagagacagagacagagaaggagacagagagagggaatataagaatcagacttaaagattgagaaagaaaaaagaagaaagaa

SEQ ID NO: 168223 - DNA, 601 bp, Human
acactgtcctacattccctatgttcctccccagcattttatcattcaattctatttaacatgctattttttaatttttgtaaaatattaatggtttgaaagtttatggaactatctgatggcctttcatttttattgaattataatttacatatatagaagtacataaatagtaaatgtgatattcagtgaattttcaacgtgtacacagctgtgtaaagaacaggcagatcaagaaagagaacacttccaaaatctccacttcttgtgcccctcacaataactaacttctctcaaagaaragtagtatcctgacttctaatatcatgaattagttttgcttggctttgagtggtatgtaaaaggaatcatatagtaaagattcatctgtatccagctcattttgtacaatgttatttttgtttcagagatattactgtctataggttataattctttccttttctttgctgtacagtattccattgtctgaacatacaaaatttacttgtctattccattcagctgtagatggttgggtgtttccagactttgagtttttctgaatagaaatgttcataacttcctgttacgaacatttt

SEQ ID NO: 168224 - DNA, 601 bp, Human
tacattccctatgttcctccccagcattttatcattcaattctatttaacatgctattttttaatttttgtaaaatattaatggtttgaaagtttatggaactatctgatggcctttcatttttattgaattataatttacatatatagaagtacataaatagtaaatgtgatattcagtgaattttcaacgtgtacacagctgtgtaaagaacaggcagatcaagaaagagaacacttccaaaatctccacttcttgtgcccctcacaataactaacttctctcaaagaaaagtagtatyctgacttctaatatcatgaattagttttgcttggctttgagtggtatgtaaaaggaatcatatagtaaagattcatctgtatccagctcattttgtacaatgttatttttgtttcagagatattactgtctataggttataattctttccttttctttgctgtacagtattccattgtctgaacatacaaaatttacttgtctattccattcagctgtagatggttgggtgtttccagactttgagtttttctgaatagaaatgttcataacttcctgttacgaacatttttatacctgt

SEQ ID NO: 168225 - DNA, 601 bp, Human
tgggactacaggtgcccgccaccatgcctggcaaaattttttttgtatttttagtagagatgggatttcaccatcccatctgaactgagataaatatgtcagaaggcagatatcatttgtctaactcttgcatgattcaaatatatgaatattttagtcacagatttcaccatgatattcaggaaaggacaacaaatgcctgagctatctttttagccaggatggtcttgatctcctgacctcttgatctgcccgcctcagcctcccaaagtgctgggattacaggcatgagccaccatgyccggcccataatttttaaagtaataagcaacagacatttgttttcaatgtaattctaatgtaaaacattctcaaagtaggattaaaagaaatcagataagacaaatctataaagagaagacataaaattgtgcctaatatgaactgagataaatatgtcagaaggcagatatcatttgtctaactcttgcatgattcaaatatatgaatattttagtcacagatttcaccatgatattcaggaaaggacaacaaatgcctgagctatcttttcaaagaaccctgagatctgctgctctgt

SEQ ID NO: 168226 - DNA, 601 bp, Human
ttatgtatacactacctccccccaaaaataaaataggtactgctgtccatctctttacctacatgaatacagacattaaagaggtcatgtgacttggccacacaactcaaatatgttggaacctaaaaataaactaaaaccttctgactccaaaggctacacttgttctactatacaatggtaacataagtgtatatgaagaagaaaaaaataaagaaaataaaacattagatttaaatatgtaatctttgtacgtagtggagaggaagttccttcatatcagtagagtacttaagcatgygaaagtgaaactgaagactgcccttgttgaatgattatgctattccactcactctatagcacttaatctttgtttcttctgtatacatttgaatgaccatgaaatctcatagtatgcctttatctctagtaaaggttttcaatgcccaccaaatcacaggacctgattcttttcctgccaataggctctgcctcccttctttgggaaactgaatgaacaatgttaacaggaactgggtttagttgactggtccagggtagcagtccattctccatctttagcctgtagggctctaataaa

SEQ ID NO: 168227 - DNA, 601 bp, Human
cctacatgaatacagacattaaagaggtcatgtgacttggccacacaactcaaatatgttggaacctaaaaataaactaaaaccttctgactccaaaggctacacttgttctactatacaatggtaacataagtgtatatgaagaagaaaaaaataaagaaaataaaacattagatttaaatatgtaatctttgtacgtagtggagaggaagttccttcatatcagtagagtacttaagcatgtgaaagtgaaactgaagactgcccttgttgaatgattatgctattccactcactctayagcacttaatctttgtttcttctgtatacatttgaatgaccatgaaatctcatagtatgcctttatctctagtaaaggttttcaatgcccaccaaatcacaggacctgattcttttcctgccaataggctctgcctcccttctttgggaaactgaatgaacaatgttaacaggaactgggtttagttgactggtccagggtagcagtccattctccatctttagcctgtagggctctaataaaacaaatcacatcagagctgccattgaaaatatgggaggagatttttctccacacaaa

SEQ ID NO: 168228 - DNA, 601 bp, Human
ttatacgtaaaacagaataaatgatggcttctaaatacatatacgagaaaagattaaatagataagtagattgattgatcatagatcagtgtaactggaattaattggataatatttcccccccctaaaggaactgaagaggaagatgaaggagatgactgtctgttggggtctgtggatgagttctggtggtttcctcacatgtggagccatatgcagccccacctcttccacaatgagtcatctttggtggagcagatgattctcaacaaaaaatttgccttagtaagtaactcacttygttgcattgaagtagtgtacactgattggagaaatgaaaagattcttacattgtggcatagttgcgcttttcagtggcttttccatatgatcatttggaatattttggtattgccgcctttcagtatgtggctcttgagtttgtattgagtgctcaccactatgcttaatgttttgaaggatctaatttgagagggacctcacaaaatacaagatttattatgacattatggtcagagcacctaagacatggctcctgtccagaaggagtttcctgctgcactgagaaggcagaaatatg

SEQ ID NO: 168229 - DNA, 601 bp, Human
tcactgggagtagcccaagatggattcttctggaaataagattttagatacgtcctgaaataagaataaatcttcgggatcaggattaattgaaatgaaatgaggctgagggaaaatagcaggtaggagaccataatgactgtatgaggtaataaagactcaatctaaacagttaaaagcattgcaaacatatatgctgtatggatggaacatttgtttggctgaagcaaggtacaccatgtaatactgaagggtttatattcaggacagggaaatttatagtaaaagtttaaataagcayattatgaagaaaaatgtgcttgtgatcagagagagtaccgaggtacacttacatggaatggttttctacaccaactgttagaactaagaagtttcagttggttctcacagtaccttactcaaatatatacaagacaaggttagaatgtatacactatattttttttcttgaggatatacaagaccaaatactttatggtggcatcaggggcccatatttgtcttttagcttcaatctactcccccaaataaacaaacagcttcaggtgcacctttgccacatattgatattttgtcaaga

SEQ ID NO: 168230 - DNA, 601 bp, Human
tgatattgacaatgttaatcactaataaattatgtggggaaaaaattactttgtggtttacttctaaatctgttgagaaaaagagaaagggatttgtgagagacgaaaatacgtaaatacactaaagtaaagcaccagtaaaagataagatactgagaagtgaggagtgaaattgttgttgttgttgttgctgttttgacagctttccaaaaataatgtaccaaagcagctttgataaaagacatgtcattcactgttacatctgctgaaaactagaatagtatctagaaattacttgaaygaatcaatgaatgccaatattatgtttatgtttaaaacatttgcagatatttggaagtacatatcctaagaatatacttaggctgggtgcagtggctcatgcctgtaatcccagcactttgggaggccgaggtgggcggatcacgaggtcaggagatcgagaccatcctggctaacatggtgaaaccctgtctctactaaaaaatacaaacaattagccaggtgtggtggcgggcgcctgtagtcccagctactcaggaagctgaggcaggagaatggtatgaacccaggaggtggagct

SEQ ID NO: 168231 - DNA, 601 bp, Human
gcaaagcagatttcttagaagcgtcattcctaactacatgttggcaattcaaattattgtttttgaagcagaagagagtagttgtaatagatcttcagaaataagaccaaatatattatttagtgtttaatcaaatccaggacaagtagaatttattttgttgcaagaggatagatatgaaaaaagactgaatccagaaccagtccctccccagccataacaatatgaaagagcacatataaataaggcatttgggaacagcaattagcatataacactcaatagatggcagctgctgttwttatcattatatctagtatcacaaaattgccatctttaatttttgcccaggctcctgaggtgtttggactgacaggtaagagggacaaaaatccttaagtttaaaagtttactttgtattgggatggcatttgtttaatgtgaattttacccaatttctaaatatgtgttaactcttttactttccattaagcattagggttacaaaactgcattgttgctgactttaaagatataataagaaaagatcaagggtttccaattttaacatatttttattatttcttttaattctcaaatt

SEQ ID NO: 168232 - DNA, 601 bp, Human
ttcattgagttttaacaaatacatcttatctattatccttttgcacaatgtggacacatctgactcacaaacaaatttgatgtctattttaatttgtctttgaaagctctaacagtttattatgaaaggtcaagtaaatcctttaagcaaacttgcatttgatgattacacccatcaggaaatgcagctttagaggttgaatggaaaaaatttttagttaccaaatataggataattcaggggttaaactgcaatttcaacaggggatttttttttggaaaggtacaaattctgagacaargattaaatgtatcattaataatgacctaccacaaaatttaaaatatcaactgtacagtgtgtaaaatagaataacatatcattagaaaggtaaaatagtattctatttaaacctcaaaaaagtcttcaatagtatatactctcaattgaagaactgtatctaaattttggaaaatggtggtggttaaatttttaatgataaaatagttaatagatatttctatcatagaactctgccaatatcagatgatacttaatgcttttatagacaatactattaaaagtagtagtagtagaacaa

SEQ ID NO: 168233 - DNA, 601 bp, Human
tggtcagtggcatggcatgctggttggtagatatttttcgttatcattccagaagataatcagtcagtcttaagatttagaagagactagaatcagtatatttataaggaaaagtatggaagtcatatagatttaagaagtagagttcttccaatctagataagttatgtatagagaatggtgcttgacatctagtaggtagtaaatgtttgctaaataaaaataaaagtaaacgtttcttctagctcttaagattctatcattactgtattaaaatgtaggttttattattatacaggtrtgatgagtccagtagatcaggagatgactgccattgaaaagatcagtttgttattcccagttaccaagagagggagtgtgccacaaggatgcagggccacaggggaagcaccagggtcgctcaggaggcagagggagcaggggggaaaggtgggcaagagcctttactgtggtttctgcgggaaaggtaaggcaagacagggtaagcaggctcaggattggcgactttgaataatttcagtatgctctgaggtgtaagagctgtctttagtcatctaatacttggatctggggtgattag

SEQ ID NO: 168234 - DNA, 601 bp, Human
ttatcattccagaagataatcagtcagtcttaagatttagaagagactagaatcagtatatttataaggaaaagtatggaagtcatatagatttaagaagtagagttcttccaatctagataagttatgtatagagaatggtgcttgacatctagtaggtagtaaatgtttgctaaataaaaataaaagtaaacgtttcttctagctcttaagattctatcattactgtattaaaatgtaggttttattattatacaggtatgatgagtccagtagatcaggagatgactgccattgaaargatcagtttgttattcccagttaccaagagagggagtgtgccacaaggatgcagggccacaggggaagcaccagggtcgctcaggaggcagagggagcaggggggaaaggtgggcaagagcctttactgtggtttctgcgggaaaggtaaggcaagacagggtaagcaggctcaggattggcgactttgaataatttcagtatgctctgaggtgtaagagctgtctttagtcatctaatacttggatctggggtgattagatcaaagagatagttgctcaacatatgagagtctgataaa

SEQ ID NO: 168235 - DNA, 601 bp, Human
gaagtcatatagatttaagaagtagagttcttccaatctagataagttatgtatagagaatggtgcttgacatctagtaggtagtaaatgtttgctaaataaaaataaaagtaaacgtttcttctagctcttaagattctatcattactgtattaaaatgtaggttttattattatacaggtatgatgagtccagtagatcaggagatgactgccattgaaaagatcagtttgttattcccagttaccaagagagggagtgtgccacaaggatgcagggccacaggggaagcaccagggtygctcaggaggcagagggagcaggggggaaaggtgggcaagagcctttactgtggtttctgcgggaaaggtaaggcaagacagggtaagcaggctcaggattggcgactttgaataatttcagtatgctctgaggtgtaagagctgtctttagtcatctaatacttggatctggggtgattagatcaaagagatagttgctcaacatatgagagtctgataaaggaagcagaggagggtaggagctctgaattgcttgatttacatttgagagtgctctcagggtggtgtttgctatctct

SEQ ID NO: 168236 - DNA, 601 bp, Human
taaataccagagagtatacggtggttataacaaaaatcaatatcaactttttatgctttcagaaatattaaacttcacttaaaattagtactatgtagacttcaagattcctaatcaaccttgcatattttcagggagattaaatgtgtgtgcaagtactctgagaatttgaggctgtcctggattatttatagctttcttacctctcaaagaccccaaaggtccacataaacttcaaactctgagaaagctgaattaaaccaaactttcaattcctccattatgaatccagataattttmttttcagttattttgctacagcataaaaagtaaggcttcatacattcattttttttacatttctataaaccttttcttgtgtttacttgaatacaccccagcaattcaaaaataccaacctgggctgtgcaaagtacaagtgtttacatgattcttttgagtattctcacaaaagcgcatcctttagtgctatgtttacttatgagacactcaacaaagatatgacaacacttcaaaaattctggagggaactctaagacaggaaaacaacatgctcagttaaatgaaaatgtacttgaa

SEQ ID NO: 168237 - DNA, 601 bp, Human
atattataaatcaaggagcaccatgtaagaaaactagagaaatagttagtggtcaaatctataaatattaaccaaatttatgtaactgtgtctatcatattttaggagattattccatccttaagtatgtagaaagaaaattgtatatgggagtttaagtttgttcatggattaaaaatagtacattcgtatttagcatctgaatataaaatcatttctaaaaccacaaagattatgtcaaagaaacacagaattataaacctggactttagtgactacttgtacaacccctttattttayaattttttagaaaatgaaaaatcagattcctgtgcttaaggtaattaattctttcaagatttttcatttcaaaccataccagaaatattatcatttatcacaggaacatagtctaatatttaataatctttgcatgtagtaccaaatctaaattccctaatctaatgatcctgacttgccttattttgttgtaggctaagaagacagtcagcttcctttgaatagcaactttacatatattgggccactctgccaacatccataccatttcttactttcttccagtgattgcggctacta

SEQ ID NO: 168238 - DNA, 601 bp, Human
tccttaagtatgtagaaagaaaattgtatatgggagtttaagtttgttcatggattaaaaatagtacattcgtatttagcatctgaatataaaatcatttctaaaaccacaaagattatgtcaaagaaacacagaattataaacctggactttagtgactacttgtacaacccctttattttataattttttagaaaatgaaaaatcagattcctgtgcttaaggtaattaattctttcaagatttttcatttcaaaccataccagaaatattatcatttatcacaggaacatagtctaayatttaataatctttgcatgtagtaccaaatctaaattccctaatctaatgatcctgacttgccttattttgttgtaggctaagaagacagtcagcttcctttgaatagcaactttacatatattgggccactctgccaacatccataccatttcttactttcttccagtgattgcggctactacaggactccttccgcaggtgccagaggttccacaggttcttataagctgaattgtggtgtagcccatcagtgtcaccttaggaaaacaaatcgtcattagaagcttgaaaatgcttc

SEQ ID NO: 168239 - DNA, 601 bp, Human
atgcttcacaaattcaaataattatataattttgactataatcatcctgttgtgctatcaaatagtacatattattcatgctttctaattatattttgtgctcattaatcatgcccacctcccctgcaacatctactatcctacccagtttctggtagccatccttcgactctctatctccacgtgttcaattgtttcgagttttatataccacaaataagtgagaacatgtgatgtttgtctttctgtgtcttggttatttcacttaacataatgacctccacttccatctatattgttrcaggtaactgaatcccattcttttttatggctgaatagtacaccactgtgtactattatactgtgtgtatgtatgtgtatatatatatatatatacacctcataatatacctcactttctttatctattcatctgttaatatacactggttgcttccaaatcctggctattgtaaacagtgctgcaacgaacatgagagtgcagatatctctttgatacactgatttcctttcttttgggtatatactcagcagtgggattgctggatcatatggtagttctaattttagtttttcgaga

SEQ ID NO: 168240 - DNA, 601 bp, Human
attttttgttgagttcctgtctgggacatctgtccaatgttgaaagtggagtgttgaaatctccagctattattgtactggggtctatctctctctttagctctaataatatttttttatatagctgtgtgctccagagttgggtgcatatatattttaaattgttatatactattacggggttgactcctttatcattatatagtgaccttctttgtctcttctcacagtgtttgttttcaaatctattttgtttgatataaggataactactcctgttcattttttgtttcaattggcrtggaatatcttttcacatccctttattttcagtctatgtgtatctttataagtgaagtgtgtttcttgtgggcaacagatcatagagtcttgtattttcatccatttggccactctgtgtcttttgatcagagagtttagttcacttatatttaatgtgattatttacgtgtagaaacttactcctgccacttcgttatttgttttctggttgttttggggtcgtctctcttttcttttcttccttcctgtcttcctttcagtgaagataattttctcttgtgctttaacttcttgcttg

SEQ ID NO: 168241 - DNA, 601 bp, Human
agtcaccactgctgggaatgtgctgggtcacacatgtagtaagtgcgtcccaagtgcccaaggctcacagcatactccctggctatcactgatggttattcagggtccgagggctctttaatcagcaggtgataaatccttccaagactggatctttctcttcaagacaatgggttcccttttgtcctagagtatgtcaagaaatattctctccaggagctagggcctggaatgggggcctcatgactgcctggtgccctctcctactgtagctgagctggtatccaagatgcaagacaaygtcctctttactctttgctctcctcgccttaaacagaaggaaggacgcactttcattgctgtgagttgcacttcctgggattgggggaggagtggcgcaagcaatcctttagctgctctggctagtgtctccctaggtcacatgccaccctagtccactggctctaatcccaatccagcactaggagttgcctaggaattgaagtccttgtgtgctagactgtctttcaagtttaccaaggaccttagagcatgttggcccatggtggcaagacttgacaagaaactcaagctctaactg

SEQ ID NO: 168242 - DNA, 601 bp, Human
cgagggctctttaatcagcaggtgataaatccttccaagactggatctttctcttcaagacaatgggttcccttttgtcctagagtatgtcaagaaatattctctccaggagctagggcctggaatgggggcctcatgactgcctggtgccctctcctactgtagctgagctggtatccaagatgcaagacaacgtcctctttactctttgctctcctcgccttaaacagaaggaaggacgcactttcattgctgtgagttgcacttcctgggattgggggaggagtggcgcaagcaatcstttagctgctctggctagtgtctccctaggtcacatgccaccctagtccactggctctaatcccaatccagcactaggagttgcctaggaattgaagtccttgtgtgctagactgtctttcaagtttaccaaggaccttagagcatgttggcccatggtggcaagacttgacaagaaactcaagctctaactgatgacatgcataacttccccttggctaagtctggtccaaatgatccctccatgtgtgagcaaagcctgagcagagcatggatttgctctctgctatgacagggtagt

SEQ ID NO: 168243 - DNA, 601 bp, Human
gttcccttttgtcctagagtatgtcaagaaatattctctccaggagctagggcctggaatgggggcctcatgactgcctggtgccctctcctactgtagctgagctggtatccaagatgcaagacaacgtcctctttactctttgctctcctcgccttaaacagaaggaaggacgcactttcattgctgtgagttgcacttcctgggattgggggaggagtggcgcaagcaatcctttagctgctctggctagtgtctccctaggtcacatgccaccctagtccactggctctaatcccartccagcactaggagttgcctaggaattgaagtccttgtgtgctagactgtctttcaagtttaccaaggaccttagagcatgttggcccatggtggcaagacttgacaagaaactcaagctctaactgatgacatgcataacttccccttggctaagtctggtccaaatgatccctccatgtgtgagcaaagcctgagcagagcatggatttgctctctgctatgacagggtagtactgagttcaatgtaaagtccccctgtcactgtgctctccctcccccacataaatagaccctccgc

SEQ ID NO: 168244 - DNA, 601 bp, Human
atgtcttttctatgcaaaaaaatacatgcttacaaactgtgctgtgtactatgaaaaaccaaggaaagctactaagagaagttttaatgtcgacttcatttagattggcacttgtcagtaaagtcttctccaaagatatgacagaataaattaccttcagatttatccaggtgaagatttggagtagaaacatttcaggggaagaaaccacatataggaagatgctgaggtagaaaagtgcttggtgagtttcagggaaagtttcatgtgactaaaattcagtgaaggatggagggtggcrcaagataaggctagacaaagaagcaaggatcatatgcagcgcttgcgatcatgctaagaattttgtaatttaagtggaaagggaaatcagggaaagattttgagtagacagtcacataatcatatttgtatcttttaaatattactttgcagggaatgtattggaaggaagcaagagagggaatgcgattctatgccaaaaggcaatgggataagatggtagattcgactagggtgatgataatgatagaattgaagaaaagtagctaaatttaagatatataccagagatagtactgat

SEQ ID NO: 168245 - DNA, 601 bp, Human
gaaacatttcaggggaagaaaccacatataggaagatgctgaggtagaaaagtgcttggtgagtttcagggaaagtttcatgtgactaaaattcagtgaaggatggagggtggcgcaagataaggctagacaaagaagcaaggatcatatgcagcgcttgcgatcatgctaagaattttgtaatttaagtggaaagggaaatcagggaaagattttgagtagacagtcacataatcatatttgtatcttttaaatattactttgcagggaatgtattggaaggaagcaagagagggaatgmgattctatgccaaaaggcaatgggataagatggtagattcgactagggtgatgataatgatagaattgaagaaaagtagctaaatttaagatatataccagagatagtactgataggacatgacagtggactaaatttagaaaagaggaaagaggaggtgtcaaaactatctatctttcaacacagcaacttgttggttgatggtgtcatttaatgacatggagaaaccctgcagagagagaatatctggtagggctgagatgtggaaatcatgagttcaactattaagactattaattc

SEQ ID NO: 168246 - DNA, 601 bp, Human
aggaagatgctgaggtagaaaagtgcttggtgagtttcagggaaagtttcatgtgactaaaattcagtgaaggatggagggtggcgcaagataaggctagacaaagaagcaaggatcatatgcagcgcttgcgatcatgctaagaattttgtaatttaagtggaaagggaaatcagggaaagattttgagtagacagtcacataatcatatttgtatcttttaaatattactttgcagggaatgtattggaaggaagcaagagagggaatgcgattctatgccaaaaggcaatgggataagatggtagattcgactagggtgatgataatgatagaattgaagaaaagtagctaaatttaagatatataccagagatagtactgataggacatgacagtggactaaatttagaaaagaggaaagaggaggtgtcaaaactatctatctttcaacacagcaacttgttggttgatggtgtcatttaatgacatggagaaaccctgcagagagagaatatctggtagggctgagatgtggaaatcatgagttcaactattaagactattaattccacttgtgatccaaatacttcatttacgt

SEQ ID NO: 168247 - DNA, 601 bp, Human
gtgactaaaattcagtgaaggatggagggtggcgcaagataaggctagacaaagaagcaaggatcatatgcagcgcttgcgatcatgctaagaattttgtaatttaagtggaaagggaaatcagggaaagattttgagtagacagtcacataatcatatttgtatcttttaaatattactttgcagggaatgtattggaaggaagcaagagagggaatgcgattctatgccaaaaggcaatgggataagatggtagattcgactagggtgatgataatgatagaattgaagaaaagtagcwaaatttaagatatataccagagatagtactgataggacatgacagtggactaaatttagaaaagaggaaagaggaggtgtcaaaactatctatctttcaacacagcaacttgttggttgatggtgtcatttaatgacatggagaaaccctgcagagagagaatatctggtagggctgagatgtggaaatcatgagttcaactattaagactattaattccacttgtgatccaaatacttcatttacgttttatagttacatagccagattcctcagtgtttttgaaccatgtcctccact

SEQ ID NO: 168248 - DNA, 601 bp, Human
tatttgtatcttttaaatattactttgcagggaatgtattggaaggaagcaagagagggaatgcgattctatgccaaaaggcaatgggataagatggtagattcgactagggtgatgataatgatagaattgaagaaaagtagctaaatttaagatatataccagagatagtactgataggacatgacagtggactaaatttagaaaagaggaaagaggaggtgtcaaaactatctatctttcaacacagcaacttgttggttgatggtgtcatttaatgacatggagaaaccctgcagaragagaatatctggtagggctgagatgtggaaatcatgagttcaactattaagactattaattccacttgtgatccaaatacttcatttacgttttatagttacatagccagattcctcagtgtttttgaaccatgtcctccactagaaaaatcttaacatagatttcagagttcctagatctaagatgctactttcaatcaaggatcaatgaaaagactaattagaattaacttttaaggtagactttttgccacagattaaaaaataatatgtgcttaatctcaaatcgaacaatccag

SEQ ID NO: 168249 - DNA, 601 bp, Human
aagatggtagattcgactagggtgatgataatgatagaattgaagaaaagtagctaaatttaagatatataccagagatagtactgataggacatgacagtggactaaatttagaaaagaggaaagaggaggtgtcaaaactatctatctttcaacacagcaacttgttggttgatggtgtcatttaatgacatggagaaaccctgcagagagagaatatctggtagggctgagatgtggaaatcatgagttcaactattaagactattaattccacttgtgatccaaatacttcatttaygttttatagttacatagccagattcctcagtgtttttgaaccatgtcctccactagaaaaatcttaacatagatttcagagttcctagatctaagatgctactttcaatcaaggatcaatgaaaagactaattagaattaacttttaaggtagactttttgccacagattaaaaaataatatgtgcttaatctcaaatcgaacaatccagaggagagtaatcagccaaaaatttagcatgatggctaaagcttttaaaacctgatagtctgccttccggatcacactacctgcaatctta

SEQ ID NO: 168250 - DNA, 601 bp, Human
tccaatcagtgtctatatttcatcaataattcctttatatcttttttatttcctttcccactgccaccatcttaatttacttccttgactttcatgtgtgaacctggtgctgcttcctactttatctatttacaggttccatccaccacctcactgcagtctatcccatagacagtgccaaccttttaatctttctaaaatgctgcctttatcctggccttcctaaccttgattagttccagttgcttccatatcccctaatgtgcccttcaggtacctgaaaaccatctggactgtctayctttctatttcctatttccctatggctgaagcacactcactccaaccaaaccccataatagtattgctgttaccatgcctgtgtcattctttccaccttgagagactttctggccactatctacctatttctattccctttattcttcaatatcaaatcccatatcttaaataattgaaaacaaagcaccttagtatatagcaactcaatacctaactcatacctacagggatcttattctcctctgaattcctacaacacatcattttgtattttcatcaggaacataaacaccaatta

SEQ ID NO: 168251 - DNA, 601 bp, Human
ttgaaaacaaagcaccttagtatatagcaactcaatacctaactcatacctacagggatcttattctcctctgaattcctacaacacatcattttgtattttcatcaggaacataaacaccaattacactttaagctgtttgagccctaaccaaagtctctggacccctagttttattgcattttcaactgagtcattttccttcagccaagacctgatggaaaccagcactctctactctaatctctggttgttgaatatgactctctggaaagaaccagtatattagtccattctcacrttgctatgagtaaatacccaagactgggtaatttataaaggaaagaggtttaatggactcatagttcagcatggctggggagacctcaagaaacttacaatcatggcagaaggcaaaggggaagcaaagcaccttcttcacaaagcaacaggaaggagaagtgcagagcaaaccgggaagagccccttataaaatcatcaggtcttgtgagaactcactcgctatcacaagaacagcatgtgggaaactgtccccatgattcagttacctccacctggtctctcccttgacatatgagta

SEQ ID NO: 168252 - DNA, 601 bp, Human
cattctcacattgctatgagtaaatacccaagactgggtaatttataaaggaaagaggtttaatggactcatagttcagcatggctggggagacctcaagaaacttacaatcatggcagaaggcaaaggggaagcaaagcaccttcttcacaaagcaacaggaaggagaagtgcagagcaaaccgggaagagccccttataaaatcatcaggtcttgtgagaactcactcgctatcacaagaacagcatgtgggaaactgtccccatgattcagttacctccacctggtctctcccttgayatatgagtattatggggattacaatttaaaatgagatttgagtgaggacacaaaccctaaccatatcagccagagacctctaaaaaattagactacacatcctatctacttactgtttttaatggaaatgcccattggtagagactcattaatcctgctgtaaaccctctaagtggtctttattggtatctccccagaagtatttgttggcagttgctcctgaatgagccttaggtacaggatattgacttcagtccacattggccaagattcttgttgatcatggctttcataataaac

SEQ ID NO: 168253 - DNA, 601 bp, Human
ctataaaaatttgaaaaaccttatcacgagtgtatataattgaagcagataatatatatatacaaaggatgaagagaagacctcttactaaatgaccttttatcattttgttgttacactttctaaaagtaacaaaccaagtgaataatctctttcttacagtaggaactggcaggcttcacacttagaatctgaggtaattactatagcctgcagtagtcctttcagacgagaacagatactgtgatttgtgtctcaaatattcattctaatttaaaatgtcattccctaagaagcacaytgagttgataactgacttcattttctaatgcatggcagaatttggcagaaaatattttcttaaaattattgcctattaagattacagtatagcacagacaatccaatactttttttaaagtctcatttttacttctttttttttaatctcttaagatgctagaacctactaggcttcataaaagaagtactcactttgatatttaaaacagacaagtagctaaaataacacaacacctattttagttttaaaatatttcttcaactttcttcactattccttccatattaacatcacctt

SEQ ID NO: 168254 - DNA, 601 bp, Human
aataaatagtgaaaaatgatagggctggcaaaaattaccctggcaaagaggctagggattgggcagtcatcagccaagccaatatgaagttctagctctgaaacagtagtaaaaactaaatggaaccacatctagaaatgggaacaaaccaattctacaagtagcagtaacatgaggaactcatggcagaaccagggaagtgctccagcggatcctcctttgcattgcaaagtgatcagaagctttcatggggaataaaatttttcacctgtaaaactctcctatttccacggggaaccatttttttttccatttagacaacagttacctctattattatttttattttactatttaaagttaacgtagaagcaaaatagtagaggaattaggtaagcaaatctagttatattttctacttcatgttagattcgtcttgctaggtcataggctgaagcagagcaggcctatttaatgggctacttttttttttttgagatggagtctcactctgtcacccaggctcgagtgcagtggcgccatctcggctcactgcaagctccgcctcccgggttcacgccattctcctgcctcagcctcc

SEQ ID NO: 168255 - DNA, 601 bp, Human
attgaataaaatttgcaaaacccctctcttgaccttagttttatagtccctgcaaataaaattgcagatagtgttcaccatctacttgtattcaaggagatttattgtgctcaattctgcttgtattcatcactatacctatgttttaactcctagaaaatgagatagaagaaagagtaactcatctttggacaaaacctgctcgtgtattcaaaaatggggatagtttggaggaatgtgatatttggacttttgaaagtttatcaaccttcagatcccaaaaatacaaataagtctggtytgaacatcagaaatataataactcttctaacttacctattttcacaaatggaagtattttgagtctccttatacagctttcttctcttttttctcaattcagccagtacagtaatatacagtcaaaaagagttaaaccaatgcctggttatgaactgaagaagcagttaaaacactcttaaaatgctaacattttcaccaataattttaagcactttaatctatcatctgtaaaattctgatgtttcacatttactttcatcatagagcaacagaagtattaacaaataatcatgaactt

SEQ ID NO: 168256 - DNA, 601 bp, Human
ggaagatccagatgcagtaaggcatgccagtaatttagcagatgacattttttattaggccaggatggaaatgagaaaaccttgatggaatcaaagtatacattagctgcaggaaagtcatgaattttaattatagtggatttgaaagatagccattgtaagtttaagtaataccccaggcctcaattagaagtgccattttctgagaatgccaagtgaggttatcgtttactacaaaaagatagatgtgtattggaaacatggcacttaaatacattcacatacatttgagctgaaaacraaaatataaacaggactttaattaatgagggttttaagtttttcccatatgtcaacataatatcaaggtgctatactaacttaccagtactggggtgagaaagggttacaataaggtgcccctcagagttaaactggaaagatcacagcaaaggtaaaaaaaccgttaaacagaataactctctggcctgaaatgttctaatgttaccaaaatatttgtcatgtaaaagaaagaagtatcaatcaagtgaatttaacaaaatagagaattacaaagacaaatgttagcactgtctgggga

SEQ ID NO: 168257 - DNA, 601 bp, Human
taacttaccagtactggggtgagaaagggttacaataaggtgcccctcagagttaaactggaaagatcacagcaaaggtaaaaaaaccgttaaacagaataactctctggcctgaaatgttctaatgttaccaaaatatttgtcatgtaaaagaaagaagtatcaatcaagtgaatttaacaaaatagagaattacaaagacaaatgttagcactgtctggggaagagaaaactttggtcatctctaaatgagcttttccaatgtcacaggcctggacaactctcacgtaagctggatgcrggggttttgattaatagactttgaagtttagatccatttgggggaggtggacctagcaggctatctgagcctggaaccattgagatttccatttttctaatactacttttcctgattctaaacccaactgatgacttcctcattatggtttactttcccacgtagatcctactataggaaaagaatatgttaatcataggaacttgtactctctgggacaataatttgcaatataattttataagttttattttaattgatcaatacttcccatgtaaccggactacctggaaagagccc

SEQ ID NO: 168258 - DNA, 601 bp, Human
gagcttttgctaatctgattctgccccagaaaaatactgactctctctgcaagtgtactgaatcaggttttggagcctgtcggtcagaaacagacctcagagtgttcgttgattaaggatggtaatgagagttacctcatgatataccatgggagagagccactggaagtaccccagagtcactgctagcaacacacaggcatgagatttctacacaaacatgtaatatacctagatacaaacattcttgatcaatttacaattatacagagtactcatatatattttcaaaaattgtgakattctatttactttagatacttatataaaataaaatgcagaagggtactaagaactgaaacttatgaagataacaaaaaggattaattggcaatgactgcatctgccctcaataaataaaactctatatatgacgtatatacttagacaaaaggaactagtacgactatagtgttcattttaacaagtttccagttccacctatcttaggaagatgcagtaatagttaattaatatgctgattggaaaagttccggcttagacaggtttgtacttcttgtgggagccatattatcatctc

SEQ ID NO: 168259 - DNA, 601 bp, Human
gctaacccctttatgcacgcattttattaaatgctttttgtctctctgtttctcaatttgatatagcatacttccaccataccctacataccctcctactcaaatccctaaaagttaaatctaaattgtgtttctcttattataaacatggatgtgaatagagtgaatatcttaaactaggattaacacatagattgattacaactaaaataaataaaacagaattcactcaagaagaaagcctttataaaaagaaattaacccacattgaaattgaaaaaaaatactgtaattttatatstgtatgtgcttttctctaaaattcatctgaaaggaaataatacattgacctaatgggaagttttatgtttctttttttgttcgctagttctggaacacattctaataataggagacccttcgctgaaaaataaataaatgataataactttagacctagaaaagtaattcctggtctaacgtttaagtctttaatccatcttgaattgatttttgtataaggtgtaaggaagggatccagtttcagctttctacatatggctagccagttttcccagcaccatttattaaatagggaatc

SEQ ID NO: 168260 - DNA, 601 bp, Human
tgtgcttttctctaaaattcatctgaaaggaaataatacattgacctaatgggaagttttatgtttctttttttgttcgctagttctggaacacattctaataataggagacccttcgctgaaaaataaataaatgataataactttagacctagaaaagtaattcctggtctaacgtttaagtctttaatccatcttgaattgatttttgtataaggtgtaaggaagggatccagtttcagctttctacatatggctagccagttttcccagcaccatttattaaatagggaatcctttycccattgcttgtttttctcaggtttgtcaaagatcagatagttgtagatatgcagcattatttctgagggctctgttctgttccattgatctatatctgtgttttggtaccagtaccatgctgttttggttactgtagccttgtagtatagtttgaagtcaggcagcgtggttcctccagctttgttcttttggcttaggattgacttggcgatgcgggctcttttttggttccatatgaactttaaagtagttttttccaattctgtgaagaaagtcattggtagcttgatggggatga

SEQ ID NO: 168261 - DNA, 601 bp, Human
attatgtaataaaatacgctatataataaggtacattcaggcatttaaaacatgttgtgtaataagtttggctgggtgtggtggctcatgcctttaataccagcactttgggatgccaaagcgggtggatcacctgagttcaggagttccctgaccagcctggccaacactgtgaaacccagtctatactaaaaatacaaaaattagccgggcgtggtggtgcatgcctgtaatcccagctacttgggaggctgaggcaggagaattgcttgaacccgggaggcggaggttgcagtgagcygaaatcgcaccactgcactccagcctgggcgacagagagagactccatctaaaataataataataataataattttaatgacgtgaaatattcatgatcttctcaatgggaaaagtaaattacaagaaaatgagatatgagtatggaaataaactagaaagaactcagcagattgttagcagtagttatcctagatcacacaattgaagatgatttccattatcttcctctaatttttataaaatatctatagtgaacacctattagtgttataaccagaaacttcatacacatgtacac

SEQ ID NO: 168262 - DNA, 601 bp, Human
gtttcctacctctatctagaatcaatgacacttagtagcaaagagctcagctagtgctcaaattttaatttctaaatactatttctccccaaaagtaagtgggctttttggagaaaaggctaaattcaagtcagatacatggaaagtacaaattgagtctggaacaccttgtaccagaaaaaagggaaacagtcactcaaagactaacaagcttgtattaaacaggacagaaatcagctaaaagtgctcttgatatgagataattttagcatcaaaaaaatggaggttatagacatactcraagtatgaaaaaagaaggagagttcttctgtagagaagacaccagtgccagctgatgaattcaggtagaatgatggaattcaaagatcatcattttgcagacaccaatgaaaacaattgattgaaaaaagaaacatcaatagttgctgaaacttttgggtgaaagattacacagccttaaggtttaattccatagattacttattaattacaaagagaaaaatcattcttcacaatagagaaatctgacagtttcttactgtacccaagtgatcagaattaacatcaccaaaggtggagt

SEQ ID NO: 168263 - DNA, 601 bp, Human
tagcaaagagctcagctagtgctcaaattttaatttctaaatactatttctccccaaaagtaagtgggctttttggagaaaaggctaaattcaagtcagatacatggaaagtacaaattgagtctggaacaccttgtaccagaaaaaagggaaacagtcactcaaagactaacaagcttgtattaaacaggacagaaatcagctaaaagtgctcttgatatgagataattttagcatcaaaaaaatggaggttatagacatactcaaagtatgaaaaaagaaggagagttcttctgtagaraagacaccagtgccagctgatgaattcaggtagaatgatggaattcaaagatcatcattttgcagacaccaatgaaaacaattgattgaaaaaagaaacatcaatagttgctgaaacttttgggtgaaagattacacagccttaaggtttaattccatagattacttattaattacaaagagaaaaatcattcttcacaatagagaaatctgacagtttcttactgtacccaagtgatcagaattaacatcaccaaaggtggagtaacttaacaagataagctgatattatgcacctcct

SEQ ID NO: 168264 - DNA, 601 bp, Human
aatggaggttatagacatactcaaagtatgaaaaaagaaggagagttcttctgtagagaagacaccagtgccagctgatgaattcaggtagaatgatggaattcaaagatcatcattttgcagacaccaatgaaaacaattgattgaaaaaagaaacatcaatagttgctgaaacttttgggtgaaagattacacagccttaaggtttaattccatagattacttattaattacaaagagaaaaatcattcttcacaatagagaaatctgacagtttcttactgtacccaagtgatcagamttaacatcaccaaaggtggagtaacttaacaagataagctgatattatgcacctcctgtgattcaatacaaaataaagtagggtgacatcagcaaaatgatgaaatagaaagtcccatatcctccttccttccatagagtcatcaactgaacaacaatacatgaattaattccctttgtgaaaaatccagaaacaaattaagacactgctggaccccaggcaagcgcaaaaccagctgcatagaggccagtaaaaaaattcacaacactcacttgccatagtccctttcactgactcagc

SEQ ID NO: 168265 - DNA, 601 bp, Human
aaaggatgttaaaagcagaaaaagaaaactgattcatcacataaaagggagcctccataacactatgaggagatatctagcagaaacctttcaggacaaaatggagaagggagatatattcaaaatgctgaaagaaaaaataattgccaactgagaatactatagcctgcaaaattgtccttcaataatgaaggaggagcttctgcacaacaacaaaactgtcaacagagtaaatagacagcctacaaaatgggagaaaatatttgcaaactatacatctgacaaaggtccaatagccagyatctataaggaacttaaacaaatttacaagaaaaaaaaaaaacaactttatttaaaaagtgagcaagggacatgaacagacacttttcaaaagaagacatacatgtggccaataagcatattaaaaaagctcagtatcactgatcattagaaaaatgtaaatcgcttcatttcattcatttcatcttccatcactaatatcctttcctccagttgatcgcatcggctcctgaggcttctgcattcttcacgtagttctcgagccttggctttcagctccatgagctcctttaagcacttc

SEQ ID NO: 168266 - DNA, 601 bp, Human
gaagacatacatgtggccaataagcatattaaaaaagctcagtatcactgatcattagaaaaatgtaaatcgcttcatttcattcatttcatcttccatcactaatatcctttcctccagttgatcgcatcggctcctgaggcttctgcattcttcacgtagttctcgagccttggctttcagctccatgagctcctttaagcacttctctgtattggttactctagttatacattcgtctaaatttttttcaaagtttttaacttctttgcctttggtttgaatttcctcctgtagctcrgagtagtttgatcgtctgaagccttcttctctcaactcgtcaaagtcattctccgtccagctttgttccattgctggtgaggaactgcgttcctttggaggaggagaggtgctctgctttttagagtttccagtttttctgctctgtttttcccccatcttcgtggttttatctacttttggtctttgatgatggtgatgtacagatgggtttttggtgtggatgtcctttctgtttgttagttttccttctaacagacaggaccctcagctagaggtctgttggagtttgctagaggtc

SEQ ID NO: 168267 - DNA, 601 bp, Human
agctattgttgtctacagaacactagctttagatttaaagacactcacaggctgaaagtgaaagcatggaaaatttattccatccaaatgttaaccgagagagcaaaagtagccatattcatatcagaaaaaatggactttaagtccaaaactgtcacacaaaaaaagaaggacataatctagtgattaaaaagtcaattaaccaggaagatataacaattataaatataaacgcatgcaaattcaaagcacccaaatatgtgtaataatcattgagataactgaagggagaaatagacartaacacaataatagtagaagatagcatcctactttcaacaatagaacacttagaccaaaaatcaataagaaaacaatacttgaacaacactatagacccaattgacctggccaactgatacagaacattttactcaacagcagcagaatgcacatgcttctcaaactcacacaaaatacattccaggatagattacatgttggatcacaaaataagtctcttttcagaacattgatatcataccaagtatcaattcctaccacagggaatgaaactaaaaatcaatagcagaaggaaaaa

SEQ ID NO: 168268 - DNA, 601 bp, Human
aagcatggaaaatttattccatccaaatgttaaccgagagagcaaaagtagccatattcatatcagaaaaaatggactttaagtccaaaactgtcacacaaaaaaagaaggacataatctagtgattaaaaagtcaattaaccaggaagatataacaattataaatataaacgcatgcaaattcaaagcacccaaatatgtgtaataatcattgagataactgaagggagaaatagacaataacacaataatagtagaagatagcatcctactttcaacaatagaacacttagaccaaaawtcaataagaaaacaatacttgaacaacactatagacccaattgacctggccaactgatacagaacattttactcaacagcagcagaatgcacatgcttctcaaactcacacaaaatacattccaggatagattacatgttggatcacaaaataagtctcttttcagaacattgatatcataccaagtatcaattcctaccacagggaatgaaactaaaaatcaatagcagaaggaaaaatgggaaattaacaaatatgtggaaattaaataaaacactcttcaataacaatttgggtaca

SEQ ID NO: 168269 - DNA, 601 bp, Human
aaaacacctaccaaaacttatggaatgcaacaaaagcagtattatgagggaagtttatagtgataaatgtctacatttttaaaaacagaaagaattaaaataaatagtttaattctacctcagggaaactcaagaaactagaaaaaaaagagcaaactaaactcaaaattagtagaaaggaaacaataaagattagagcaaaaataaatgaaatagaaaatataaaaataagagaaaaaatcaatgaaattggttttttgaaatgattaacatcattggcaaacctttagttactaacaaraaaggaagaagactcaaataaataaaattggaaatgaaagagaagacattacaactgatcactggaataaagatgatcataatagtctataatgtacaattatacactgataaattggaataacctagaaaaaatggatatatttctaaacacatacaacccccaagacttcatcttgaagaaatagaaaatctgagcaggcttgtaactagtaaggagactgagtcactaaccaaaagccttccaacaaagaaacttccaggaacagatgtctttactggtgacttatatcaaacattt

SEQ ID NO: 168270 - DNA, 601 bp, Human
caacagcacattaaaaggttatacaccatgactaagtggcattgattcttgggatgcaaggatgtttccacatacaaaaatcagttaatgtaatataccaaaataacataattaaggataaaaatgttatgatcatcccaatagatacagaaaaattgtttgacaaaatgcaatatgatttcatgataaaaacttgcaacaaagtaggaataaaaggaaattacctcaacgtaataaaagccatatatgaaaaaccccacaagtaacctcattcttcatggtaaaaacctgaaaacttgcstgaggaacaaggcaaggactcccactgtgatcatttctattcaacattgtactggaagtactagccatagcagttaggcaagaaaaaaaaaaagacatccaaattgtaaataaaagagtaaaattatctctgtttggaaatgacatgatcttatatttagaaaaccctaaagatttcacacagaaacatacacacgcaggcacacatgcatgcacacacacaaaaacaactgttagaattaacagttccaggatacaaaatcaacatacaaaaatgagttatgtttcactaaccacaaac

SEQ ID NO: 168271 - DNA, 601 bp, Human
cttaaaagaaactaaaaggcataataatgtaatgtaatttataagcctaagctttcattggatctggaatttttaaaaatatacatctataaaagtcacttttaagttattttttagccccaaaataaagaggcttaaaaaaacattaatcattttacaatctctcatgatttctgtaggtcagaaatcagaaaaacctgaagtgggccgggcacagtggctcacgcctgtaatcctagcactttgtgaggctgaggcaggcggatcacctgaggtcaggagtttgaaactagcctggccmacatggcaaaaccccgtctttactaaaaataaaagaattagcctggcatggtggctggtgcctgtaatcccagctactcaggaggctgaggcacaagaatcgcttgaacccaggaggcggaggttgcagtcagccaagatcaggccactgcactccagcctgggtgacagagcaagactccatctcaaaaaaaaaaaaaaaagagagctgaactgggtgatcctggctccaggtttctcatgaggttgcagtcagatggtaactagagctggaaaaccaggtggcagtgactagagcatc

SEQ ID NO: 168272 - DNA, 601 bp, Human
ctttcattggatctggaatttttaaaaatatacatctataaaagtcacttttaagttattttttagccccaaaataaagaggcttaaaaaaacattaatcattttacaatctctcatgatttctgtaggtcagaaatcagaaaaacctgaagtgggccgggcacagtggctcacgcctgtaatcctagcactttgtgaggctgaggcaggcggatcacctgaggtcaggagtttgaaactagcctggccaacatggcaaaaccccgtctttactaaaaataaaagaattagcctggcatgrtggctggtgcctgtaatcccagctactcaggaggctgaggcacaagaatcgcttgaacccaggaggcggaggttgcagtcagccaagatcaggccactgcactccagcctgggtgacagagcaagactccatctcaaaaaaaaaaaaaaaagagagctgaactgggtgatcctggctccaggtttctcatgaggttgcagtcagatggtaactagagctggaaaaccaggtggcagtgactagagcatctgtgagctggtgggcatctcttcatgtagtcccagggcttttccatgtgat

SEQ ID NO: 168273 - DNA, 601 bp, Human
gtgggccgggcacagtggctcacgcctgtaatcctagcactttgtgaggctgaggcaggcggatcacctgaggtcaggagtttgaaactagcctggccaacatggcaaaaccccgtctttactaaaaataaaagaattagcctggcatggtggctggtgcctgtaatcccagctactcaggaggctgaggcacaagaatcgcttgaacccaggaggcggaggttgcagtcagccaagatcaggccactgcactccagcctgggtgacagagcaagactccatctcaaaaaaaaaaaaaaaggagagctgaactgggtgatcctggctccaggtttctcatgaggttgcagtcagatggtaactagagctggaaaaccaggtggcagtgactagagcatctgtgagctggtgggcatctcttcatgtagtcccagggcttttccatgtgatctttaccggggggcttatctgggtctcttcccagaacaatcagacagctttaaggctccatcaagtgttgcagcaagtaaggcagaagcagaattgccttggattcagaagtcacagcatcacttttgctgtcacaaaagcctgcccacat

SEQ ID NO: 168274 - DNA, 601 bp, Human
aaataaaagaattagcctggcatggtggctggtgcctgtaatcccagctactcaggaggctgaggcacaagaatcgcttgaacccaggaggcggaggttgcagtcagccaagatcaggccactgcactccagcctgggtgacagagcaagactccatctcaaaaaaaaaaaaaaaagagagctgaactgggtgatcctggctccaggtttctcatgaggttgcagtcagatggtaactagagctggaaaaccaggtggcagtgactagagcatctgtgagctggtgggcatctcttcatgyagtcccagggcttttccatgtgatctttaccggggggcttatctgggtctcttcccagaacaatcagacagctttaaggctccatcaagtgttgcagcaagtaaggcagaagcagaattgccttggattcagaagtcacagcatcacttttgctgtcacaaaagcctgcccacattcaaacacagaataaataaattatctctctttataggagactgacaacattctggaagaaagagaaattgtggtagtcatttttggaaaatagaatttaccacagacaacaatgaggcaattggg

SEQ ID NO: 168275 - DNA, 601 bp, Human
attttgacctcaagtccctgcctactcatttctttctttgtagtagaaacttcagccctaaaagaactcagtcaaagccaaatcatttctcactacccccaaaaaggcctacaaatttgggccaggagaggcaatcctggcaaggaaatttttttaaaaaggtcccagttacactcaaattgggagtttcactaaattgatatcccccttaggatgcttaatgctcagcttcaatcttacctccagggcatatgatattgtatcatatctgagatttagattgctgaggcatttcctatcmtaactcagtaggttcttaagattttactttgcagagtttaatccactggggtttttttgtctggttgcttaggctaatgctgcttggtgttctgagcgacctcacttccctgtggccctagagtgtggggtgacctgttgcagatgttagtaatttcctatcttgggtggaggccctcacagaagctttatttgcatatgagtgtatttgcccctgatgttttggtcttggatgtcagcggaattgtccgtccttctgaaggtcatacaataccgctttccagggaggtattataacaca

SEQ ID NO: 168276 - DNA, 601 bp, Human
tcaatcttacctccagggcatatgatattgtatcatatctgagatttagattgctgaggcatttcctatcctaactcagtaggttcttaagattttactttgcagagtttaatccactggggtttttttgtctggttgcttaggctaatgctgcttggtgttctgagcgacctcacttccctgtggccctagagtgtggggtgacctgttgcagatgttagtaatttcctatcttgggtggaggccctcacagaagctttatttgcatatgagtgtatttgcccctgatgttttggtcttrgatgtcagcggaattgtccgtccttctgaaggtcatacaataccgctttccagggaggtattataacacagataattgaataattgggccctctctgttttccaaaaggagtgggtttgccacatcttttcttgcaaactagcaaacctagggttaagtagggcttgttggtaaatgtagcgtgtcaggagctcacagccagatatgagccagtaagcaacgtaggtgtcctgggatgacaaaggaggaacatacacacctcagttgtcttgctgattctactctgtgcttccatgtccc

SEQ ID NO: 168277 - DNA, 601 bp, Human
aaaaatgtcaataacactacaataataatagaggtctctcttatgagaaattggttatttagtagacattataaatcaaggtttcaaaaagtattatcgggccatctcaatgttcattgcagttggcatcagtaaagtgaacatggtcaaggtgatattctctaaccatagtaaaataaagggctgaggcattcatttggtgtaaataggacaaacaccagggaggcttggccaggtgtcttttgtagtaaaattgggattctgagattgctgttttccaacttggcaacagccttaaacrtcttggtatcctttaatgttatgattccacttctagggatgtctcctaaggaaagagtgctaaatagagaaaaagtgtaaattgtaatggcgacagaaaatagaaacaacctgaatgtccaactgaagggaaaatgtgtaaataaatcatattcactttatagatgattgtacagacttaaaaatttatgcttatgaataatttggtgataacatgaggtatgagagatatgtataaaaagaatacaaaattatacataaatggcaaagttttaaaacaaaatgtcattaaaataacaaa

SEQ ID NO: 168278 - DNA, 601 bp, Human
cattaaaatgatactttttgagtatataaggaatctttttcttcacatttcaaaacattaactctttctaaaagtccatagtgtgagaggtaaaacactaataatatgtaaactatcagcaattgtacttctcgccataacaactgtatggattgcagacaagaacaaggaaataaataagaaagtccccttgagaagggagagaagacaaaaggaatctactttgtgccaggcaatgtgctacatgctttcataaatgaccttatttaatcctcacaacaactctatgaggcatatataggtgtgtgtgtgtgtgtgtatatatatatatgataaaataagatatatacacatcttattttaccctagcagcaattctgttagatgaggaaactgaaaattctaatagatgaagaaactgaggttcaaagaagttgcataattggaccaaaggaaaacaactaagaaacaagtccacattctttccactgtcattgtgctttgttgatagactacccctggcccatgctcatagccttagatagcctcatttttaaacagaatttggtcacacttcttagtctggtttcttatcctaagg

SEQ ID NO: 168279 - DNA, 601 bp, Human
aactatatggaagtaacacattattttgttcaaaattttgaaatatatatttataattctgtacagctggctggactgtgaactaactatcattgtacagagatctcaacagtgctgcccagcatgatcttaaagcatgtatgtttccaagtgaaaggtgatggaatattttgacagcatgctgctaacttaaacatttttgtttaatgtaatttttgtgtctaagtgctcccaaccaccatttccaagacaagaagactcatgagcattcagaaaacatttggcactgtttcattttaattttttacttctccttgactctttgagcctagaaagaattttctctgtagttgctcacccaggtacaagtgtccttgagttaatcttcggtagctcattttagaatccgactgtgactaaagttggattctgtgactgccttcttgcctgcctctccactgtcacctataattttgtcatttcttttgctctgaaccagcttgctatgctaaaagccatcccttcctttcacattttataatcctcataagattaacagccaaaatccatgaccagaactctgaccacgtacagtctacag

SEQ ID NO: 168280 - DNA, 601 bp, Human
tgagcctagaaagaattttctctgtagttgctcacccaggtacaagtgtccttgagttaatcttcggtagctcattttagaatccgactgtgactaaagttggattctgtgactgccttcttgcctgcctctccactgtcacctataattttgtcatttcttttgctctgaaccagcttgctatgctaaaagccatcccttcctttcacattttataatcctcataagattaacagccaaaatccatgaccagaactctgaccacgtacagtctacagaggacttcatgctaccttgatawtaccccgtattttaccagcaaccatctctcagacttgactataaccctctggtgtacctcatcaattcaatgctccagtgtttatccttgatttcattgttttcttgcctcacagaggtacctagagattttttccaacagaatctttctgcctttttcacttaatagcctatctatgccagtattcccaagtaaactccctttaactgtaaagccattaattttttcttctgatttcttcttttctctttcccacctttgtcttgcccagtttttacttattttcattcctctagtaac

SEQ ID NO: 168281 - DNA, 601 bp, Human
aaccatatccttgtggcaacttataaaaacctcaattgtgtggtttgcctctgcctgttcctgagggcatgcagacataacgaacttctctctcagcctggacctgtgctggaaaagagtttgacgcccactaaaacaggcatttcactgtgaattagaaagcctctggagaagagactttatgtaaatgtgtgttctcagtgtggaattgttcttccatgtttacaattgtttgtgtgtctttttctctgtgccaaatttcaggtgactggagactgattagctggtctgtgctatcctyactccactttagccaacacattgcacattcttacctccaaagtggcaaaaaatgcaaatgtgtatcattatgctttattagctttagtaaaaagtttgccatattaaaggttaaaatttttggcaattttttgtactcctcgaatatctaattatttagattaaaataattatataattattctagttacctttcttgaatttaagtcttaaaaaaaaccctgcaagcaaacatttacctatgtaacaaacctgcacatcttgcacatgtaccccagaacttaaaatttaaaaaaaaacc

SEQ ID NO: 168282 - DNA, 601 bp, Human
catacatttaacattataaattcttttaactgtttcttcttaaattactttgcactatgccttcataacattatatgcagatagaaagttgcatattattatgaccaaaggtcatttattatctaacctttcatcttggtgttgatgatggtcagctcattaaattgttcttctcaacctgggagaattaagccctaatgctcttatgaatccattgcacgtgatgagttcacttctctagctttgtacccttgttgtgagaattatgaaaataggcagttgaattattttctccataatratatagagaaataataatacagagaatgtggaatgttctcaaaaactggttaagaaaggctacattaagaaatatttattaaacttctaatatgagacacccactacactaattgatagaacaaaaaagctttgtaagccataaccctttctcttaaagaatttacattttactttatgagatatgaaataatctgatgaaagatctggaaaataatcaatggaatttgagattgaattatgcagcatcaacttgaaatttgaaagtaaaaaaaactatgtgaacttcatcaataataga

SEQ ID NO: 168283 - DNA, 601 bp, Human
gccttaaacctattattgtgtttaatatatatgtatccttggcttaaatgagcaagactaataaaatccagaaacagcctcattatttttcctgtgcccatccctataagccaatctgtagggctagttcctcccatctccccagaaaaaaaactcaagtaagcctcaacattttttggttattctcagatactaaaaagttctccagtcactttagttgtgaataagtctcaatttagtaagtaatgtatccaatattatataataatcaaagtactaaatgtaatttaaggttgaaacytttaacccctgccctcatcctacagctctactttactacaaggaaggctcttcaatgggaaaatgaggatgatagactttgtctctatttcctaccttacgcctccagttaacatggttcttaacacatctagggtgaaaatagagggggagtggaggaagaggagaggtaagagccaaagacaaagaaatagggtttgtttgtttttttaacctttattttagattcaggggatatatgtacaagtttgttaactgagtgtatttcctgatgctgaagtttggggttcaaatgatccca

SEQ ID NO: 168284 - DNA, 601 bp, Human
agtaatgtatccaatattatataataatcaaagtactaaatgtaatttaaggttgaaacttttaacccctgccctcatcctacagctctactttactacaaggaaggctcttcaatgggaaaatgaggatgatagactttgtctctatttcctaccttacgcctccagttaacatggttcttaacacatctagggtgaaaatagagggggagtggaggaagaggagaggtaagagccaaagacaaagaaatagggtttgtttgtttttttaacctttattttagattcaggggatatatgyacaagtttgttaactgagtgtatttcctgatgctgaagtttggggttcaaatgatcccatcaaccaggtactgagaataggacccaacagctagtttttcaactcttgcctctctcccttcctcccctctctggcagtccccagtgtctactgctgccatctttatgaccatgagtatccaacgtttagcttccacttataagtgagaatatgtggtatttggttttttgttcctgcattaattcacgtaggataatagcctccagctgcatctatgttgctgcaaaggatatgatttca

SEQ ID NO: 168285 - DNA, 601 bp, Human
atattatataataatcaaagtactaaatgtaatttaaggttgaaacttttaacccctgccctcatcctacagctctactttactacaaggaaggctcttcaatgggaaaatgaggatgatagactttgtctctatttcctaccttacgcctccagttaacatggttcttaacacatctagggtgaaaatagagggggagtggaggaagaggagaggtaagagccaaagacaaagaaatagggtttgtttgtttttttaacctttattttagattcaggggatatatgtacaagtttgttarctgagtgtatttcctgatgctgaagtttggggttcaaatgatcccatcaaccaggtactgagaataggacccaacagctagtttttcaactcttgcctctctcccttcctcccctctctggcagtccccagtgtctactgctgccatctttatgaccatgagtatccaacgtttagcttccacttataagtgagaatatgtggtatttggttttttgttcctgcattaattcacgtaggataatagcctccagctgcatctatgttgctgcaaaggatatgatttcattgctttccatgg

SEQ ID NO: 168286 - DNA, 601 bp, Human
gtaagagccaaagacaaagaaatagggtttgtttgtttttttaacctttattttagattcaggggatatatgtacaagtttgttaactgagtgtatttcctgatgctgaagtttggggttcaaatgatcccatcaaccaggtactgagaataggacccaacagctagtttttcaactcttgcctctctcccttcctcccctctctggcagtccccagtgtctactgctgccatctttatgaccatgagtatccaacgtttagcttccacttataagtgagaatatgtggtatttggttttytgttcctgcattaattcacgtaggataatagcctccagctgcatctatgttgctgcaaaggatatgatttcattgctttccatggctgtgtaatattctgtggtgtccctctttgagtggtacaaagaagtacacagatcaacttaggagacaattcagtagcctgttcaaaataacccactaaatgccaggaagtaacagtttggagacaaatttggttagataggtgacttttcaatttagctttggtttaatcttgagtcttctcagagcctagataaaagcctaagaagaaagcac

SEQ ID NO: 168287 - DNA, 601 bp, Human
tctggcagtccccagtgtctactgctgccatctttatgaccatgagtatccaacgtttagcttccacttataagtgagaatatgtggtatttggttttttgttcctgcattaattcacgtaggataatagcctccagctgcatctatgttgctgcaaaggatatgatttcattgctttccatggctgtgtaatattctgtggtgtccctctttgagtggtacaaagaagtacacagatcaacttaggagacaattcagtagcctgttcaaaataacccactaaatgccaggaagtaacagyttggagacaaatttggttagataggtgacttttcaatttagctttggtttaatcttgagtcttctcagagcctagataaaagcctaagaagaaagcaccacaggattgggtcatgtagtgcatctacagtgtacctagttgtacagacattttctagaggctggtgggtgacctaaggtcaagtagcccatttcttgaccagcttatacttttacagtcatcttatttttcagtgatgaacactctaatatctcctaagtgccctcacctaaccacacaggaaaaagaggaaagaaacga

SEQ ID NO: 168288 - DNA, 601 bp, Human
gccatctttatgaccatgagtatccaacgtttagcttccacttataagtgagaatatgtggtatttggttttttgttcctgcattaattcacgtaggataatagcctccagctgcatctatgttgctgcaaaggatatgatttcattgctttccatggctgtgtaatattctgtggtgtccctctttgagtggtacaaagaagtacacagatcaacttaggagacaattcagtagcctgttcaaaataacccactaaatgccaggaagtaacagtttggagacaaatttggttagataggygacttttcaatttagctttggtttaatcttgagtcttctcagagcctagataaaagcctaagaagaaagcaccacaggattgggtcatgtagtgcatctacagtgtacctagttgtacagacattttctagaggctggtgggtgacctaaggtcaagtagcccatttcttgaccagcttatacttttacagtcatcttatttttcagtgatgaacactctaatatctcctaagtgccctcacctaaccacacaggaaaaagaggaaagaaacgaaatacctgtgaattccaacagccaga

SEQ ID NO: 168289 - DNA, 601 bp, Human
ccaagcaatgaggacaaggacttcttataagacaaactcccctgagaattgaaatgatcaaaggaaacctctgggttctaggccattcagctggctgcctgacacaagccaacactttgcactttcctaaaatggaacagagagaatgtcttcaatggtcacaaagccaagatctcaggatataaaacaaaagagaatctcaggatataagacaaaaggagaatctcatccagtttttgactcagttacctacagcaaagttagtttaactaaacagaagtctggtaagaactacaaatcyaccagcctgtcaggccagtttgagcaacaaccttagaaagcctatgcctgtgctccttgccctgtgattctgctgtttatgataaacaatacaaaagacagacaacagaaaacaaggcagcatctctgcaagggaagggatcagaaaataagactactcataccaaacaaacaaacaaacaatcaccagattcactatacccagcaactcgtacatacggatgattttctcctgctaacctgaattttggaaagaagagatgagaaaattttaccttccattctccaccagacgacacta

SEQ ID NO: 168290 - DNA, 601 bp, Human
caaaataatgtcaaaaaactagatgtaaggagaatgaagttgacaaaacagtttaaagaatcatttcattgcacatggcactgaagaacaaaatgaaatcatttctttaaaaagtattcatcctctgccatggttaatcttacgtgtcagtttggtaaggccatggtactcagatatttgttcaaatattattctaggtgtttctgtgcaggtatttctttagatgagataacatttaaatcagtagcctatgagtaaagcagattaccctccataatgtgggtgggcctcatccaaatayttaaaagccttaatagaaaaagactgacctccccagaagaggaaattctcccagcagattgtgcttggactcaaactgcaactcttctctgtgtctccagccctgcaaatctggggcttaccaagtctctatagtcacaagccaattcctcaaaataaatctctgtctgtctgtctctcattttctctctgtctccctttgtctctctctctctctctacacacacacacacacacacacacacacacacacacacacacatattctctgtctctgttggttctgtttctctagagaacc

SEQ ID NO: 168291 - DNA, 601 bp, Human
gtcagtttggtaaggccatggtactcagatatttgttcaaatattattctaggtgtttctgtgcaggtatttctttagatgagataacatttaaatcagtagcctatgagtaaagcagattaccctccataatgtgggtgggcctcatccaaatatttaaaagccttaatagaaaaagactgacctccccagaagaggaaattctcccagcagattgtgcttggactcaaactgcaactcttctctgtgtctccagccctgcaaatctggggcttaccaagtctctatagtcacaagccarttcctcaaaataaatctctgtctgtctgtctctcattttctctctgtctccctttgtctctctctctctctctacacacacacacacacacacacacacacacacacacacacacatattctctgtctctgttggttctgtttctctagagaaccctaagacatttttaatattgtataacaatatgcaatattaagtatacataatttattagtagaaatgtgctttcattctatgcatcaaaggaatactctgtactatgtacttacttgctgtaagcatgtttgtggtctgcatttt

SEQ ID NO: 168292 - DNA, 601 bp, Human
atgagataacatttaaatcagtagcctatgagtaaagcagattaccctccataatgtgggtgggcctcatccaaatatttaaaagccttaatagaaaaagactgacctccccagaagaggaaattctcccagcagattgtgcttggactcaaactgcaactcttctctgtgtctccagccctgcaaatctggggcttaccaagtctctatagtcacaagccaattcctcaaaataaatctctgtctgtctgtctctcattttctctctgtctccctttgtctctctctctctctctacacwcacacacacacacacacacacacacacacacacacacatattctctgtctctgttggttctgtttctctagagaaccctaagacatttttaatattgtataacaatatgcaatattaagtatacataatttattagtagaaatgtgctttcattctatgcatcaaaggaatactctgtactatgtacttacttgctgtaagcatgtttgtggtctgcattttcacatgtgccctctgactatgaaagctgcataattacaaactatctccaggcctttccattttccatgaagtggcttt

SEQ ID NO: 168293 - DNA, 601 bp, Human
tgctactgtacattttttaaatgtatattgaatttcaaagaaatatttgatatatgttaccattaattatttaatatggaagaaagcattttacttcatgctgtgtgtatatacaaactaaacacatttttaattgtctatgcatttaaattatttatgaacataagggaagcttaccaaatttagttcactttaacaggaaatcaaatgcactggtgtaataaaatttgtgatgataaatgcttgtaaattaaagccaataagtataagataaagtggtatctaataatatgtatattayacatttattataaattatatatattaattttataacatacatatgatatatgtagatatcattaaaagaaaaaccttagacaaattaaatttaacagtttaattgagcaaagaacaatttgcaaatcaggcagcctcttgagccagggtacattcagagagattccagtgcagccacatggttgaagatttatggacagaaaaaggaaagtgatgtacagaacatggaagtggggtacagaaacagccagattggttggttacagttcagcatttgcctaatttggacatggcttgaata

SEQ ID NO: 168294 - DNA, 601 bp, Human
accatcacattctcacttaggtaacggtgtgacaaaacttagggccttagtgccacttcagttaccatcattttgggtttctagtttcagcacatcattcataagtcatcatgtcctcatggtcacacatttctttaagcttttgtcattacagttcaggagagaccatttgacattcttgagatggctgcatgcaaacattcaaaactttttaaagaaaacagcacatgagggagactactattatgaccatgaggaggataataccaagagtttggagtatgctttttagccagagtcyccatgaaccaatccaactacaattaaatagatcaaagaattagctagacaaagagtctactcatttcaaccaggtagcctgttcattaatcccctagaaatgaatctctataatacccaatgtattccttcacgtacaactagaagtaccagcaactatacagatacttctgtttagccagcaagtaatctagagcaattcaattatttagcataactttcacaagagaattttaagtctgttgtgtagccagagcttttgcagtagaatctgctacagagcctatcatgagggataaat

SEQ ID NO: 168295 - DNA, 601 bp, Human
gaattagctagacaaagagtctactcatttcaaccaggtagcctgttcattaatcccctagaaatgaatctctataatacccaatgtattccttcacgtacaactagaagtaccagcaactatacagatacttctgtttagccagcaagtaatctagagcaattcaattatttagcataactttcacaagagaattttaagtctgttgtgtagccagagcttttgcagtagaatctgctacagagcctatcatgagggataaatttctaatcattgcctcatctactcccaaccacagaawgagcgatctaacaaatgatatccatccaaaagagagaagatctcctgtaaaggttttctttaatccatgatgtaccttaagaggagtggaccaatgttctgtttttgattgactatgaaggaacaaggctaacatttgttgttcgtattggtccttcatctttcatctctcaaggcataaggttgtccatgtggaagtttggctgcgaaatcttccacaaataaaagtataccccaagagggcacataagagaccccctttttagctctattgttgttagagacataagcaagaaaaaat

SEQ ID NO: 168296 - DNA, 601 bp, Human
ctttggcctaatgagctactgttacaacatcagccctcttgcctaggaaagcttttatacaaccagaaaacatacattgaaaatgaaaattgaatgaaatccctctataaatgtttaaatggcccatcaggtaacagaaatgtacctgaagtttagattatcttcctaggaatatgggtttaacaaaccaaacattgatcataaactattttagcaatttaggacagttacaccacctataaatatcattaatatatgatatatttattatatattattaatatataatatattaataatktatatattaatttggattcctttatcatttccatgatgaatcatggattgtacagcttttaataatgaaaactttaaagactcagaaaagacaaagcagccatctaagttctccctgagtccacatttaacattggacttatgtcctcttaaatccagttgtttctccgatttaggtgcagagcactgataactaataggctatcgcagataatttgacttgcaccatggggtttattcaaattgcatatctaaacagtagtggctgatttagcatgaaaatctgagaaagtattttctt

SEQ ID NO: 168297 - DNA, 601 bp, Human
accacctataaatatcattaatatatgatatatttattatatattattaatatataatatattaataatttatatattaatttggattcctttatcatttccatgatgaatcatggattgtacagcttttaataatgaaaactttaaagactcagaaaagacaaagcagccatctaagttctccctgagtccacatttaacattggacttatgtcctcttaaatccagttgtttctccgatttaggtgcagagcactgataactaataggctatcgcagataatttgacttgcaccatggrgtttattcaaattgcatatctaaacagtagtggctgatttagcatgaaaatctgagaaagtattttcttgatattcaattaatttttgtcttgcttgggttagcagttttaaaaaccagtcagtttctcattagatttctgggaattcttatccaggcttcataatatgatccaaaagttatcacaaacctatatccaagagtgcttaccagggtgctttgaatcctttcatgaacctccttaaaaacacagtaccctaagattctatgtgcttgtgaagttttcaaaaactgcatcaga

SEQ ID NO: 168298 - DNA, 601 bp, Human
tttactgtcatttattaatactccattgaaattttcctcaaaagagaaaaccaaattttatttttagattactgtattatcaatgctaaagctaattgtaataaaacttataactaaatctatgaaatttgtcatctttcgaccacacaagatttccataggtcttttatgttttacatttttccccaacttcctaggtttatgtaattttgcctattttttagtccttcaatttgaaatgtttaaataacttcaaactagataaaaaaaattttaaatacacattttatgtctttattastttcctcatcaaaagcatatcttgcttttgtttatacattctgtatacagaattgtttcatatctagtagtagtaatataattatatataaactctaatttaactattagaaccctaatttatagtgaaaactctgaaagtaattttgaactgttttatatcagtatttacaaataaaaaccattttataatttttttcaaaagatggttcaagttattgttttttaacagacctaaatatatttagcttttctgtacaatataaaaaaagtcaaggtatatagaattaaactcatgttt

SEQ ID NO: 168299 - DNA, 601 bp, Human
taacacccacatggaggccacatttggaaatggactgggagagggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttcccyctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggc

SEQ ID NO: 168300 - DNA, 601 bp, Human
tctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaawaaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaa

SEQ ID NO: 168301 - DNA, 601 bp, Human
cccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcaccycatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttggggcagtattgtaact

SEQ ID NO: 168302 - DNA, 601 bp, Human
ggctaagctggcactcaaaccacaagacgcagcgcttcccatgcttccctcccctttccaaatgcagcgagcctcaccccatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctayccagctgtagggcctaccttatataaactttttatccaggatagctttcttttttgtctttggggcagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttac

SEQ ID NO: 168303 - DNA, 601 bp, Human
taattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcarattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgtt

SEQ ID NO: 168304 - DNA, 601 bp, Human
tttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcaaattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatartgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctcct

SEQ ID NO: 168305 - DNA, 601 bp, Human
taaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttaccyacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttt

SEQ ID NO: 168306 - DNA, 601 bp, Human
ggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggwagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatg

SEQ ID NO: 168307 - DNA, 601 bp, Human
tgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttmtactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggat

SEQ ID NO: 168308 - DNA, 601 bp, Human
aagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaawaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctattt

SEQ ID NO: 168309 - DNA, 601 bp, Human
cccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagsgttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtcttttatgaacttctcaccttttatccccagagttagaaacttctatca

SEQ ID NO: 168310 - DNA, 601 bp, Human
atattgtggagggagtgatttaaaacaaagaagcaaaatgcttcctgctggaaaataaagatgttttcattgcaaaattaatataacctttgtgctatgctgctgcttaaaaaaggatgtctattaattaatcatttttaaatctatcataagaagtaactgtattcattattctgtcactttctaacactaaaggaagaagaacagctgttgtctggcctctaactaactgcaatggggtctttcagaataatacagaaagaacattagaacagcatgagcaagatacacaattcaaaaktaatcgaaaattggtgatctgagaactggagatgttctcatgacatgtaaatatttgttcagcagctaaagtaatagcaatgcattaaaccaatagaattacttttgacacctaacagaaatgttaattgatcatcaatctttagctcgtaataaaagggctgaacttgcagttctgaaagtatagccagaaaaattatgtgagagacataaatgttataaaaaagacaaactgctccaagctaaattgctttaaattacattgacctcatcactgtacctttgaaacctgtctctaatt

SEQ ID NO: 168311 - DNA, 601 bp, Human
aacctttgtgctatgctgctgcttaaaaaaggatgtctattaattaatcatttttaaatctatcataagaagtaactgtattcattattctgtcactttctaacactaaaggaagaagaacagctgttgtctggcctctaactaactgcaatggggtctttcagaataatacagaaagaacattagaacagcatgagcaagatacacaattcaaaattaatcgaaaattggtgatctgagaactggagatgttctcatgacatgtaaatatttgttcagcagctaaagtaatagcaatgcrttaaaccaatagaattacttttgacacctaacagaaatgttaattgatcatcaatctttagctcgtaataaaagggctgaacttgcagttctgaaagtatagccagaaaaattatgtgagagacataaatgttataaaaaagacaaactgctccaagctaaattgctttaaattacattgacctcatcactgtacctttgaaacctgtctctaattgagagcaattgatttacccttccaactttcctttaaagcctatcagatcccaaattctaaatgttaagaaccctttgccaaagt

SEQ ID NO: 168312 - DNA, 601 bp, Human
tattctgtcactttctaacactaaaggaagaagaacagctgttgtctggcctctaactaactgcaatggggtctttcagaataatacagaaagaacattagaacagcatgagcaagatacacaattcaaaattaatcgaaaattggtgatctgagaactggagatgttctcatgacatgtaaatatttgttcagcagctaaagtaatagcaatgcattaaaccaatagaattacttttgacacctaacagaaatgttaattgatcatcaatctttagctcgtaataaaagggctgaacttscagttctgaaagtatagccagaaaaattatgtgagagacataaatgttataaaaaagacaaactgctccaagctaaattgctttaaattacattgacctcatcactgtacctttgaaacctgtctctaattgagagcaattgatttacccttccaactttcctttaaagcctatcagatcccaaattctaaatgttaagaaccctttgccaaagtattctgcaattgagctttcctttgagattcttaagtgatgactaaggcacgagccaggtagaaaaacagtactcagtgaatttaa

SEQ ID NO: 168313 - DNA, 601 bp, Human
tcttcccagcctctcttgcaaattctctcctgcaccaggtctcaggaggatgagaggagcagatttaatattgcaacaagtttggaatttttattgttctttgaaccaaaagatttaaactactaaatcaagacttaaagctacatggcaactttctgtcacctaagaggttagggaggccattctgcaagggaaaactacccatactgaacaaattttaaagggacagtgggaaaaagaagtaagattgctttagtaataatatcccatgaatcctaattatttaacatatgagctacayaattatttttaagattatttcattcattttatattcagatttttataccatgaatatacatagaaatataaaatttctaagaatgaaataaaaagatttttaaatgtcttgctaatcacagtagcctcacattatgattaacagatgtaaatccatatttcaaatactcttcttcaaacttttgaaatttgggagcctactattgttaaatgtgattatatcatcactgttttcatcgcattaggggctgacaagggttcagactagaaggagcacaggggttggctctggcactttcct

SEQ ID NO: 168314 - DNA, 601 bp, Human
aatatcatattttacccaatctcaggtaacatgtatttcttgggtacttaactatgttgtcagacactatattgaacttttagcatgtattatctcattgaatcctcacatgtaattcatctggagctgttaaagctaacatttgctcccctatagtctgatgaaagactatttttctaccttccttattagtctcttcacatttggtttctttttcatctgcagttcattattgattgcaagctaaatcgtcaaagctaacacaatttccaaataatgcttcccagccagcaagaatcaygcaaaatgaaaagcagtgatttgacatgaagaggacaatttttctcacagctcgaacataaattgtcaccattcatgaactccagtagactgctcttcctttatgatttgttcttattcatgccccaggtgaacaggaataaagcccagggcactgagccagtgtgctgaacccaagacaggtggcacaataagatactagcctttaaaatatgcattcggttggaacctgcaatttcatccacttctaaaaatttttcccaggaatatagtcagataccaactaagatgtatcaatgat

SEQ ID NO: 168315 - DNA, 601 bp, Human
ttattgattgcaagctaaatcgtcaaagctaacacaatttccaaataatgcttcccagccagcaagaatcatgcaaaatgaaaagcagtgatttgacatgaagaggacaatttttctcacagctcgaacataaattgtcaccattcatgaactccagtagactgctcttcctttatgatttgttcttattcatgccccaggtgaacaggaataaagcccagggcactgagccagtgtgctgaacccaagacaggtggcacaataagatactagcctttaaaatatgcattcggttggaacytgcaatttcatccacttctaaaaatttttcccaggaatatagtcagataccaactaagatgtatcaatgatgatgaccaatccagtgttgtttacaacaataaaaattatgagcaaactaaaggaccaagagtagaaaactgactaaggacattgtgataattaataagataaattactatttagccattaaatatatatatatatacacattttaaagtatttttaacaatgtataaaatgctaaagatatattgctaagcagcaaacactatgcatcaagttataccatacattaaca

SEQ ID NO: 168316 - DNA, 601 bp, Human
atacacatacaaaattttatataaaaataatttatacataatttataatatatacttttttatataaatcctatatataagatttttaaatatgaaaacaattcagaatttttttcttttttgacattttctgttttttaccttgactgtataatttttaaaagcaaaaagatcacttatgatatagacttcaattcaacaaatacttttcagtagcctattatgtaattaaattaagtttaacaaacatttctttaatgaaccatacacatgactgtagatataataaagagtacaaccygatccctgctcttgatgagctcacagtttagcaagaggaacgtataacaagtcaaaacaactaatcctaatagttgttatgaaagagcagtggagatacaaagaggaagtagtcacctcaaactggaaaagcaatggtaggtaaagagacaggaaggtattccaggtagaataaaaaacatctaccaatgtatgctgtcatgcacactggaatggaaagtaaaagcaagtaagtgggaaaatatgaagatgaagaagaaggtaggggcattatcatgatggactcttgaagcattaaggt

SEQ ID NO: 168317 - DNA, 601 bp, Human
tacacatgactgtagatataataaagagtacaacctgatccctgctcttgatgagctcacagtttagcaagaggaacgtataacaagtcaaaacaactaatcctaatagttgttatgaaagagcagtggagatacaaagaggaagtagtcacctcaaactggaaaagcaatggtaggtaaagagacaggaaggtattccaggtagaataaaaaacatctaccaatgtatgctgtcatgcacactggaatggaaagtaaaagcaagtaagtgggaaaatatgaagatgaagaagaaggtagsggcattatcatgatggactcttgaagcattaaggtacagactctacagctgcaccagccacatgtgaattgaattcttgaaatgtggctaatcctaattgagatgtactgtaaatataaaacaccacaccagattttgaagacttcatatttaaaaatgagaaataactcattaataatttttatgttgattacatgctgaaatgacatttttgtgtacattgggttaaattaagtatattatttaaattgattttattcaattattattatttttcataatgtggctactaaacatata

SEQ ID NO: 168318 - DNA, 601 bp, Human
gagtgcattgacaaaacaagtccagttcaataagaaatgaggatctggtaagtgtctggaatgccctcagttttttggcttgataaccataggaacagtagtaaccttagggaaaataaggaatacaaaaggaagaccagatctgtctgtaaagattcattcattcaaatattatttattgagcatctaccatgtgctagttattatttagctggttaggtgctaggaaactagcagtgatgaagcagatgaggtccctgctctcctggagcttacttacactctattacaagcacataawgagctcaatttagccatgtttaaagtgagatggctatggcacattcagataaaaatgtcaactagacatttaagtataaaatttaggagaaagataggaatggtagtttgagatctggggatcattgtggtgattccacctagagacagcatgtaaaaaacaaaaccctgaaaaacactagctatctaaaggtaatgtggagaaggaagaatcagtgaaaaatatagatagaggagaactaggagaaaacagtgtcaaaaaagccaaggaagaataaaattttaagtgtggtcaaccatg

SEQ ID NO: 168319 - DNA, 601 bp, Human
tgaggatctggtaagtgtctggaatgccctcagttttttggcttgataaccataggaacagtagtaaccttagggaaaataaggaatacaaaaggaagaccagatctgtctgtaaagattcattcattcaaatattatttattgagcatctaccatgtgctagttattatttagctggttaggtgctaggaaactagcagtgatgaagcagatgaggtccctgctctcctggagcttacttacactctattacaagcacataaagagctcaatttagccatgtttaaagtgagatggctayggcacattcagataaaaatgtcaactagacatttaagtataaaatttaggagaaagataggaatggtagtttgagatctggggatcattgtggtgattccacctagagacagcatgtaaaaaacaaaaccctgaaaaacactagctatctaaaggtaatgtggagaaggaagaatcagtgaaaaatatagatagaggagaactaggagaaaacagtgtcaaaaaagccaaggaagaataaaattttaagtgtggtcaaccatgttcaatggagtagattggttaacccaatgactaccaa

SEQ ID NO: 168320 - DNA, 601 bp, Human
aagtgtggtcaaccatgttcaatggagtagattggttaacccaatgactaccaagtatccatatgtagctacgaggctattgcttaccttttggaaggcatttttcatgggatggtggggacaaaacccaagtcacaaatggctgaaacatgaatggaggtgaggagtaaagtcagcacctgagtactgttcctttgaagaacttggctgggtaggacagtggctagaaaagataaaatctcaagagagagcctaagatgagagagattgaaatatgttttcgggtatgagggaaggaccatggagaggactgaaaatagaggaaaacagaggaatatgtgatagactaagatcacatgggagttgaaagtagatgcgatgaaaagcactgggggatatattagtcttgacaacaaaatggaacacctttgcttgacactccaggtgtcaggaggaatttttaaaagacaaatgtgtagaaagaaggacttgaaagagttcctgcctgatgaccagcactccctgttaattaggggatgattagggaaagtagggagagtggaaactgaacagaaggcctccagagagggatgaaagttta

SEQ ID NO: 168321 - DNA, 601 bp, Human
tggtagaagaagtgatcagaagcacattgattgatgcaggaaaaaaataagagggttaagaggttggaaggctgtcctgataaggctggtgagctgctagaaagaaattgtaaataagaaatgatgtttctccaaaataacaataatatatcaacaataataaatagctcttcattattaagcaattactatgtggcaggcagtgtattaaaatttttttaactttacatttaattgtaatgacaaccctgtgaggtaattactattattatatcctttttgttttcttttaaacaagtamattaaagtactgagagtttaaataacttgctaagactgtagagccagtaggtggtggagccctctttcttaatcactgtacaggccaaaggcaaagacataaagatatagtttatttaaaaaggagtaaggtttcacggaaaacagagggaaatggacagtaagaaaataagtggagactagagaagcagagttcagaaagaagagtacacagtgaatggagataaagttagaggagacaagaataaatcattgaggaggcccacaattttaatggtgctaaaagattaccagaatgagt

SEQ ID NO: 168322 - DNA, 601 bp, Human
taacaataatatatcaacaataataaatagctcttcattattaagcaattactatgtggcaggcagtgtattaaaatttttttaactttacatttaattgtaatgacaaccctgtgaggtaattactattattatatcctttttgttttcttttaaacaagtaaattaaagtactgagagtttaaataacttgctaagactgtagagccagtaggtggtggagccctctttcttaatcactgtacaggccaaaggcaaagacataaagatatagtttatttaaaaaggagtaaggtttcayggaaaacagagggaaatggacagtaagaaaataagtggagactagagaagcagagttcagaaagaagagtacacagtgaatggagataaagttagaggagacaagaataaatcattgaggaggcccacaattttaatggtgctaaaagattaccagaatgagtggcattgaaaaaataactgaccctagaatttttcagctttacaaataagattactggagccagctcaaagcacatacaatatattacagacagttcagagaataaagttgaaaggcccatgccagcccccaaggaac

SEQ ID NO: 168323 - DNA, 601 bp, Human
aaaccacatgattatctcaatagatgcagaaaaggccttcaataaaattcaacatccctttatgttaaaaactcccaataaatgaggtatttatggactatacctcaaaataatgagagctatttatgacaaacccacagccaatatcatactgaatgggcaaaagctagaagcatttccttgaaaactggctcaagacaaggatggcctctttcaccactgctattcaacatagtattggaagttcggcccaaggcaatcagccaatagaaagaaataaagggtattcagataggaagasaggaagtcaaattgtctctgtttgtagatggcatgattctatacttagaaaaccccatcgtctcagctccaaactcgttaagctgataagtaacttcagcaaagtctcaggatacaaaatcaatgtgcaaaaaaatcagaagcaatcctatacatcaacaatagacaagcagagagccaaatcatgaatgaactcccattcacaattgctacaaagagaataaaatacctaggaatacaacttacaacaaaggaccctcttcaaggagtactacaaaccactactcaaggaaatcagagg

SEQ ID NO: 168324 - DNA, 601 bp, Human
aacaggcaacctacagaatgcaagaaaatttttgcagtaaatccactacaaggaatttaaacaaatctacaaggaaaaaacaaacatcatcatcaaaaaattggcaaaggatatgaacagacacttctcaaaagaaaacttttatgtggccaacgaacatacaaaaaaaagctcaacatcactgatcattagagaaatgcaaatcaaaaccataatgagataccatctcacactggtgaggttgtggagaaataggaacacttttacactgttggtaggaatgtaaattagttcaaccatwgtggaagacagtgtggcaattcctcaaagacctagaaccagaaataccaatgggattgctgggtatatacccacaggagtataaatcattctactataaagacaaatgaacacgtatgtttactgcagcactatttaaaatagcagacacgtggaaccaacccaaatgcccaacaatgatagactagataaagaaaatgtggtacatataaaccatgggatactatacagccataaaaaggaatgagatcatgtccttggcaaggacatgaagctggaagccatcatcttcagcaaacta

SEQ ID NO: 168325 - DNA, 601 bp, Human
ttgcagtaaatccactacaaggaatttaaacaaatctacaaggaaaaaacaaacatcatcatcaaaaaattggcaaaggatatgaacagacacttctcaaaagaaaacttttatgtggccaacgaacatacaaaaaaaagctcaacatcactgatcattagagaaatgcaaatcaaaaccataatgagataccatctcacactggtgaggttgtggagaaataggaacacttttacactgttggtaggaatgtaaattagttcaaccatagtggaagacagtgtggcaattcctcaaagayctagaaccagaaataccaatgggattgctgggtatatacccacaggagtataaatcattctactataaagacaaatgaacacgtatgtttactgcagcactatttaaaatagcagacacgtggaaccaacccaaatgcccaacaatgatagactagataaagaaaatgtggtacatataaaccatgggatactatacagccataaaaaggaatgagatcatgtccttggcaaggacatgaagctggaagccatcatcttcagcaaactaacacaggaagagaaaaccaaacaccgcatgt

SEQ ID NO: 168326 - DNA, 601 bp, Human
agacctagaaccagaaataccaatgggattgctgggtatatacccacaggagtataaatcattctactataaagacaaatgaacacgtatgtttactgcagcactatttaaaatagcagacacgtggaaccaacccaaatgcccaacaatgatagactagataaagaaaatgtggtacatataaaccatgggatactatacagccataaaaaggaatgagatcatgtccttggcaaggacatgaagctggaagccatcatcttcagcaaactaacacaggaagagaaaaccaaacaccgcrtgttctcactcataagaggtagttgaacaatgagaacacatggacacagggaggggaacaacacactgaggccagttaggggatggggggctaggggagggaaagcattagggcaaatagctaatgtatatggggcttaaaacctagatgatgggttgataggcagcaaaccaccatggcaaacgtatacctaggtaacaaacctacacgttctgcacttgtatcccggaacttaaagtaaaattaaaaaaataaaataaacaggattgaagggaattaggagccaaattcacatgtctg

SEQ ID NO: 168327 - DNA, 601 bp, Human
agatcatgtccttggcaaggacatgaagctggaagccatcatcttcagcaaactaacacaggaagagaaaaccaaacaccgcatgttctcactcataagaggtagttgaacaatgagaacacatggacacagggaggggaacaacacactgaggccagttaggggatggggggctaggggagggaaagcattagggcaaatagctaatgtatatggggcttaaaacctagatgatgggttgataggcagcaaaccaccatggcaaacgtatacctaggtaacaaacctacacgttctgcayttgtatcccggaacttaaagtaaaattaaaaaaataaaataaacaggattgaagggaattaggagccaaattcacatgtctgtatgaaccagttctctttttagcaatcttctgaacatcaccacacatctgtcagcagtacagaagccctcaaaagtcatggccaagggcacttaccaagctgttttttgtactaaggacaactctaagtgtaggacattgaaatatatttatgaacttaataaaacatgcttgcttttaaaatgtgtttaaaaaggactactacaaagcaaccaatgg

SEQ ID NO: 168328 - DNA, 601 bp, Human
cctgagttagatctttcctatatgaataaaatatatatttctatggaaaataaaagttcctctgggagaactgggtctagccaggctttctcaaactgtattccaatgatccctgcatcaagaccactagggattattaaaatgcaggtaccagggcctcctccagacctaaaaatcagaatctctgagtataaagactggtgatcagaatgttttaaaacttcccagttgatttgtatatatcataaaccttttgaacctatggtcacccagaagcatactaaagcaaaacaaaactggwtggctgagagaaagagtttgctgtaaactctcttctaccttctgaattctgactcttttcatgaacaaaacttaaaagaatgagcagcatatttatatttgcaccctgagaatgaagcagagcatctggcaaatagcagaataatcagaaaaatatttgtggatttaaactgagcagcgtggtcatgaaaggcatagtttataataaataacatactttttttcacatccacatttcctctcctcttcccagccttctctaaagaaagagaatacttactgcattgtcaacagcgtttgc

SEQ ID NO: 168329 - DNA, 601 bp, Human
ctggtgatcagaatgttttaaaacttcccagttgatttgtatatatcataaaccttttgaacctatggtcacccagaagcatactaaagcaaaacaaaactggttggctgagagaaagagtttgctgtaaactctcttctaccttctgaattctgactcttttcatgaacaaaacttaaaagaatgagcagcatatttatatttgcaccctgagaatgaagcagagcatctggcaaatagcagaataatcagaaaaatatttgtggatttaaactgagcagcgtggtcatgaaaggcatastttataataaataacatactttttttcacatccacatttcctctcctcttcccagccttctctaaagaaagagaatacttactgcattgtcaacagcgtttgcaccaggacctgtattttgctttttattcttggtaatgagccatgcatcccccatacctagagcttagtggattcacagggttgatgctagaaagtatagataaagcttcccacacttttctcttagttacactttgacaaacagtatctgtttcctctctcataaagactaatgtatgtggtatttgacatttacct

SEQ ID NO: 168330 - DNA, 601 bp, Human
atatttgcaccctgagaatgaagcagagcatctggcaaatagcagaataatcagaaaaatatttgtggatttaaactgagcagcgtggtcatgaaaggcatagtttataataaataacatactttttttcacatccacatttcctctcctcttcccagccttctctaaagaaagagaatacttactgcattgtcaacagcgtttgcaccaggacctgtattttgctttttattcttggtaatgagccatgcatcccccatacctagagcttagtggattcacagggttgatgctagaaagyatagataaagcttcccacacttttctcttagttacactttgacaaacagtatctgtttcctctctcataaagactaatgtatgtggtatttgacatttaccttttccctttttacagaaaaaaattcacagataaccatctggctatacacatctatatctcacagactagaaagaattgtttcagttgttaatcatataaacattatgcctttggcagtttcaaatgatgtgagttttaagcagctaaacagtccttttggtgacaactaattactcatagtgtgtttatagcaaaaat

SEQ ID NO: 168331 - DNA, 601 bp, Human
agcagagcatctggcaaatagcagaataatcagaaaaatatttgtggatttaaactgagcagcgtggtcatgaaaggcatagtttataataaataacatactttttttcacatccacatttcctctcctcttcccagccttctctaaagaaagagaatacttactgcattgtcaacagcgtttgcaccaggacctgtattttgctttttattcttggtaatgagccatgcatcccccatacctagagcttagtggattcacagggttgatgctagaaagtatagataaagcttcccacacktttctcttagttacactttgacaaacagtatctgtttcctctctcataaagactaatgtatgtggtatttgacatttaccttttccctttttacagaaaaaaattcacagataaccatctggctatacacatctatatctcacagactagaaagaattgtttcagttgttaatcatataaacattatgcctttggcagtttcaaatgatgtgagttttaagcagctaaacagtccttttggtgacaactaattactcatagtgtgtttatagcaaaaattgttttataaatgcaattgtc

SEQ ID NO: 168332 - DNA, 601 bp, Human
taaagtctcattttttaagaaagacccaaaatggtaaaaggcttagttcccaattccatgactgcattggtctgctggtacagacagctattttaaatcactcacaaaataatttatttgtaaaagttcaaagatttaatatatgttcaggcagagtgaatagaaatgcaaatattcttgatcacaatgaagctttttatgtaaaagcctgcaggatttgttccataggatattactacttcctcttattcatagttgttaagtaattacatttttcttatttattgtgttaaatattaayataactttttctctcatctctgtcacattacctcaatgaattttcttgaatatttctttcagcctcttaatgaatgacctattaaattcattattatgattatagtaaaccattgttactattcattcacatgacattatatattttaggaaagtactattatcacatgaattattttatgatcttttttatagcagcataaacgtcacaatggctttctttgccattaaaaatctcatgcagaagaattcatttgtcaacactaaccagcaaaaattatctgcattcacttaaagctac

SEQ ID NO: 168333 - DNA, 601 bp, Human
attattatgattatagtaaaccattgttactattcattcacatgacattatatattttaggaaagtactattatcacatgaattattttatgatcttttttatagcagcataaacgtcacaatggctttctttgccattaaaaatctcatgcagaagaattcatttgtcaacactaaccagcaaaaattatctgcattcacttaaagctacaaatacccattctacgtctacatcccagaccaatgcagtctaacctgcagagttcaaatttattttattataaaaagtttcctgcacttkctgtgattgtctttcaatgcatggattcaatctaggtcaggtgcttccataggaagagtcaattttatctagccaagcattaaagatttttcttaaaggagatgttttatattgggaataatggaactaaggaatgtgaaaaagggcttgagaaatatacaggttgttattcagcatcagtcttattgcaccaacatgggtatacagcagctattgatgttgaatgtatttttttgttatgaaatataagaaaatttcagggaaaaaatgctcaagtcttgctgataacacatcctccag

SEQ ID NO: 168334 - DNA, 601 bp, Human
ttaggaaagtactattatcacatgaattattttatgatcttttttatagcagcataaacgtcacaatggctttctttgccattaaaaatctcatgcagaagaattcatttgtcaacactaaccagcaaaaattatctgcattcacttaaagctacaaatacccattctacgtctacatcccagaccaatgcagtctaacctgcagagttcaaatttattttattataaaaagtttcctgcactttctgtgattgtctttcaatgcatggattcaatctaggtcaggtgcttccataggaaragtcaattttatctagccaagcattaaagatttttcttaaaggagatgttttatattgggaataatggaactaaggaatgtgaaaaagggcttgagaaatatacaggttgttattcagcatcagtcttattgcaccaacatgggtatacagcagctattgatgttgaatgtatttttttgttatgaaatataagaaaatttcagggaaaaaatgctcaagtcttgctgataacacatcctccagtatgtattaatataatgagggtttgagggacatgtcccaaatccaaaaacacgcca

SEQ ID NO: 168335 - DNA, 601 bp, Human
cagcagctattgatgttgaatgtatttttttgttatgaaatataagaaaatttcagggaaaaaatgctcaagtcttgctgataacacatcctccagtatgtattaatataatgagggtttgagggacatgtcccaaatccaaaaacacgccatcaactgaaaccctgtgcagactacttaaggaaaaaaactagcatggctgtgattatactgccctctagtgtcaaaataaatgttatttacactgaagttcatttgcttttttcagatcagcattttcatgacccatttgtccaactaygggaatgaccgactgggattatatacatttgttaatctggccaactttgtgaagagctggaccaacctgcgacttcagactctgcctccagtacaactggcccacaagtattttgagctgtttcctgatcagaaagaccctctctggcaggtaaaattaattaaataattgatataaccagttaattccaggaacataattctgtgagatatcccaaatttgaaaagtgaaggcacctgaaaaaacctgcattttggaaatgttagtaaatttgagaaactactccttcctaaactgtag

SEQ ID NO: 168336 - DNA, 601 bp, Human
gttcccttgcacattggaaattatgggattcggaaagttcagtgacagattcaatgaatataacgtcttcaatcaggagtgagagataaatctacaggttgcaataggctggaagagtagaagatggtaaacaggtcgtttgttagacaggtagcctttgaacacatccccatatctctaatgactaaaccatattaaaggatctctgagaagagttcagaactgacatctgccttctgaaccacgaggtacaccaacagccaacagccactgaatgtggacagctttcaaaagtattaaytggggattaatatgggggaaagcatttcatgggaaaatcactgagcttcttaagataaataccacatgaatacagcatattcagatgactctgggggtaacctagatttcaaagcatagactcttatgtatcatagaattgcaggaacaactttgaatttaaattgtccactccatgatctgtgaaaaataataatcttggcaaataattacatattgcttattatatgtcagacggggcacttgacatgtgttaactcatttaatcctcacaactaccttaagtggtaggtacagttat

SEQ ID NO: 168337 - DNA, 601 bp, Human
ttaactcatttaatcctcacaactaccttaagtggtaggtacagttatgatttgcattttacagatgaagaaactgaagcacagaaaggctgagtcaattaagcaaggtcacacagctagtgtgttgcagagcaggaatcagttgtaggccatctggttccaaaagctgtacttcttaatcactgttctaaacgctactagagttacagacagagctgatggtaaaacaataacaatcatcagaagtagaactcagtaactttttaccacagattgaagttgttaactctgaactttatastcaatgcattcagctttcaaccgtaagttaattacctcctgagcacacacagatgactccaagagacataactgcatatttagcaggttaaagttggtggttgtggacttatgactgcatattacttttccgttgttttaacaagcatcttttcattttaaccaccacgaaacatcaccaaatgttagccaatggaaagacatgcaattttcctgctaattcaaccttacttttaaactgaaatcattatttcaggtgacaagttttaaactgtttttttgttttttttttcagaagaac

SEQ ID NO: 168338 - DNA, 601 bp, Human
gattgtatcaaaagtcaagagggacacagataagtacctataactctttataataaatcccttctagaaaaatagtcccttaggctgccattttcctaatattgtttatttgtaaactatttcttgcagagatgactattttttaaaagtctaaaagatatttcacaagcagaattcctagacatacacaaaactttgtgctaagaaaggtgtttattcatacccaggagaaatcttttgcaccttttcttaaattgatgtgcaatttttttcaccataaacttctttatcaccataaactttttttttttttttttttgagacggagtctcgctctgtcacccaggctggagtgcagtggcatgatctcagctcactgcaaactccgcctcccgggttcacgccattctcctgcctcagcctcccgagtagctggggctacaggcgcctgccaccatgcccggctaatttttttgtatttttagtagagacagggtttcaccgtgttagccaggatggtctcgatctcctgacctcgtgatccgcccgcctcggcctcccaaagtgctgggattacaggcgtgagccactgtacccggtc

SEQ ID NO: 168339 - DNA, 601 bp, Human
gagaggttaaataatttttgttcaaattcacacagctggtaagtacaagaataaaaatcttggtcctagaatttacctgacttcaaaaaacatgctttttctactttaccgtggatttcatgtaatggagcttttttcctccaataaattttagatattgcttcatagttattctaagtcagtgattctcaagggtggttgccagagcagcaacataagcatcaccagaaaatttattagaagtgcaggccaggcacggtggctcacgcctgtaatcccagcactttgggaggccgaggcrggcagatcatgagaggtcaggagatcgagaccatcctggctaacacggtgaaatcccgtctccactaaaaatacaaaaatttagccgggtgcggtggcgggcgcctgtagtcccagctactcaagaggctgaggaaggagaatggcgtgaacccggcgggcggagcttgcagtgagccgagatcacgccgctgcactctagcctgggcaacagagcgagactccgtttcaaaaaaaaaaaaaagaagtgaaattcttgggttataacaaagacttaccgaatcagagatactgggatagg

SEQ ID NO: 168340 - DNA, 601 bp, Human
tattttaacaatttttctattgtatagatatggtagatttaagtaaatattaaagaaagcttaatttataaatacttaaatagtatttatttacttaaatattgccatatttgtaccatttaagtaaataaacactaaaatactaccttacttccatattaatactatttaagggcggggcacagtggctcatgcctgtgatcccagcactttgggaggctgaggtgggcggatcacctgaggtcaggagttcgagaccagcctggccaacatggtgaaaccccgtctctactaaaaatasaaaaattagctgggcatggtggcaggtgcctgtaatcccagctgcttgtgaggctgaggcatgagaatcgcttgagcccaggaggcagaggttgcagtgagcccagatcgtgccactgcactccagcctgggcaacagagcaagactccatctaaaaaaaaaaaataaataataataataatactatttaagtaaatactagcatattaatgctatttaagtaaatactatactatcatattaatactatttatactactattatttaattagtactattaataataccatattaatacc

SEQ ID NO: 168341 - DNA, 601 bp, Human
ctatttaagggcggggcacagtggctcatgcctgtgatcccagcactttgggaggctgaggtgggcggatcacctgaggtcaggagttcgagaccagcctggccaacatggtgaaaccccgtctctactaaaaatacaaaaattagctgggcatggtggcaggtgcctgtaatcccagctgcttgtgaggctgaggcatgagaatcgcttgagcccaggaggcagaggttgcagtgagcccagatcgtgccactgcactccagcctgggcaacagagcaagactccatctaaaaaaaaaatataaataataataataatactatttaagtaaatactagcatattaatgctatttaagtaaatactatactatcatattaatactatttatactactattatttaattagtactattaataataccatattaataccatttaagtaaataaataataaagaaagcttacctgaaaaataagaaaattcaaagttttgtacaaatggcaacatgacataattactaagcataattagagtaatttctccaagtgagagaaatattataaggccatgtcttgttactattgctagctattgac

SEQ ID NO: 168342 - DNA, 601 bp, Human
tttaagggcggggcacagtggctcatgcctgtgatcccagcactttgggaggctgaggtgggcggatcacctgaggtcaggagttcgagaccagcctggccaacatggtgaaaccccgtctctactaaaaatacaaaaattagctgggcatggtggcaggtgcctgtaatcccagctgcttgtgaggctgaggcatgagaatcgcttgagcccaggaggcagaggttgcagtgagcccagatcgtgccactgcactccagcctgggcaacagagcaagactccatctaaaaaaaaaaaataaataataataataatactatttaagtaaatactagcatattaatgctatttaagtaaatactatactatcatattaatactatttatactactattatttaattagtactattaataataccatattaataccatttaagtaaataaataataaagaaagcttacctgaaaaataagaaaattcaaagttttgtacaaatggcaacatgacataattactaagcataattagagtaatttctccaagtgagagaaatattataaggccatgtcttgttactattgctagctattgacttg

SEQ ID NO: 168343 - DNA, 601 bp, Human
atagtatatttctctcttaggagtagccaatatatagaaatacttttatattatgatcttttaaacacagtcacagttacaagtattaaatacatggctaaatctttgacaaactgaacccaaactgccttactttctcttgtaccaatctgactaagctacaccctttatctcctcatttagtcttataaaaccctaactgtacagtttatgacattgctcactttttgaaaaatcacacccttgctccccaatagtcacaaatatatatacgtacctgtgatacaccattctcttcccyagtaaatgcaaattctataagttatgtcgctaagaaagggcaccatttttttttccaatttagcaatttaaacaatttttgacactactaagtacattgaagcttaagcaaacttgtggaaagattaaattctgtcttgagtttaattagctttcataggcctctggaagaacttaatatgagaacccaagtattgattttggtaatgtaatatgttaaataataatatatttcatttatatagtgccttattaccgtcaaaatgtcttcaagtacatgttctttcattctcagagaaaa

SEQ ID NO: 168344 - DNA, 601 bp, Human
atgttctttcattctcagagaaaatctatgaaataagtaggcaggtgattttccattaagaaagctgagacaggtcaggagaggtgactcactcctgtaatcccagcactttagggggccaaggtggaaggattgcatgagctcaagtgttcaagactagcctgagcaacacagtgagacctcatttctactaaaaattaaaaaaaaattaaaaattagcccggcacagtggtgcatctctgtagtcacagctacttgggaggctcagacaggaggatcccacgagcctggtgtcaaggtygtagtgagccatgattgcaccaccacactccagcctgggcaatatagtaagatgctgaaaaaaaaagaaagaaagagagagaaagaaggaaagaaagaaaagaaaaggaaagaaacaaagaaagaaagaaaagataaaaagaaaactgagacaaacagaagctaaaagacaaagtcacagacaaatcagtcattgagctgagattgaaagccagttctctcaatccctgcaacaggcctcttttcacaccacactatctccattttttagaacctgcttctattaaactgccgattatct

SEQ ID NO: 168345 - DNA, 601 bp, Human
caaagtcacagacaaatcagtcattgagctgagattgaaagccagttctctcaatccctgcaacaggcctcttttcacaccacactatctccattttttagaacctgcttctattaaactgccgattatctattcaatttatttccagcagtagttgtaataaatctgtttggatcattctaatatttattcatgactttaaagtgttgatcataggaaattgtgttttcatttaattaatttctgaacctctattgtctttctaggtaccactgctttgtatttgttcctggttatgcayccttccatccttagtaactcccccagcccaaaaacctttgaggaggtacagttctttaatagaaataactaccacagggggattgattggtaagatgggttattagtataaatctaaaagtatatgtactgtgcacagtataaacttagcactaatatttagaaacatctaagtttgtagtcacaaataaaatttaacctctgtgccttggaaattgattgaatatcataaaggggctcagaaatttttcagaacaaactcttctcagtttataaagagacttgttataccaagaggatc

SEQ ID NO: 168346 - DNA, 601 bp, Human
ctctctcaaaaaaagaaaagaaagaaaccatcgactacttcagctgtatttgatcactgactcaaatatacatgccagtatataattatagaataaaatgatattaacatcaggactaaaaggactgaataaaaactgctttggaggtggacaggaatgtattagtattacattcctgtcaataattggattccctaggatgttttttcaaagaacatatttttgaaaaatttatggtaaaaaattattgcaacagttattcttaattttttaccataaattttacaaaaatatattttgrtcatcatgtggctaggtactctaataggaacaaaaagtccagctgggcacactggctcacacctgtaatcccagcactttgggaggctgaggcgggcagatcacctgagctcaggagttccagaccagcctggccaacatggcaaaaccccgtctctactaaaaatacaaaaattagctgggcttgttggcaggtgcctgtaattcgagctactcaggaggatgaagcaggagaatcacttgaacctgggaggcagaggttgcaatgagtcaagatcgtgccattgtactccagcctggg

SEQ ID NO: 168347 - DNA, 601 bp, Human
ataaaaactgctttggaggtggacaggaatgtattagtattacattcctgtcaataattggattccctaggatgttttttcaaagaacatatttttgaaaaatttatggtaaaaaattattgcaacagttattcttaattttttaccataaattttacaaaaatatattttgatcatcatgtggctaggtactctaataggaacaaaaagtccagctgggcacactggctcacacctgtaatcccagcactttgggaggctgaggcgggcagatcacctgagctcaggagttccagaccarcctggccaacatggcaaaaccccgtctctactaaaaatacaaaaattagctgggcttgttggcaggtgcctgtaattcgagctactcaggaggatgaagcaggagaatcacttgaacctgggaggcagaggttgcaatgagtcaagatcgtgccattgtactccagcctgggtgacagaaggagactccatcaaaaaaaaaagaaaaaaaaaggaaggaaggaaggaaagaaggaaggaaggaaggactgactcagggttgacccaaataacaaataaatgtggagtattgcaaaaaaaa

SEQ ID NO: 168348 - DNA, 601 bp, Human
aaaaaaggaaggaaggaaggaaagaaggaaggaaggaaggactgactcagggttgacccaaataacaaataaatgtggagtattgcaaaaaaaatcccatttttcaggtaaaagaaaatgctgaagttttatgttttatagaagtagaaaaacttaagggaggcaggcatttgcttttaaccctgaattgttaaaacactccagtttgttcactaattctttgaataacctgaatttacattctataaatgtgagcctatttgtggagcttcaaggtctcatactaaaaatatgaaccttktatttacttctctattaatcgaacatctttcaaatgcctgtaagtgccagccactacactagaaaaatgcggacatataggcaaacaagagctgtgccctgccctctccatgagcccctggggcctggcaaaatcaacacattataggtccaagatccagacttgcttgaggaggttttcaaagcctaaactgttccagatacaaaagacttctaggaaggtatggcaggtttaagaagctaaaatttctgctcttttgtgtgatttttgaagcctttttcagaacaagcaagtttgagt

SEQ ID NO: 168349 - DNA, 601 bp, Human
acctgaatttacattctataaatgtgagcctatttgtggagcttcaaggtctcatactaaaaatatgaaccttttatttacttctctattaatcgaacatctttcaaatgcctgtaagtgccagccactacactagaaaaatgcggacatataggcaaacaagagctgtgccctgccctctccatgagcccctggggcctggcaaaatcaacacattataggtccaagatccagacttgcttgaggaggttttcaaagcctaaactgttccagatacaaaagacttctaggaaggtatggmaggtttaagaagctaaaatttctgctcttttgtgtgatttttgaagcctttttcagaacaagcaagtttgagtcaagcttggaccaaataagataccactagacacttgaaataatcttagcactcctggaaccagtgtgagcttctacataagaagcatcctgaaagttggcactctccgtaaatagaatgtacaccagaacaaatagcacatcaaaccttccagaaatttttgtatatctctttctccctaaaagggtgccagaattacatatcaccaacaagccaattccagacaac

SEQ ID NO: 168350 - DNA, 601 bp, Human
atctttcacactatgtgattaaacgtaacaccggcacaatacatttgtagaaaagaaattatttcacttgcaataaagtaaaaaatattttctctaaatccttttaaaatgtctgaactgaacatatcgtctgttttaatacgattttctttttgagtacttgaatttttctctgtacagtgtttctacattgagacacatttgatatagttaggtcgatcactgttgcagtttgatcactctgtgtctacatttttgttattgcttatattttttcctgatattaagcaaaacataaagmaaatgtacttagaaaaacatcttccaaacacattattagtgttctagatatttttctcttcctaactatggaggacaaatgctgtaaagaaaaagccttttatttaggaaacacatgaatttgtgggacacttttaacatctttggtcaccagaatgagtataaaccagaatcttattttgagaaaaatattccttttctaggtatatggatttcttcccagtcccatctaatgtcactaccgactttttgtttgagaagagtgccaattacttccactcagaggaagcccctaaaagag

SEQ ID NO: 168351 - DNA, 601 bp, Human
tctcattgacccttcagaccgagcatactcctggtaccaggtaaggaaaatgcaaataaaatccaacagggagaagtggagtatggacaatggagcattgtttttagcaatacccactagctcaggttttcacaaaagagatttgctagttgtttgatatctacagaaaaatggacaagtttttcttgatttctattgagaaatttcctccactaagtttttgttcttattttattaacttaatcaattaatttaataaaatgtattaatgcaataaaagaaactaaaatataacaaaatwttatgtacttttttatatctatgcttctatatatctgcattttaaggtaataatttaaaatcattattttttcatctaatacttgtgtactctataaagagtcagattgcaacaagttcagacattgaggtttatacagtctccattgcaactctaccattgtatttcgaaagcagccatagacaatatgtaaatgcataagcattcctgtgttccaataaaactttactgaataggcagtaggccatagattgctgaccctggctctaaaacagcttaaatagctacttgtactaaaga

SEQ ID NO: 168352 - DNA, 601 bp, Human
ttctaccttttccaccaagtatctggagaaaagagaaataagccttaattgactccaagaaaaagaagaaaattggagcttggcaaccacttagtccctgaaaaatagagaatttacagaaaaagaaggctttaaggctgcaagctaacaaaatgtcctaaatattacaaataaatcacagtggcaaaatgcaggccttaacaaagtctagtagagtttgtagtccagtgatttgaatctcaattgcagaaaatttgctattcaactagatgaggtaaacatccacaaactcaccactaagcctgaatatttattggccaatttaaagaaaaggtgatttcctcaaacccatgggcctaagcctgagcaatcctgttggattgctgctttctgcattttctgcacaataaatgattctgattcaccgcaaaggttaccattagataaaataatcttggcttttagatatcagggaatgtatgataaaagctgtggatttcagataatgtacatgtcagactttctagtactttcttcatttaaaagagctgataggccttttctaatctaaaactgcattactagatggagcaaaactatt

SEQ ID NO: 168353 - DNA, 601 bp, Human
aactgtcaggttacttgttccttatatactggttatttttcaatttgacattaaccacggaaaaaaaaaacatttcaacagtgtgacacagaaatgtcctaaatcctgtgttaattcctaattgtacaaagatttccctgaaaggaaagtagagaaataaaacagtggtaaatcttaaaacaaaccacaaaccttaaaagaagttatctgaaataaattcgtaaagcctgagcctatttaacaggcaatatggggcttcttggaagtatgaacaggtgagtaactaggtagtttaggaacygactcttctctcatttgtgtaattttcagaaacaatgtcatacagcaagaaatagtccataggtgattgaataagcagagagagatgtactattatcgctcccaaacaaacgtccttttttattttttcatctttgtctttatccactatttgaccctgtcatctctgcttcagagtcctcagcagttaaagcactggtttgatttttctgtttgtttgtatggttttttgctggtttcctccgattttcttaggtaactgactctgtaaggtccatgaccagggaccagtaaggaacta

SEQ ID NO: 168354 - DNA, 601 bp, Human
aaggcagtcactctcggaggtgtgcccatgcctgagactgagtgctgtgtcctaggtgcctctcttacctcaccctagtgctgactctgggcttcacttagcatttttgaagaagacctctatcttactgcgtccatttagaatagttggcaatcagatttaggagaattatatttgttcctaccacatgtgtagagcaactggaagatactgagttggattgggtcatggacctgactcacaccgtaagttggtttttttttaattacatggactgagccttaaaaaaaaactgaaaaagactatcatggaatttttccattgtgtttttcagtataaaactcagttccacagatcgagtagttttccctttttttgtactctttaatatcaatttagaaagtgagaggcaggtttcctttacctttcaacaaactttgcaggaaaaaaagattagcaggaaaacatcaaatactgcttatatctcctacaaatcaaatatagagacacgtaagggaggcattttgctgtagaggacaaaggagtaggtggaactctgcagttttgagcttccttcctaagagtcatttatactttgctg

SEQ ID NO: 168355 - DNA, 601 bp, Human
ccaaaccatatcacaaatgttggcaaatatgtggagaaactagaatcctcatatactgctaatgataatgcataatatatggccactttggaaagcagttttgcagtttcttaaaaactaaacagaatctcactcaacaatccaatttcacttctaggaatctaccccagaataaatgaaaacctaagtccataaaagctagtaagggaatgatagcattattcataatagctaaaaactagaaacaatacaaatgttcttcaactggtgcatggctttgttatatccacacaccaggggrgtttaaaaaaaaaaaaaaaaggaatgtccagaaaagagacaaatgtagagttagaaaaggtttatctgggccgggcatggtgactcattgctgtaatcccagcactttgggaggccgaggcaggcagatcacccgaggtcaggagttcgagaccagcttggccaacgtggtgaaaccccagttctactaaaaatacaaaaattagctgggcgtggtggcgcaggcttttaatcccagctactccagaggctgaggcaggagaattgcttgaacccaggaggtggaggttgcagtgagcca

SEQ ID NO: 168356 - DNA, 601 bp, Human
tgaacacttcctccaaaatgttcactgcctgaaggccttgaaaggagggccccagccatgacaatggttgccagtgcttacataaaaagatagtttccttgctgttccaccagacttcagagaaacactgctgctttctgaatagatgtggggagattttctccatcttctattacacttcttcatttgggctctgaaatagtattacttgtgtcccaaactcataagaccttcaatgaacagcagtcccttcatctatgatggttctccatgaaggaccagacccagtccctcaggccaytgggtaaataaacatgctttcccttctagcttctccttctcattttcatcctgacacacttataccattgcctatgagggtatgcacacagatgcctaggctaggtgccagctacacacacagtttttctcagtgaagcccagcatgacacctgctgcataagatctaattaattagccgacataaaagaaaaacctatttttcttttgattcttaattttagcatgtgtggagttcagtgcttcttagaaaaactttctctcagaagactactcattttaatacacagcatatgtatgt

SEQ ID NO: 168357 - DNA, 601 bp, Human
actttacaaagaggctgtaatatttttaatttctaccaacaattctatttgttccatgtctttgccaacatgggatatttttaaaatcagtcattctactgagtgtacagtgctatttcatttgtaattttaatttgtatttccttaatgatgaatgatgttcagcaaattttcatttgttcattgaccattcatatgtgttctttggtgaagtgtctgttccaatcttttttttttttttgagatggagttttgctcttgttgcccaggctggagtgcaatggcacaaactcggctcacygcaacctctgcccgccaggttcaagtgattctcctgcctcagcctcctgagtagctgggattacaggcatgcagcaccatgcccggctaattttgtatctttagtagagacagggtttctccatgttggtcaggctggtcttgaactcccgacctcagctgatccgcccacctcagcctcccaaagtgctgagattataggcgtcagccattgcacccagcctgttccaatcttttatgcagtttttattgatatttttatcttttatagtgagttatatattccaaatacaagttctat

SEQ ID NO: 168358 - DNA, 601 bp, Human
ctgtaatatttttaatttctaccaacaattctatttgttccatgtctttgccaacatgggatatttttaaaatcagtcattctactgagtgtacagtgctatttcatttgtaattttaatttgtatttccttaatgatgaatgatgttcagcaaattttcatttgttcattgaccattcatatgtgttctttggtgaagtgtctgttccaatcttttttttttttttgagatggagttttgctcttgttgcccaggctggagtgcaatggcacaaactcggctcaccgcaacctctgcccsccaggttcaagtgattctcctgcctcagcctcctgagtagctgggattacaggcatgcagcaccatgcccggctaattttgtatctttagtagagacagggtttctccatgttggtcaggctggtcttgaactcccgacctcagctgatccgcccacctcagcctcccaaagtgctgagattataggcgtcagccattgcacccagcctgttccaatcttttatgcagtttttattgatatttttatcttttatagtgagttatatattccaaatacaagttctatattagatatatttt

SEQ ID NO: 168359 - DNA, 601 bp, Human
gttcatcctaagaaatctttgcctaacccaaggttgcaaaattttctggtttttttccctatgttttctttcagaatttttataattttagctataaattttttatttatttatttatttatttatttattatttttattttttttttttttttttttgagacggagtcttgctctgtcacccaggctggagtgcagtggcacaatctcggctcactgcaagctccgcctcccgggttcacgccattctcctgcctcagcctcccaagtagctgggactacaggcgcctgccaccacgccyggctaattttttgtatttttagtagagatggggtttcactgtgttagccaggatggtcttgatctcctgacctcgtgatccgcctgcctcggccttataattttagctataaatttttaagttttcagcttaaatttttatagtttaggtttagctcaataatacatttcaagttaatttttacatacaacatgaggtaagggtcaatgttcagctttttcatatagatatccaatttttcttgtgaaatttaaaggactaatcctttcccactgacttaccttggcagccattttttga

SEQ ID NO: 168360 - DNA, 601 bp, Human
acattcacttttatatctgagcatacaaattagtgctttatttacagtgaataataatataaaacctacttggagaccagtaaaaaagaaaaggccctaaaccgaaaatcagcaggcctagacttgagtcatgacttgaatattgaagaagtgtatagtacaaggtaaataaaccttgacaaacattttctcccttctcattttgtgttcaactaatacttggcaaatgtttacaagagccaaacagtatgctaaatgctataaaatgggaagaatccttcacagcatatccttaagtgtyagaatgaaacctcaaatgagaaagagttatatgaaatattttggtaagataaaatgtgtattttaatgtgctattattatttattataattatggcataaaaagttcatttaggctgggcacagtggctcacgcctgtaatcccagcactttgggaggctgagacaggcggatcacctgaggtcaggagtttgagaccagcctgaccaacatggagaaactccgtctctactaaaaatacaaaaattagctgcgcatgatggcacatgcctgtaattctagctactcgggaagctgaggg

SEQ ID NO: 168361 - DNA, 601 bp, Human
atcacttgaacccgagaggtggaggttgcggcgagccgagattgcgccattgcactccagcctgggcaacaagaccaagactccttctcaaaaaagagaaagaaaaaagaaaaaaattcatttgtaggtgctattactttaatacagagctcataccaaaagaagaaagtagctctgaaaaaaattaaatggattatagctagagaatcctaaaagtaatcactccatgatacactgaaaccttttctcttctattaccttctagttgtatgatacaagtagcatctaaatccatagacayggaagaaggctgacttgtttttaaaccctacaaagaaaaagaatgacttgtttttaaacccaaaaaaaaatttgaatatttatgcattttttccttccagatgaaggaagtagccttattaatttctattaataggagatgtgctgacaatttttctgttaggaacctggcaaactcacaaatatgacagatgaactcagaatttagaagtatgccaaaagactttatgcaaaggaatatagtaaaaaagaattcagtttctctggttatagattgttatccaaataaaatatttatgta

SEQ ID NO: 168362 - DNA, 601 bp, Human
cctgggcagcaagagtgaaactccaactcaaaaaaaaaaaaaaaaattctatttttttcactgcctgagtcattctgttgtagtaagtgtgccctgggcagtaatgtaagttactgatataatatactaagttttgagctgttaatatgctaataaaatgaaagaagcaatgtatttcccaacatctaacatactagcagataatttaggctttggggaatgtagacacacactttgcagtatgtattcagcacttcctgtttattctgttcagaatggagacatggtgatcacttaatgytacagttttctccatttctataccccacatttttactttaatgcttacttgacatatattaagatttactaataatatttttatttattattagtctagttagtagtttcaatataaccatgcaagtagattttgatttgtaaattttttttagatctcagaaattaaaatatgatttgggatttttcccccacaattaatacattacattaactgagaaccctaagatagtctgaggatcctaaggtgggctaaacttattagaatactttaacaaaaccttgaggactactttttgtg

SEQ ID NO: 168363 - DNA, 601 bp, Human
actcaaaaaaaaaaaaaaaaattctatttttttcactgcctgagtcattctgttgtagtaagtgtgccctgggcagtaatgtaagttactgatataatatactaagttttgagctgttaatatgctaataaaatgaaagaagcaatgtatttcccaacatctaacatactagcagataatttaggctttggggaatgtagacacacactttgcagtatgtattcagcacttcctgtttattctgttcagaatggagacatggtgatcacttaatgttacagttttctccatttctataccycacatttttactttaatgcttacttgacatatattaagatttactaataatatttttatttattattagtctagttagtagtttcaatataaccatgcaagtagattttgatttgtaaattttttttagatctcagaaattaaaatatgatttgggatttttcccccacaattaatacattacattaactgagaaccctaagatagtctgaggatcctaaggtgggctaaacttattagaatactttaacaaaaccttgaggactactttttgtgccttgcctgatagatgcagggtctg

SEQ ID NO: 168364 - DNA, 601 bp, Human
ccatattgggtttatttaagggagtggctgattttgtgaaaataatgtccacaaagcaggtaagagtaaagaggtcttcacagaggtaatgaaaatacaaatgtgtaggagggattagagtgggcagtactgtcaccacaccttttgcctcttcctagtaagaaaaatgccagtacccaagactgtcagtaaaatatcatagcatgtgctaaataaatagtccatatgcttaatacaaattttaatccagatctggtatacttggtacttatttcaacgtagtcaaagtgtatgaaatgtrataaacaaaataaaatgtacttttctctcctcctctccacttagagcaggacatttctgtcaagctactatcgagatcacaacgtggaactctcaaagctgctgcacaaactgggtcagcctctgccatcctggctgagacaggagctgcagaaagtaagatagcactgagagaaaacttgagacttcatcgtccatgtagaacacaccttttccaaagcttccagaagctaccaaaaggcagttgaaaaatatacctcttcaaatgagaaaaaagaacagtttcttccatgtgctggca

SEQ ID NO: 168365 - DNA, 601 bp, Human
aaccaaatataagcagatatgatttaattaaatgtccctttctggcagtgacgacctacccacaggagaacatgcctctcgcaaaagatctccttcatccctccccagaagaagagaagaagaaacacaagaagaaacgcctggtgcagagccccaattcctacttcatgggtgtgaaatgcccaggataatataaatcaccacggtctttagccatgcacaaatggtagttttgtgtgttggctgctccactgtcctctgccagcctacaggaggaaaagcaaggcttacagaaggatgytccttcaggaagaagcagcactaaaagcactctgaatcaagatgagtgggaaaccatctcaataagcacatttttgataaaaataaaaaataaaataaaataaaataaaaattaaatgttcatctgcaatgcggttacttaaacacacattatgaaggaaaaaaaacacaacaggccaagaattactataaatataaggttaagagaactagggcacagtcattataaaccttatagttatgacaaaagtgcttaataaaggctccattaatctgcaattccatctcacacaataaaaac

SEQ ID NO: 168366 - DNA, 601 bp, Human
agaacatgcctctcgcaaaagatctccttcatccctccccagaagaagagaagaagaaacacaagaagaaacgcctggtgcagagccccaattcctacttcatgggtgtgaaatgcccaggataatataaatcaccacggtctttagccatgcacaaatggtagttttgtgtgttggctgctccactgtcctctgccagcctacaggaggaaaagcaaggcttacagaaggatgttccttcaggaagaagcagcactaaaagcactctgaatcaagatgagtgggaaaccatctcaataarcacatttttgataaaaataaaaaataaaataaaataaaataaaaattaaatgttcatctgcaatgcggttacttaaacacacattatgaaggaaaaaaaacacaacaggccaagaattactataaatataaggttaagagaactagggcacagtcattataaaccttatagttatgacaaaagtgcttaataaaggctccattaatctgcaattccatctcacacaataaaaactgctctctttaatcttccaagtattacagagtgcctaacatggaacaatagtgctttacaacagaa

SEQ ID NO: 168367 - DNA, 601 bp, Human
tggtaaaacttcgacaggatcagcatatacttgacaggaaatgcagcatctcataccactcagtacaaagaaaatgtctgccttccctgactttaaaaaagagtagctatgtaaaaacttaactgacgaaaacagaaactgaaagtaaaaatgtctacagcatatatatgtacaacttaatattgtgaacattttcataccacaaaagttttttaaaacttgctttaaacttttaaaaagtcagaaaaaattttggtcaattggaatcggcatgatgagaaatctcttgaaaaccattctmaattccagttcctataaaatcagactccagacaatatatccagccaaagctacgactgccttcgcgcttctgaagaaactatacaccgcagcatgccctactacaaaccagttgctttttcttccaggaagcacgtttaactttttgtttgtttgttcaaggcagtcatactaggcacgaaaagatgaacggagcaaagagtgacccttggccttctccgggttcaaggtaggagttccggctcctcacgccttctttaccaagcaccagccggagcttctcgcttccgcaccgagttag

SEQ ID NO: 168368 - DNA, 601 bp, Human
ctcctgagctcaggcaatcctgcctcggccttccaaagtgctggaattacaggcatgagccactgtacctgtaaacaattctttaagagtctcaggccgagcgaggtggctctcgcctgtaatcccagcactttgggaggccaaggcaggtggaccacgaggtcaggagttcaagaccagcctggccaagatgaggaaaccctgtctctactaaaaacacaaaaattagccgggcgtggtggcaccgcctgtaatcccagctactcaggacgctgagtcagagaattgcttaaacccaggmggcaggccaggcgcggtggctcactcctgtaatcccagcactttgggaggccaaggcaggtggatcacgaggtcaaaagatcgagaccatcctggccaacatggtgaaaccctgtctctactaaaaatacaaaaattagctgggagtggtggcgcgcgcctgtagtcccagctactcgggaggctgaggcaggagaatcgcttgaacccaggaggcggaggttgcagtgagccgagatcatgccactgcactgcagcctggcgacagagcgagactccgtctcaaaaacaaacaaaaccc

SEQ ID NO: 168369 - DNA, 601 bp, Human
tctctaatggcattaatatatttctgactcacactatagttacttctgtaaacaattcttttttttttttggagacaaggtcagcgccaccacacccggctgatattttttaatgtttagtagagatgaggtctcactatgttgcccaggctggtctccaactcctgagctcaggcaatcctgcctcggccttccaaagtgctggaattacaggcatgagccactgtacctgtaaacaattctttaagagtctcaggccgagcgaggtggctctcgcctgtaatcccagcactttgggagkccaaggcaggtggaccacgaggtcaggagttcaagaccagcctggccaagatgaggaaaccctgtctctactaaaaacacaaaaattagccgggcgtggtggcaccgcctgtaatcccagctactcaggacgctgagtcagagaattgcttaaacccaggcggcaggccaggcgcggtggctcactcctgtaatcccagcactttgggaggccaaggcaggtggatcacgaggtcaaaagatcgagaccatcctggccaacatggtgaaaccctgtctctactaaaaatacaaaaattag

SEQ ID NO: 168370 - DNA, 601 bp, Human
aaaatatgtgaacaaatgaatgagatggttgcaatccgtggtttatggagtccagactttacaacaggtaacatgtcatatagtagtgcttttggcctggcgtggtggctcacgcctgtaatcccagcacgttgggaggatgaggcaggcggatcacctgaggtcaggagttcgagaccaggctggccaacaaggtgaaaccccgtctctactaaaaacacataaattagctgggcgtggtggcaggtgcctgtaatcccagctacttgagaggctaaggcatgagaatcacttgaacccrggaggcggaggttgcagtgagccgagatggtgccactacactccagcctgggagagtgctaagcacaagttacttccaaatctctactaccagtttcacctctttcctaactaatttaaatgtttgctgaacatttccacttgcatatcctattagcacttaacacttaacgttttccagtttgaaatattatctctttaaatccagccaccttgcaaaattgacttcatctcctgccattccaatttcagttttaatttaaaacatctcaaatcttccagtgttcccaacatacgaagt

SEQ ID NO: 168371 - DNA, 601 bp, Human
ctgcctggaaaataatagctaacaaggggataacgtgttcatttcataaaccttccttggaacatcatagaggactaattaacccagaccagatcctacagaacagctttcctccactccttacctatgtgagcatcaatctctacaattttctcaatgctgctgggctccatcagtggggaagtaattctcttctccacagctaggcacacaccctctgatgtctggatcccaatggctgtagaaccaagctaaagagaaacatgttatgattaccatatataggtcaaataactgtctyacatactcaccagatagctctctgtaaatcttcacatgatagaaacttcaactggccacatcttataggcagagagaaggagcaccctaacatactgtaagtaattaatatactattcctgtcaatagcaagaacattgatttacagaattttgtgattctaaaaagttcttttttctcccttaaatttttttaaaatttttaatgttttctttataatttacccatgtaattcccagaaccccaaaagagtaagttcaacaaagtctttcaaacactggaaaaatccactctctaatgc

SEQ ID NO: 168372 - DNA, 601 bp, Human
ttctatgtctggagaaaccagacattttaaaaactgtttaagaaaattagtaccttccttagggatttagaagtatagtatgtataaatatggtacttgtttatgcctatcttagaaatatttgaggatgaggatcagatcaacattccagagcaaagttctaaaacataccctgactatagtaacaagttacttctaattccttccagaattagcactggttccaataggggaattcttcatggaatccccaaatttgtgcaaacggtatagaatcactaaactttagtattagaagccrtatatatatgtatatacatacacacacacacactctacaatagccctttttacaataatctttttttaatgtattttttaaagagatggggtctggctctgttatccaggctggagtgcagtggcatgatcatagctcactacagcctggataacaactcccaggctcaagagatcgtcctgccttagccttcaagtagctgggactacaggtgtgtgctaatacctggctaacagtctacaataatcttctcagtctccaccccaaattaaaataattccctgcaaaagcatgggggaa

SEQ ID NO: 168373 - DNA, 601 bp, Human
caataaaacagccaggtgcagtggctctcacctatagtcccaggtactcagtaggctgaggcaggagaattgcctgaggccaggagtttaagaccagtctgggcaacacagcaagaccccatctctaaaaaaattaaaaaacattaaccaggcatggtgtgtgcacctgtagtcccagctactcgagaggctggggtgggaggactacttgaactcatgagttcaagaccagtctaggcaatatagccagacctcatctcttaaaaaaaaaaccgaaaaaaatccaacaataaaacagaargtacctcaatgtttgttgcattcagcttctcctccattacttgtttgaggatgatgagtgaagacttgatggcttctttcaaagtcatagacttgaaacaaagaaggcaagaagatgcctattaattatgcacaatccgtccttccttcaaagattttccctttatctcactgaaaaaagtatttagcaagtatgtcaaacatcttacttagtatggtgcattacaagtatctccagaactcaagtaaatggcaaataagtagaatacattttttcaggaaaaaaaacccccaaacctta

SEQ ID NO: 168374 - DNA, 601 bp, Human
ggagcgcagtatcacaatctcagctcactgcaacttccaaatcctgggttcaatcaattctgatgcctcagcctcccgagtagctggaactacaggtgcgtgccgccacacctggctagtatttgtatttttggtagagtcggggttttgccatgctggccagactggtctcgaactcctggcttcaagtgatctgcctgccttggcctcccaaagtgctgggattacaggcgtgagccacctcgccaggcctcattctttaactcactgaattctggcttctgccagcaccactttactraagctgcttattattcaaaggctgttaataatttcttaggaactaaacatacaaaaatgtcatttccatgatctatgtagtcttcagcaatgccagctatgatatctgaataaaaaacaataaaacagccaggtgcagtggctctcacctatagtcccaggtactcagtaggctgaggcaggagaattgcctgaggccaggagtttaagaccagtctgggcaacacagcaagaccccatctctaaaaaaattaaaaaacattaaccaggcatggtgtgtgcacctgtagtcccagctact

SEQ ID NO: 168375 - DNA, 601 bp, Human
gtgtaggtattgtaaaaactttatttatttattatttattttgagacagtgtcccgctctgccctcgggctggagtgcaatggcgcgatctcagctcactgcaaccttcgcctcccgggtttaagcgattctcctgtctcagcctcccgagtaactgggattacaggcgcgcgccaccatgtccggctaattttgtatttttactagagacggggtttcaccgtgttggccaagctggtctcgaataacctcgtgatccgcccacctcggcctcctaaagtgttgggattacaggcgtgarccaccgcgccagaccaaaacttttgattcttctcatccttttgggtatttattatgagatatccttataataattccttataataatatttactattatgaggcactcttatgtctaggtttggctataagccctaaaaggctgaaatcataagcagtaattgtttactaattctccccagctttaaataagagcacaccaagtctttcaaagctcaagaaaactaaatggataaaatcatttaaaacactcagctctttgaatgcctgaattccctctacaaacatttctgctaagcag

SEQ ID NO: 168376 - DNA, 601 bp, Human
cgtctcaatccagcacccaaacttaaccattatttgctatgctgatcagacaacagtgtaggtattgtaaaaactttatttatttattatttattttgagacagtgtcccgctctgccctcgggctggagtgcaatggcgcgatctcagctcactgcaaccttcgcctcccgggtttaagcgattctcctgtctcagcctcccgagtaactgggattacaggcgcgcgccaccatgtccggctaattttgtatttttactagagacggggtttcaccgtgttggccaagctggtctcgaacaacctcgtgatccgcccacctcggcctcctaaagtgttgggattacaggcgtgaaccaccgcgccagaccaaaacttttgattcttctcatccttttgggtatttattatgagatatccttataataattccttataataatatttactattatgaggcactcttatgtctaggtttggctataagccctaaaaggctgaaatcataagcagtaattgtttactaattctccccagctttaaataagagcacaccaagtctttcaaagctcaagaaaactaaatggataaaatcatttaa

SEQ ID NO: 168377 - DNA, 601 bp, Human
taaaactgtctatcaggtattatgttcactatttggatgatgggttcaactgaagcccaacctcagaatcacacaatatatccatgtagcaaatctgcacaagtaacccctgaatctaaaatttaaacaacaaaaacaattatttatcctattcaggaccaacgatgggcctaggcattatgaaagtgggcacaagagtaaaagctaatgagacaaatataaactgcattgactcaaaaaatttacctaagagtataccgtatgctttacccttattgctttatttaatcttcttgaaaaygcagcaattattaacattatctatagatgagaaggctgtcacttagaaatcatttgcccacattggtgctgctaataaagaacttgaccgaaatatagatgcaagcaccaggcacacttctaagcggtctatattattatctcattgacttctctcaatatccccattgagtagatactattactatcgtcactgcacagatgaggaaactggctcagaaggttaagttgccaaaggtcatttgaacccagagtcgtctcaatccagcacccaaacttaaccattatttgctatgctgat

SEQ ID NO: 168378 - DNA, 601 bp, Human
caataattcaataatggtcaggtttctgcaatgtctgtaaaatccctgtatataatacaaaccctcaggagagggtgatatttactgaggctctacttctcaataaatatgctttatttactcattcaatagttatttatcctatttagggaacacttatacactgttgatggaactgttaagttagttcagcctctgaactaacagagttcacagatttttcaaagaactaaaaacagaattaccatttgactcagcaatcccattactgggtatatacccaaaggaaaataaattattytaccaaaaaaacatctgcactcgcatgtttaccacagcactattcacaatggcaaagacatggaatcaatctaggtgcccatcaatggtgcactaaagaaaatgtggtacatatacaccatggaatacgacacagccataaaaaagaacaaaatcatgtcctttgcagtaacatggatgcagctagaggccattatccaaagtgaattaacacagaaatagaaacccaaatacagcatgttctcacttacaagtggaagctgatcactgggtacacacggacttaaagatgggaacaaca

SEQ ID NO: 168379 - DNA, 601 bp, Human
ttaggattctggaggcccttctcatatcaactcaccacttgtttatttctttccccctaactctttcacctgcattatgcctttttgagtaagaaatacttgttattgctgaatgggacaaaaaaatcaagaaaggcatcatcaggaaaacaaaatggattataatgaaaagcattcagattatacaagactatgtatacatgcatactataggcccagcataaaatatattcgtaacagtcgatatatccttataattcagaaagttttactatttggattatataatcttaaatttttytgtttcattcttgcttatgggaagaatctggaatgttctactgaaaattacatgtaatttagaggcatttagcatttggctgagttttgtttcgttttgagacaggatctcactctgtctcctgggctgcagtgtagtggcgcaatctcaaatcactccaacctcagcctcctgggctcaagtgatcctcctcccacctcagcctctgaagtcactgggtccacaggtgcgtgccaccgcaccaccatgtatttctagtacagatatagtttcactatgttgcttaggctggtctggaac

SEQ ID NO: 168380 - DNA, 601 bp, Human
ggcaagaggatggcttgaactcaggagttcaggaccggcctgggcaacgtggcaagaccctgcctctactaaaaatacaaaaaaatagttgggcatggtactatgtgccgggggtcccagctactcgggaggctgagccttgctgcagtgagccaagatcgcgccacatcacttcaatctggtgacgtagcaagactctgtctcaaaaaaaaaacaaaaaacaaaaattcaatcccccaaattcttttttttttttgagacagagcctcgctctgtcgcctaggatggaatgcagtggtgygatattggctgactgtaacctccaccttctaggttcaagcaattctcctgcctcggcctccctagcagctgggattacaggtgcccgccaccatgcctggctaatttttgtattttagtagagacggagtttcaccaggctggtcttgaactcctgacctcaagcgatccacccgccttgaactcacagcagagtgctgggattacaggcacgagccaccaccggcccaatcctccaaattctaaggatgagttaattaaaatttgaataactgtattttcctcatctttcttgccccaa

SEQ ID NO: 168381 - DNA, 601 bp, Human
cttgacagcattatggtaagtgaaataagccagtcacaaagagactaatactgcatgattccacttatgtaaggtacttagagtagtccagatcatagaaacagaaaatagaatagtggttgccaaggggtccaccttggggaaagggaaaaatggagagttattgtttaatgggtatagaattttagttttacaagataaaaaatgttctagagatgggtggtggtgatggttgcacattatgaatgcatttaataccactgaactgtacactttaaaaatgttaaaatggtaaattggaaaaaaaaaaaaaaacaaagatgacttaaacatagtccataactgcaagaatttaccacgcttgacaaatacaagctatgctaatagttgatcaacctaaatcataagatctgaaatctgcattgctccaaaacccaaaactttttcagcaccaatgacactcaaagcaccaatgacactcactgcagcattttttatttcaaccagtaagtataatgcaaatataccaaaatctgaaaaaaatctgaaatctgaaacacttttggtcccaagcacttcaaataagggatactcaacctgt

SEQ ID NO: 168382 - DNA, 601 bp, Human
ttgggattacaggcgtgagccactgtgcccagctggtcactaatttcaaataactcttcagggcctccctggccaaatctggagttatctgagcaccaaaataattaagtaatgaattatgtacaattaaaaatataggaatccatgagttcatactgatactaaatagataaataaatggggaaagggagggaaggctctttcttaaagtagaatgccaagcgttgagtagtaaatgtagacaaaatgctagagtagataatcatcattttgaaacattatagtaaagattgcttcagawaaaaattaacaatgaatactaaatttagagaaaaatttgtatgaggagcaagatatctgcatggtcttaaaatgttatccgcacagactgttgatgagttgcaagggaaataacagtaactacacagtggagaaaatggataacatcttcatcaaatgatcaaaattaacattagcagtgaggggcttaaaggcattgtgtaacactagatgcgatgccctgtgaaaaaacatcagacatatccaaaatgaagaatgttctattaacaaaagggaaagattcacataccaagaatatgtg

SEQ ID NO: 168383 - DNA, 601 bp, Human
agcttggtttgcggggaggctatgtactgggaagtagcagaaaaatcaaactgaactggtagagcgcatcctagggtacaacagataatgggatacaatagggaaccactgcaaatattcagtaagagaatgacatgatgacatgggagctttaagaataagtttggaaacaggccaggtggaatggctcaagcctgcaaccccagcactttgggaggctatgggaaaggatcccttgaggccaggagtttgacaccagccctgacaagagagtgaaacctcatctccacaaacaaaaaaragaaagaaatagtttggaaacagtatagagatgacttggaaatggaagtataaaaatgggaaccctagatagaaagtacccattacttataagtaatccaaatttgagatgacaactgagatgataaaggaaaccaagagaaagagatgtatacaagaaagtaactatggttatgtctcatgacagactagataaaggcagataagagaaaaggaagacacaagtatgactctaatgtgtcaagactggatgtcgttaatagcgatgctagtaaaagtctatcaagttgggagaaataat

SEQ ID NO: 168384 - DNA, 601 bp, Human
cgagactctgtcaccaaaaaaaaaaaaaaaaaaagtacatctataaaatgctagtcatcaaaaataatacaagtttaaatgtactaacatgaaaagatggcaaagatatatcattaagttaaaaaaaaggaagttagatagcactatgtataatgatacagttttggcaagcaaacaatacagacgtaacatgtaatacatatttatttatttttttttttttttgagacggagtctcactctatcgcccaggctggagtgtagtggcacgatcttggctcactgcaacctccacctcccrggttcatgtgattcttctgcctcaacttcccaagcagctgggactacaggcacatgccaccacacccggctaatttttggatttttagtagagatgggattccaccatattggccaggctggtctcgaatacctcacctcatgatctgcctgccctggcatcccaaagtgctgggattacaggcatgagccaccgcgcccagcccctacacatacatttttactatttgcacagaaaaatatcctggaatcatgttcaccaaacaatcttcagagtaggattaatcagtgagctttcaca

SEQ ID NO: 168385 - DNA, 601 bp, Human
gctgggattacaggtatccgccaccatgcccggctaattttcatatttttagtagtgacagggtttcaccatgttggccaggctggtctcgaactcctgagctcaggtgatccacccgcccaggctggtcttgaactcctgggctcaagtaatcctcctgcctcagcctcccaaagtgctgagcccctgcactggcctaagctatattttttttaaaaagaatgaagagctacaccaagactaagaaggattttcatgaaatactgttgaatgagaaaaccaaaatgcagagtatgtatayaatatcctatttttgtaaagcaagcagcccattaaaccttgcatatgtatatatacatattccttttaatgtggcatgagaacatgttaacacaagtaacttaaagggggaaaggtacagcaagcaaaagaaaccctgcactttaaaaaatctcctttatgggccaggcgcagtggctcacattttattattctccttttacagatgaaggaactaaagcacagaaggttaggtaacttgtccaagattacacagctagttagtatctaaaccagaatttaaaattgggcaatctggctc

SEQ ID NO: 168386 - DNA, 601 bp, Human
tcacgcctgtaatcccaccactttgggaggctaaggcgggcggatcacctgaggtcaggagttcgagaccagtctgaccaataggaagaaactcggtctctactaaaaatacaaaattagctgggcatggtggcacatgcctgtaatcccagctcctcaggaggctaaggcaggagaatcgcttgaacccaggaggcggaggttgcggtgagccaagatcgcgccattgcactccagcctgggcaacaaaagcaaaactccgtctccaaaaaaaaaaaaaaggtagcgctctaagtttccstctcacacaagaatcaaagcagttctattctcattggtcttaaaaagtggaagtgaaagatttcagctgaagaaagtataagagccatctgtcttatatcaactggtgaataaacaaaatgtggcatatccaaacatggaatactactcagcaataaaaggaactactgatacatgctacaatatggatgaacctcaaaagcatgctaatggatgggaggctgaggtgggaggatcacttaaggtcaggagttcgagaccagcatgggcaacatagtgagaccctgtctctaaaaataaa

SEQ ID NO: 168387 - DNA, 601 bp, Human
ggttaaaaaaaaaagtattcttaaacactgcaagtttttattccttttaatatcacctggatacagcatttatatacacagtctctttctttctttttttctgagacaaagtcttgctttgtcacacaggctggaaagcagtagtgtaatcacagctcactgcagcctcaacctcctgagctcaagcaatcctcccacataaggctttcaagtagctgggagcacaggcacatgccaccaagccggggtaatttttaaatttttttgtggagacagtctccctatgttgccagggtggtcwcaaactcctgagctcaagcgatcttcctgcctcagcctcccaaagtgctggaatcaaaggcatgagccaccacatctggcctatatatacattttcttagattatgctttacatcggtggttttcaaactatattccttggagcctaggtttctaaagaggtacccaggctgggcatggtgactcacgcctgtaatcccagcactttgggaggccaaggtggacagatcacctgaggtcagaagtttcagaccagcctggccaacatggcaaaaccctgtctctactaaaaatacaaaaa

SEQ ID NO: 168388 - DNA, 601 bp, Human
gcatcttttcatatatttaaaaaatgtttttccttttctgtgaccatccatctgttctgcccatttttctactaatttatttttatctttttctaggagctctttatgtattaagaagacaagccctttgtctatgagttgcaaatctttttcccaagtttgttgtgttttgactttgcttatggtgtttatttcattgtgcagaaattttttgtttatataatctttttttaaattaaaaaaattttttttttcgagagtttcgctcttgttgcccaggctggagcacaatggcacgatytcggctcacggcaacctccgcctcccatgttcaagcgattctcctgcctcagcctgctgagtagctgggattacaggcatgcgcccccacgcctggctaattttgtattttttagtagagatggggtttctccatgttggtcaggctggtctcaaactcctgacctcaggtgatcaactcaccttggcctcccaaagttttgggattacaggcatgagccaccgtgcctggccttgttgatataatcttatcaatcttttcttccatggctcctagaccttaagtcataacaaaaaaaaa

SEQ ID NO: 168389 - DNA, 601 bp, Human
cacctaaagattgagcatcttttcatatatttaaaaaatgtttttccttttctgtgaccatccatctgttctgcccatttttctactaatttatttttatctttttctaggagctctttatgtattaagaagacaagccctttgtctatgagttgcaaatctttttcccaagtttgttgtgttttgactttgcttatggtgtttatttcattgtgcagaaattttttgtttatataatctttttttaaattaaaaaaattttttttttcgagagtttcgctcttgttgcccaggctggagyacaatggcacgatctcggctcacggcaacctccgcctcccatgttcaagcgattctcctgcctcagcctgctgagtagctgggattacaggcatgcgcccccacgcctggctaattttgtattttttagtagagatggggtttctccatgttggtcaggctggtctcaaactcctgacctcaggtgatcaactcaccttggcctcccaaagttttgggattacaggcatgagccaccgtgcctggccttgttgatataatcttatcaatcttttcttccatggctcctagaccttaagtc

SEQ ID NO: 168390 - DNA, 601 bp, Human
ttcagaaacttggtaaaattgcttggtttgtagcaagggaccaaaccgcccagagcaagaagtttaggaacacgcttacctaggtggcatagctctgctatgaataggacccactggattctcaccagtgaagggccagttactatgaaaaaggtgctgacatttgttctcaaattgaaattcatacagcgattaaataaaagatgtgagaaattacaagagcacctgatttagcataatcctccattctattatctaaaattaagacatgaaactatgattatgcgtattagcgtttttkttttttgttttttcttgctgagtttaaaaataaaatctcatctgttgtaatgtaagcccttatctgccacttgccccttaaaaagcaggggaacctaccttctgcaggtatgccagccaatgtagcacaatttttaaaattaagggttcatctttttttttttttttgagacggagtctcatctcactctgtcctccaggcttgagtgcagtggcgcgatctcggctcactgcgagctccgcctactgggttcacgccattctcctgcttcagcctccggagtagctgagactacaggag

SEQ ID NO: 168391 - DNA, 601 bp, Human
agtatgaaacactctggacaaatagatgttatttccttcacaaatgagactataaaaattaatcaggtttaaaaaatcatggtagctcagtctaatttgaaactcatgctttctctagaagcagctattttgagtgcttttttttatttttatttttttgaaacggagttttgctctgtcacccaggctagatagagtgcagtggtgtgatcttggctcactgcaacctccacttcctggattcaagtgattctcctgccgcagcctcctgagtagctgggattataggtgcctgccaccrtgcctggctaatttttgtatttttagtagagacaggtttttcgctttgttggccaggctgctcttgaactcctgacctcagatgatctgcccaccttggcctcccaaagtgctgggattacaggtgtgagccaccgcgcccggccttgagagcttttaaaaaattatttattactgctggccaggctcggtggctcatgcctctaatcccagcactctgggagaccgaggcaggcggactgcttgagtccaggagttcaacaccagcctgggccacacgcagaaaccccgtctctacaaa

SEQ ID NO: 168392 - DNA, 601 bp, Human
gaggctgaagcatgagaattgcttgaacccaggaggcagaagttgtggtgagccaagattgagatagcaccattgcactccagcctgggtaacaggatgagactctgtctaaaaaaaaaaaaaattagatgctagtatgtttctcaatctgaaagagtatgaaacactctggacaaatagatgttatttccttcacaaatgagactataaaaattaatcaggtttaaaaaatcatggtagctcagtctaatttgaaactcatgctttctctagaagcagctattttgagtgcttttttttwtttttatttttttgaaacggagttttgctctgtcacccaggctagatagagtgcagtggtgtgatcttggctcactgcaacctccacttcctggattcaagtgattctcctgccgcagcctcctgagtagctgggattataggtgcctgccaccgtgcctggctaatttttgtatttttagtagagacaggtttttcgctttgttggccaggctgctcttgaactcctgacctcagatgatctgcccaccttggcctcccaaagtgctgggattacaggtgtgagccaccgcgcccggcc

SEQ ID NO: 168393 - DNA, 601 bp, Human
aaaaagcaatgcacattcaaaagtgcaagaactcaatatcttcttgtttccatacattagcaataatgctgaaaatttgaatttctgttcctgtattaccattattcttttaaaataccattccaatttttccatctaaaaatcctacttcagtggcagtttaaaggttgagagaataagggtaatcaactataaatcagacattctctgttgctttttctggtaggtagtattaaaatagacatttaacactttaaaatgtaaaatggaccccccaggccctgccaccctctgccccccmaaaaagttgattttggaaaacttccaaataaaaaaaaaattcccattacaatgaaatcagatttttttttttcattttcacagatggattccattccctgccatcccccaaaccctgaaaattacctgtctggatgtgtctccttcgctactaagctattatttggtcccaaaagttctaaccaataagagatggctttatgtctagctaatatcatggcgacaagtggtccagaactcatgtaagctgttaagttggggaaaaacatttttccatacttttccacataaaagttactac

SEQ ID NO: 168394 - DNA, 601 bp, Human
ccagctactcaaaggctgaggtgggaggatcacttgagcccagaaggtcgaggctgccatgagtcgtgatcatgctactgcactccagcctgggtgacagactgagactccatctcaaatagataaataaataataaaagctaacgagcaaaagtctaattcacttgtaagactaatataaagtgctaccatattaaaaagacctctcgctgggcacggtagctcactcatgtaatcccagtgtttggggaggctgaggcaggaggactgctttgagaaaaaatatatatttctaaaagtrgtttttgtttgtttgtttaagaatcagggacttttcagactgtacagaaaggagggaagcaggtcttcccctgggaggatgactgaaaggccagtggagaaaagttgtcagcccattgtcaggtcagcatcaggccgttaccgaccctgttggcactaaaaagtaacagatcaagtattcaaaatgtgaaatgtatttattttgaattcagaaattcaaacaacagtgatactgttgtatcacatcagttattcaaaacatgtgaaatctccaaaaaaaagaaaaaaaatatatcaggaa

SEQ ID NO: 168395 - DNA, 601 bp, Human
aggcatgatggttcatgcctataatcccaacattttgggaggtagaggcagcagtattgcttgagcccaggagttcaagaccagcctgggcaacgtagtgagatttcatgtctatagaaaatataaaaattagccgggcgtggtgatatgcgcctgtggttccagctactcaaaggctgaggtgggaggatcacttgagcccagaaggtcgaggctgccatgagtcgtgatcatgctactgcactccagcctgggtgacagactgagactccatctcaaatagataaataaataataaaarctaacgagcaaaagtctaattcacttgtaagactaatataaagtgctaccatattaaaaagacctctcgctgggcacggtagctcactcatgtaatcccagtgtttggggaggctgaggcaggaggactgctttgagaaaaaatatatatttctaaaagtggtttttgtttgtttgtttaagaatcagggacttttcagactgtacagaaaggagggaagcaggtcttcccctgggaggatgactgaaaggccagtggagaaaagttgtcagcccattgtcaggtcagcatcaggccgtt

SEQ ID NO: 168396 - DNA, 601 bp, Human
gcctcacaaagtgttggaatcacgggtgtgagccaccacacccagactgtatatttattttcaaatataatcattttgatagcagggatatcttcttattcagctttgcatttatggcaaatagtaggcaacttaataaatttgttgaagaaatggaatatagcaaaactttgaattagccatttatattaaaagggaaaagagaccagcctgggtaatgtagtgagaccccatctctacaaaaaaattaaaaaattagccgagcatggtggtacacacctgtagtcccagctactcaagrggctgaggtaggaggattgcttgaggacaagagtttaaggttgtagtgagctatgattgcaccattgcattccatctggagtgacatggagagaccctgtgaccaccccccagaaaaaagggaaagaagagagcattacttttttcttttcttttctttcagacagtctcactctgtcacccaggctggagtacagtggtacaatctcggctcactgtaacctctgcctcccaggttcaagtaattctcctgcctcagccttctgagtagctgagattacaagcgtgcgccaccacgcct

SEQ ID NO: 168397 - DNA, 601 bp, Human
ttctctcatccttgttttatttatttatttgtttgtttgtttgagacagggtctcactctgttgtccaggctggagcactctggtgccatcacagctcaaacagccttaacctcctaggctccagtgatcctcccactttagcctccagagtagctgggactacagacatgggccaccatgcccagctaattttttattttttgtagagatgagatcttgctatgttgcccaggctggtctccaactcctggactcaagtgattctcccgcctcagcctcacaaagtgttggaatcacggstgtgagccaccacacccagactgtatatttattttcaaatataatcattttgatagcagggatatcttcttattcagctttgcatttatggcaaatagtaggcaacttaataaatttgttgaagaaatggaatatagcaaaactttgaattagccatttatattaaaagggaaaagagaccagcctgggtaatgtagtgagaccccatctctacaaaaaaattaaaaaattagccgagcatggtggtacacacctgtagtcccagctactcaaggggctgaggtaggaggattgcttgag

SEQ ID NO: 168398 - DNA, 601 bp, Human
atttaggggttttttggatattgatttgtaagagttccttatatattttagacattaaccccttatcagatacatggtttgcaaatattttcttccctggaattgttttcttaatttcattagtgaattattcatttatttatttattgagagggtctcactctgtcacccaagtgaagtacagcagcgcaaatgcagctcactgcggcctcgacctgctgggctcaagtgaatctcccacctcagcctcccaagtagctgggaccacaggtgtacaccaccacccccagctaattttttwatttttggtagagacagggtcttgccatattgcccaggctgctctcaaacttctgggctcaagcaatcctcctgcctctgcctcccaaagtgttgggattacaagtgttagccaccatgccaggctagggctgaataaattaatgagagaataaaaagagtgttttcatgtttcttacatggatgaactttaagttttttaagttttctctcatccttgttttatttatttatttgtttgtttgtttgagacagggtctcactctgttgtccaggctggagcactctggtgccatcacag

SEQ ID NO: 168399 - DNA, 601 bp, Human
taatttttgtacgttgagtagaggcagggtttcaccatgtcggccaggctggtctcaaactcctgatctaaggtaatcctcctgtctcggcctcccaaagtgctaggattgcgggcatgagccaccatgctcggccctaatttctgtatttttagtagagatggggtttcaccatgttggccaggctggtcttgaactcctaacgtcaaataatctgcctgcctcagcctgccaaagtgctgagattacaggcatgagccactgcaaccagcctgttttctttttcttttcttttctttattttttttttttgagacagagtttcactcttgtcacccaggctggagtgcagcagcacaatctcagttcactgcaaccccgtctcccaggttgaagcaattctcctgcctcagcctcctgagtagaaccagcctcagttttcagttgggatgtttctcttattatttagacataggagttctttatatattctagttacaagttctttatattatttggtgatattttttcccagtctgttgcctacctatcttttcatatttttaaaaatttaacttctatttttttttttgacacaggg

SEQ ID NO: 168400 - DNA, 601 bp, Human
tgtcagctgcaaggttacatgtatctgggtagagtgtgctgggctttcccgagatggatcaatagagatgccagaatgcttgccatctgagcatacctgtctccaggtccagtttactcttttggaggatggtggcagagcatgggctctgtgtaaggaaaatgttatagctaaagtagtcattaatgtttctctgtggtaactggttcaatttccatttcctctccattttccgttaaaacaatcagggcccaggaaaatgatgtggtttctcctttttatgttacaaatgacacgcaargtccagagggatgaagcaacctttcaatgccacgcaccactttgtctaaggcagttgaggaagggaagtagataagatggagcttagtgggagagcagctaaaatcctaagggaagagagtaactttagttcagagcagatggggaaatgagagattgagtaggaggcctaaggttaagggaagcagattgtcttagttgctgtcagtggctgatggggaagattgtctgttggtagaaggaagtcagaatatagatgtagagggataagtttgctaagaacagagatcagcaaatggct

SEQ ID NO: 168401 - DNA, 601 bp, Human; identical to SEQ ID NO: 23252

SEQ ID NO: 168402 - DNA, 601 bp, Human; identical to SEQ ID NO: 23253

SEQ ID NO: 168403 - DNA, 601 bp, Human; identical to SEQ ID NO: 23254

SEQ ID NO: 168404 - DNA, 601 bp, Human; identical to SEQ ID NO: 23255

SEQ ID NO: 168405 - DNA, 601 bp, Human
gcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacctggtctccactacaaataacaaaagttagccaggtgtgctggtgggtgcctgtaatcccagctacgcaggaggctgaggcaggagaatcgcttgagcctgggaggtggaggttgcagtgagctgagatcrcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaac

SEQ ID NO: 168406 - DNA, 601 bp, Human
ttattggccctctctgagcctaagtgggctcatctgtaaaatggaaaaataacactgcctggcacatagagagggatcaaataactgaatctgtcccttcacttccttccagcacccccaacactgtccctgcttccccctccccagccccttcaggcttcagagactcacattctagaagaaaggccaggggtaatggaaaagggaagaggtcctgaccaaagtagaaagggagtctcatggaatcaccctgggcctcctagtccaaagcagaccagaaggatcacatagacatttgcartaatttgcatccgggcatcctacatgtggtacctgaacctgaagccaagtcaaggtcagtgccccagaggggtatgaagtcctcagccttgggcaggaacacagcagagcagccagagttccatgcatttcccagaacctgacactttcccaagtgcctgttcacacttctctccactttacagatgaagtggaggctcagagaggttgagacacttgcccaaagtcacacagccaatcagaatcgatgtcctgaaggcccaggtgcttcattgccctttatcccatagactcagggggt

SEQ ID NO: 168407 - DNA, 601 bp, Human
aaaataacactgcctggcacatagagagggatcaaataactgaatctgtcccttcacttccttccagcacccccaacactgtccctgcttccccctccccagccccttcaggcttcagagactcacattctagaagaaaggccaggggtaatggaaaagggaagaggtcctgaccaaagtagaaagggagtctcatggaatcaccctgggcctcctagtccaaagcagaccagaaggatcacatagacatttgcagtaatttgcatccgggcatcctacatgtggtacctgaacctgaagycaagtcaaggtcagtgccccagaggggtatgaagtcctcagccttgggcaggaacacagcagagcagccagagttccatgcatttcccagaacctgacactttcccaagtgcctgttcacacttctctccactttacagatgaagtggaggctcagagaggttgagacacttgcccaaagtcacacagccaatcagaatcgatgtcctgaaggcccaggtgcttcattgccctttatcccatagactcagggggtccagctctctccctgaggaccagtaggcattggactctcacttcc

SEQ ID NO: 168408 - DNA, 601 bp, Human
tacagatgaagtggaggctcagagaggttgagacacttgcccaaagtcacacagccaatcagaatcgatgtcctgaaggcccaggtgcttcattgccctttatcccatagactcagggggtccagctctctccctgaggaccagtaggcattggactctcacttccaatctggcatttctccccacaggggcccctggcatccggacaggcatccaaggccttaaaggagaccagggggaacctgggccctctggaaaccccggcaaggtgggctacccagggcccagcggccccctcggrgcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacacc

SEQ ID NO: 168409 - DNA, 601 bp, Human
agtataaaggcttccttctgttagtaaaatgttgtaaaatttgatatccttttgaaaacgctttctctatgtgtactgaatttttttctgttgtctgcctttgtttcctgtttttaaagatcttgacttctcatgggtaaattatatacactttaaacagctgaaaaatcagtggaaagtcagaaggggtgacacagggtttgcaagaagtgctgggaggcaaaactccagtagacaagattctaacgagtggtggtctcaatttggtgaagtatgccctacatcttggaatgaggtgacttttttttttttttttttgatattttggccaattattgatcagtacttggaggtctcctgggataccatttgaggtcctgtaacttgagagaaagtagtatgtgtctccacttttcttgtggagctgttcgcttagcagtaatggagctccaaactggttcttaggggcagagaagagaagacctgttatgtttcgagaacaccaacagagtcctttgggggtcactcccacaactgttcttttctttttttctttttttttttttttttgagatggagtctctatcgtccattctatctg

SEQ ID NO: 168410 - DNA, 601 bp, Human
tgttagtaaaatgttgtaaaatttgatatccttttgaaaacgctttctctatgtgtactgaatttttttctgttgtctgcctttgtttcctgtttttaaagatcttgacttctcatgggtaaattatatacactttaaacagctgaaaaatcagtggaaagtcagaaggggtgacacagggtttgcaagaagtgctgggaggcaaaactccagtagacaagattctaacgagtggtggtctcaatttggtgaagtatgccctacatcttggaatgaggtgacttttttttttttttttttratattttggccaattattgatcagtacttggaggtctcctgggataccatttgaggtcctgtaacttgagagaaagtagtatgtgtctccacttttcttgtggagctgttcgcttagcagtaatggagctccaaactggttcttaggggcagagaagagaagacctgttatgtttcgagaacaccaacagagtcctttgggggtcactcccacaactgttcttttctttttttctttttttttttttttttgagatggagtctctatcgtccattctatctggagtgcagtagcgcgatc

SEQ ID NO: 168411 - DNA, 601 bp, Human
tgctgggaggcaaaactccagtagacaagattctaacgagtggtggtctcaatttggtgaagtatgccctacatcttggaatgaggtgacttttttttttttttttttgatattttggccaattattgatcagtacttggaggtctcctgggataccatttgaggtcctgtaacttgagagaaagtagtatgtgtctccacttttcttgtggagctgttcgcttagcagtaatggagctccaaactggttcttaggggcagagaagagaagacctgttatgtttcgagaacaccaacagartcctttgggggtcactcccacaactgttcttttctttttttctttttttttttttttttgagatggagtctctatcgtccattctatctggagtgcagtagcgcgatctcggcttgctgcaccctccgcctcccgggttcaagcagttctcctgcctcagcctcctgagtagctgggattacaggcgcccgccaccacgcctttctaatttttgtatttttagtagaaacggggttttaccatgttggccaggctggtcttgaactcctgacctcaaatgatccacctgcctcagcctcc

SEQ ID NO: 168412 - DNA, 601 bp, Human
tctcttaagtgtgatttaagaaaataatctgtttggtttgagagcttaaccacattcattcaatttctttgttcctgtttttaagaaccgactttcctttaactgtcatctccctcatgcccttgcttctcttctttacatttaaataagctctggaacaatctgttaaaacataagtcagaaaatcagagtaggtacctaaaagttaagtagggctggtcttaaaatgtggcattcttctcctagttggaaagctttgcttttctttttatagatatcatttaattttaaaatttttactgtaaattgacagattatagttgtatatgaaagcattgcttttcaattgtaaattaattctaaagactccagaatttgtgttgggtcttttcccatttagcattgttaaacctcccattttcacaaataacttcgtacaaccgatattagcatatgctttactgaatttgataagggttttatggtctatttacatattaagcatcttgttaaagaagatgtcttagatcatgcagtttgtgcccaataacatgaattttactcataaaattcccagctggctgggtgcagtggctcacac

SEQ ID NO: 168413 - DNA, 601 bp, Human
tttaagtgttcagtgtgatgcattttgctgaccctccaccataataaaatgtgtaacatttttatcacccctcaaattttctgtggtgagttcttttaccactgaatggtgttggcacccttatcaaaaattatttgaccatatatgtgagtgtttatttctgggttccctttgcagtcagccctgtcccttgacctggttccaggcaaccactgatctgctttctttgtttctactgttttgcttttctagggtttcatataaatggaaccatacaatatgtagtcttttgtgtgactakttttacatagcataatgtttgtgagagttgtccatgttgtgtgtattggtagttgtttcttttgattgccgagtgttattctgttctatgaatatatcacagttttgtttatccattaacaagttgatggatgtttgggttccagttttaatactggtgctatgaattgcttccacgttttagctattttgaataatgttgctatcaacatgggtatacagataccttgttgacaccctgctttcagttcttttggggtatatacccagaagtggaattgttggatcatgtttttaattt

SEQ ID NO: 168414 - DNA, 601 bp, Human
ggctaggcacggtggctcacacctgtaatcttagcactttgggaggctgaggtgggcagatcacctgaggtcagaagtttaagaccagcctggccaacatggtgaaaccctgtgtctactaaaaatacaaaaattagcctggtgcggtggtgtgtgcctatagtcccagctactcagaaggtggaggcaggagagtctcttgaactggggaggtggaggttgcagtgagccgagattgtgccactgcactccagcctgggtgatagagtgagactctgtctaaaaaaaaaaaaaaaaaaagaaaagaaaaatcatttgcccacatatgtaagggtttatttctgggttctctagtctattccattgtcttatatatctccctatgccaataccgcactgttttgattattgtagccttgtagtaagttttgaaatcaggaaatgggagtgcttcagctttattctttttcaagattattttgtctattgtcccttgtttcaagattactatcccttgttgggattttgatagggattgcattgagtctgtaggttgctttggataatgttgacatgtcaacaatattaagtcttccagttc

SEQ ID NO: 168415 - DNA, 601 bp, Human
tttaccatatctgagatggagtctcactctgtcacccagactggagtacagtgatgccatctcggctcactgcaacctccgccttctgggttcacgtgattcttctgcctcagccttccaagtagctgggattacagatgtgcaccaccacacccggctaatttttatatttttagtagagatgaggcttcatcatgttggccaggctggtcttgaactcctgacctcaggtgatccgcctgtctcggcctcccaaagtgctgggattacaaggattgatttttaaccatttctgtagcargagtttattattacatttattattgggtttctaatggacacaaagattgaacaccacaaactggtaataaaagcaaataacataatagtaaattcattgctgttctgagtgcttgaagtttgtagaattagctgattgagaatattgcccacatattatattacaaagccatacattttattagataagtaagttgctttttgagtaatgaccagcatgcttttaacactttgaggacaccaagattcagttgctgaattctctccaatatttttcttttttctagggcaagaggattat

SEQ ID NO: 168416 - DNA, 601 bp, Human
attgtactgaatgattcgtagtggtcagggttgtgttaaaacaaaaaccttacaggaaaggttcagataagcataaacttgcaagagacgatgtgaatgattttttttttttctaaacacttaaattttcatctgaatatgtctgatcttttcttgccaattctgacaattgatactatactgtttcttgggcaattcaaccaggatagggaattagtcataataattgagactttaatgtcaaagaaggcagccatggctatttctgccacagttctcaagcgtgctttatatagtgtcyctattcctatatttttggaagtattccttcctcatgcattccggccgtttttgagtgatttaattggaactccttttgtagtttgatgggaaactcagattttgaagatagggagcaatgttagggtatttggaatgggacttgtaactgatgtgtatggtttaaactttttcaccttcatgatatcgctgattccgtcctttgagtactgttctgggggcaaaggaaaaggttatggaaataattagcacaaaagttttatgttctactggtactggtgctttgaagtttgaacactga

SEQ ID NO: 168417 - DNA, 601 bp, Human
tcaaccaggatagggaattagtcataataattgagactttaatgtcaaagaaggcagccatggctatttctgccacagttctcaagcgtgctttatatagtgtccctattcctatatttttggaagtattccttcctcatgcattccggccgtttttgagtgatttaattggaactccttttgtagtttgatgggaaactcagattttgaagatagggagcaatgttagggtatttggaatgggacttgtaactgatgtgtatggtttaaactttttcaccttcatgatatcgctgattcygtcctttgagtactgttctgggggcaaaggaaaaggttatggaaataattagcacaaaagttttatgttctactggtactggtgctttgaagtttgaacactgagcagacatgcctaatagggcaagattgaagggtggaggtttctaataattatattaaactcattatatttatgcttatgttttcaggtaattcattcatttttattgtgtttctaaaaaacactattggattcttaactacgtgtatactagggtaaatggcatatatgattacttattacatatgcactaggtat

SEQ ID NO: 168418 - DNA, 601 bp, Human
tttatgttctactggtactggtgctttgaagtttgaacactgagcagacatgcctaatagggcaagattgaagggtggaggtttctaataattatattaaactcattatatttatgcttatgttttcaggtaattcattcatttttattgtgtttctaaaaaacactattggattcttaactacgtgtatactagggtaaatggcatatatgattacttattacatatgcactaggtatttagtttatagggcctagtgcataatttaatagtaagtttagtacttggttggatatttacrgataaaacttttatgcttaactgggatatccctcaaaataacttcgaggcctagtatcagatgatttaaacataatcttctaatcctcgtttttttgggcagtttagtgctattatagaagcagttatttaaaagtttagaagattttacaccttctcatgcatagcaactgttttgagagttttaaaaaatgcctggtgcttctctgtgtgttttagtaacattcccagaaaagtgtgcctgtgtgtgtatattgggggagacaagggaaagtcatgtgtgaaacactcatgtccatgt

SEQ ID NO: 168419 - DNA, 601 bp, Human
tttttaacttttgctgcttttaaagaatttactgctgtttctgatttattttgtgtctaatgtgacatgtgggtaccagtcctgtgggatgtcatggatgggggcagggtggaggtgggaacacttggggtggtctggggttggcacttacaattggagctgtgttctgggacttttaggacatatttacttgggatcaaactgatcaaactaaagaacatgtgaaacaaccttgggtggtaaacttgtggcttcagatttaggtgattttaggtgagtctgtagacctgggtcctaagtrccaccaatgctgagtcacactgtcatgttggagtttctggctgaggtgtaagtgtatttctgtatcttaatccccgtaagatctgagaatattcttcgttttcactccatgctttatgctctgatacccatgcagacatcttaaagcactggactgcttgctaaaactcattctaggaccccattctttgttttcttatgacttgggtggtggttacttgctctaataacattgctgaataactgaagtgtatgctgtttctagagtctgttctttaaagtccttctagttggtactgtt

SEQ ID NO: 168420 - DNA, 601 bp, Human
aggtgattttaggtgagtctgtagacctgggtcctaagtgccaccaatgctgagtcacactgtcatgttggagtttctggctgaggtgtaagtgtatttctgtatcttaatccccgtaagatctgagaatattcttcgttttcactccatgctttatgctctgatacccatgcagacatcttaaagcactggactgcttgctaaaactcattctaggaccccattctttgttttcttatgacttgggtggtggttacttgctctaataacattgctgaataactgaagtgtatgctgtttytagagtctgttctttaaagtccttctagttggtactgttgcacaattaacactttttaaatgtctgaacctttccgttctgggaaaccagtttactctgaaatcttgattaatcacattcagatatgtcattgaacctagaaacacatagcatgcctgttagtctgctatttgtgtccttcagttattcaggggctgaattcacataagcctgaaattgtaatagatttatttccaaaatgtgttagaagtcaacatattgcattttaataaaaattgctttcctgctcagttaaccttg

SEQ ID NO: 168421 - DNA, 601 bp, Human
ttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtataaatgcctgatgaagctttattcctgttgcactgactggctctaattttacgtatgtatcaggtacccacatttttgctcccttgaatctccttgactctgtctaactggtgkgataaagggagttcaaagtgactatctttgcagctaccataatcaccctctctctctctttgcctgtgccttccatagaataaggatgccactgacccgtgcccgtcctctcagtcctctgtttcatatccaactgtttcatttgaatgcagagctgcttcccttgtttttatgtaaaatgtttcagcagcacattacaaaactcatactgaatgagcaaatgacacatgtgcttgtttgcttcttgtgacatacattggtctgcgcaaagctttctcaaaggaccactgtctcactcat

SEQ ID NO: 168422 - DNA, 601 bp, Human
atacaattgtggttaccttcaaattttgaaattaaaaatatacaaccgtttgtataaatgcctgatgaagctttattcctgttgcactgactggctctaattttacgtatgtatcaggtacccacatttttgctcccttgaatctccttgactctgtctaactggtgggataaagggagttcaaagtgactatctttgcagctaccataatcaccctctctctctctttgcctgtgccttccatagaataaggatgccactgacccgtgcccgtcctctcagtcctctgtttcatatccarctgtttcatttgaatgcagagctgcttcccttgtttttatgtaaaatgtttcagcagcacattacaaaactcatactgaatgagcaaatgacacatgtgcttgtttgcttcttgtgacatacattggtctgcgcaaagctttctcaaaggaccactgtctcactcatgaatatctgctcctctgctcctgaattgctgaatccttccagtgccctggacaaatcttggtgaagtgagattattgtgttgagattcagggttgtttttaatgtttctttctttgccaactcttgggggttt

SEQ ID NO: 168423 - DNA, 601 bp, Human
ggaaaactagcatctagaaagtctgctgacttactcaaggtagcccagtaaatgttgaggctaagaccagaccacggatctcttaccattaaattcaggtggagagggagtgccgctgtggccacagagtcctgtgtttaaacttacctcctgggcaaatgacttctctctgaattgctatttcctcacctgtaagatgggggcaatggtacttttttggggttgtcatggggttcaaatgagactcccagccttgaaaacccctctgtaaaatttggtttattcattcatttaacctacsgttatagagcaactgtctgtaccagtcactctcctcacataatctcatctaatccttacaatcccacaaaatatcttcatccccatttcacagatgaggaggctgacctcaggaaatgtgactcagttaaggtgacaccactactaatggcagatgtgacacgcaaagcacatctctctgtccccagatcccatcttctcaggccctattctctgccactctactggaaaatcggtcttatcttgtgttgtgccaaaccaaggggtagtggctgcttggggggtggagtgagaaggagtc

SEQ ID NO: 168424 - DNA, 601 bp, Human
tctgctgacttactcaaggtagcccagtaaatgttgaggctaagaccagaccacggatctcttaccattaaattcaggtggagagggagtgccgctgtggccacagagtcctgtgtttaaacttacctcctgggcaaatgacttctctctgaattgctatttcctcacctgtaagatgggggcaatggtacttttttggggttgtcatggggttcaaatgagactcccagccttgaaaacccctctgtaaaatttggtttattcattcatttaacctacggttatagagcaactgtctgtrccagtcactctcctcacataatctcatctaatccttacaatcccacaaaatatcttcatccccatttcacagatgaggaggctgacctcaggaaatgtgactcagttaaggtgacaccactactaatggcagatgtgacacgcaaagcacatctctctgtccccagatcccatcttctcaggccctattctctgccactctactggaaaatcggtcttatcttgtgttgtgccaaaccaaggggtagtggctgcttggggggtggagtgagaaggagtctaaagtccatttccaggagca

SEQ ID NO: 168425 - DNA, 601 bp, Human
ggagtgccgctgtggccacagagtcctgtgtttaaacttacctcctgggcaaatgacttctctctgaattgctatttcctcacctgtaagatgggggcaatggtacttttttggggttgtcatggggttcaaatgagactcccagccttgaaaacccctctgtaaaatttggtttattcattcatttaacctacggttatagagcaactgtctgtaccagtcactctcctcacataatctcatctaatccttacaatcccacaaaatatcttcatccccatttcacagatgaggaggctgwcctcaggaaatgtgactcagttaaggtgacaccactactaatggcagatgtgacacgcaaagcacatctctctgtccccagatcccatcttctcaggccctattctctgccactctactggaaaatcggtcttatcttgtgttgtgccaaaccaaggggtagtggctgcttggggggtggagtgagaaggagtctaaagtccatttccaggagcagcaagagtgaaggccatggttgattagggatgtctgccaggggtgagggatagagggagacagcactcattatccctgctctagc

SEQ ID NO: 168426 - DNA, 601 bp, Human
gtcctgtgtttaaacttacctcctgggcaaatgacttctctctgaattgctatttcctcacctgtaagatgggggcaatggtacttttttggggttgtcatggggttcaaatgagactcccagccttgaaaacccctctgtaaaatttggtttattcattcatttaacctacggttatagagcaactgtctgtaccagtcactctcctcacataatctcatctaatccttacaatcccacaaaatatcttcatccccatttcacagatgaggaggctgacctcaggaaatgtgactcagtyaaggtgacaccactactaatggcagatgtgacacgcaaagcacatctctctgtccccagatcccatcttctcaggccctattctctgccactctactggaaaatcggtcttatcttgtgttgtgccaaaccaaggggtagtggctgcttggggggtggagtgagaaggagtctaaagtccatttccaggagcagcaagagtgaaggccatggttgattagggatgtctgccaggggtgagggatagagggagacagcactcattatccctgctctagctgaagaaggacccccacacaag

SEQ ID NO: 168427 - DNA, 601 bp, Human; identical to SEQ ID NO: 39425

SEQ ID NO: 168428 - DNA, 601 bp, Human; identical to SEQ ID NO: 39426

SEQ ID NO: 168429 - DNA, 601 bp, Human; identical to SEQ ID NO: 39427

SEQ ID NO: 168430 - DNA, 601 bp, Human; identical to SEQ ID NO: 39428

SEQ ID NO: 168431 - DNA, 601 bp, Human
gtgcatgcgtgcatgcatgtatacgtgagtgtatgtctgcatggtgtgcgcatgtgtgtgtgcatgtgggggagtctgtgcagccaggcaccccaagagtggggaacactaagcaagcttgtgtggacaaacagcaggtgtccagctgttcctggtcttggccaggcttctctccgtcgttttctttggtctcatgagtggctgggcacatggtggctcagccccccgggcacagtgaagcctggctgttgagatcattggatcccctggacagaggaggtgaaagggaggaggatgtttmtatgcagggatcagagagacaagagcctgtccccagatacccttagtgaaaactggaacggggcccttgtcagctgctgggaatatgcttctagccctttgctgctactatacaggccctggggccacagtgagagggacctttagtcctcatcacccatcccccagcaggcaggcaggaaaggcccctgagcgctaataggactgggcatgacataggctgacagcctcaggtgataacaggtggggatggagtccagctggctccacttaggagccgtcttgcccagagatctctggg

SEQ ID NO: 168432 - DNA, 601 bp, Human
agggggagcaggaacagtgagctcttttgccttcctgactgtgtttaaaatctgatttagaattaatttcctttggttgtccaccagcggacaccttatttgtcaaatctccggctctttgcgggggagagcagagaggtggccagggccacaggcagctgctggcctgacaggcggcctgggcaaggtgccctcagcagggtcaggagcccctcctggctcgcggcccaacacccgggcacgtgcaggctccggaagcaccctgggtcgacaggcagggccgggccccagcccagagccrctccatctgtctcagccattaattcccggcccagcctccaggtctctgggctccctgaggcctggtgattagtattcttattaaagattattttattttcattgcgtggattaatctggccttgacacattatagccatatgggtattagccgagtgtgtgagaactgccgactggtgagccacagcggcgcagccatctctcagctctgggacggtgctgggaggacggggggaaaggccatagctccagaggctcccccgcctgactgcacattctggctctgctgggaacctggggc

SEQ ID NO: 168433 - DNA, 601 bp, Human
aggcagctgctggcctgacaggcggcctgggcaaggtgccctcagcagggtcaggagcccctcctggctcgcggcccaacacccgggcacgtgcaggctccggaagcaccctgggtcgacaggcagggccgggccccagcccagagccactccatctgtctcagccattaattcccggcccagcctccaggtctctgggctccctgaggcctggtgattagtattcttattaaagattattttattttcattgcgtggattaatctggccttgacacattatagccatatgggtattagcygagtgtgtgagaactgccgactggtgagccacagcggcgcagccatctctcagctctgggacggtgctgggaggacggggggaaaggccatagctccagaggctcccccgcctgactgcacattctggctctgctgggaacctggggcaaggcattcaggctccctgagcctctgtttcctcttctgtcgaacaattgtaagaattccaactacatcaaattgttataacaacaagtgccaggcactgccctggcatgaatttatgtgtcttcactcatgtcatgcttgccatctccctc

SEQ ID NO: 168434 - DNA, 601 bp, Human
gagctcagcccccaggcagaccagagccctcttgggatcctctggaggggagggaaagatgttgcaacaatggtgcgtattttcccccactctgcaacttacaagctctttctggctctgcagccttctagagtatgaagcaacttcagggcgttaccatttctcctgactccaggttttctctcaagtttgtagaattttacaaatgaacctggttttagcttttgtaataaagagatacgatcaacatccagagaagaaatgctctgcagtggcctgatgtctttgtaattgaaggttmtctcaggcactgagttttccagaacaggatttagtggagagagaaccacagtgagcttcccagtggtccctgttgcaaaggacttcagttccatggacggagccgggagctgcctggctgggtggcatttggcccacctgaacctctggggtctctgcccagagcagataatggtgggatccattcaatttgaaaactcctgcctggagtttaacagcatctgcccagggctagcactggaccaggttctgggacattgagatgaataagggagtcgtactctgtttgcaaggatctgcc

SEQ ID NO: 168435 - DNA, 601 bp, Human
cctctggggtctctgcccagagcagataatggtgggatccattcaatttgaaaactcctgcctggagtttaacagcatctgcccagggctagcactggaccaggttctgggacattgagatgaataagggagtcgtactctgtttgcaaggatctgcccacgggggcctcccagtctagaaggagagtcagcactgacaagcgagtacagccatagtgttgcaggtggtgaggccaagcaggggccgcaggagcagggcggggaatggtcgtttctctgtgtgtgtgtgtgtgtgtgtgtccgcacgcgtgtgtctagagttccagaagggacagtcaaaattaatcttaaaagaggagctcagtaggtggacagaggagaaaaggcagcccaggaagcgggcacagcctgtgcaaaggccccgaggcaggaatcagactgctgggtgtggggatcggccagtgctttagtttggcctaaggatgggggtgaggggcagcactaaacaaggctccaagtgggttttggctgggcagggagggatttgaacaccaggtttcattgtctaagccctggggagcctgtgaggcatgaaacaggc

SEQ ID NO: 168436 - DNA, 601 bp, Human
catgaacagtggttgactgaatgcatgatcacgcaggcagctgggtggggggaggcagggctggaagccaagtctgcaggctgctgtgggtgagagatgaggtagggtgtggcagtggctggagagagggtcagtcccagccacagtgacggggacagtgacagtgtgggcctgggaggggagaagcctgcgcttcttggatagtcaccctcccatgggggcttgtaaaacagaccccaggtaccggccctggctcttctaactcagctgtctgtggtggggccaggaatctgtatttttrtggaggtggctccatgtctgcctgtgtttgggagcgatgggtcttaccaggtgtcccccccctttctagtcgcattcccagcacccccatccctggcctgcttcctcatcccacccaagtcagttccggggcatttgatcctcagccccatggccctggcccctaggctggcgtcccacgtaagaaccagtgtcccataaaagagagaaggacagcatctccacccctaaagctggagacagggcctgggggaggggtcaattagaggagggctggggaatttggagatgctcaggggtg

SEQ ID NO: 168437 - DNA, 601 bp, Human
ggcagctgggtggggggaggcagggctggaagccaagtctgcaggctgctgtgggtgagagatgaggtagggtgtggcagtggctggagagagggtcagtcccagccacagtgacggggacagtgacagtgtgggcctgggaggggagaagcctgcgcttcttggatagtcaccctcccatgggggcttgtaaaacagaccccaggtaccggccctggctcttctaactcagctgtctgtggtggggccaggaatctgtatttttatggaggtggctccatgtctgcctgtgtttgggagygatgggtcttaccaggtgtcccccccctttctagtcgcattcccagcacccccatccctggcctgcttcctcatcccacccaagtcagttccggggcatttgatcctcagccccatggccctggcccctaggctggcgtcccacgtaagaaccagtgtcccataaaagagagaaggacagcatctccacccctaaagctggagacagggcctgggggaggggtcaattagaggagggctggggaatttggagatgctcaggggtggggctcactttgaggctgggactcccatgtcaggg

SEQ ID NO: 168438 - DNA, 601 bp, Human
gggaggggagaagcctgcgcttcttggatagtcaccctcccatgggggcttgtaaaacagaccccaggtaccggccctggctcttctaactcagctgtctgtggtggggccaggaatctgtatttttatggaggtggctccatgtctgcctgtgtttgggagcgatgggtcttaccaggtgtcccccccctttctagtcgcattcccagcacccccatccctggcctgcttcctcatcccacccaagtcagttccggggcatttgatcctcagccccatggccctggcccctaggctggcrtcccacgtaagaaccagtgtcccataaaagagagaaggacagcatctccacccctaaagctggagacagggcctgggggaggggtcaattagaggagggctggggaatttggagatgctcaggggtggggctcactttgaggctgggactcccatgtcagggtctgaacctcagctctgccctgactggctgtggaaccctgtggaagacacaggccccctctgcacttcagttctgccccctgcaaatgagggcagcactgggcagtgtgaaggtctgcacctccgtccctctggggca

SEQ ID NO: 168439 - DNA, 601 bp, Human
cccctaggctggcgtcccacgtaagaaccagtgtcccataaaagagagaaggacagcatctccacccctaaagctggagacagggcctgggggaggggtcaattagaggagggctggggaatttggagatgctcaggggtggggctcactttgaggctgggactcccatgtcagggtctgaacctcagctctgccctgactggctgtggaaccctgtggaagacacaggccccctctgcacttcagttctgccccctgcaaatgagggcagcactgggcagtgtgaaggtctgcacctccrtccctctggggcaccccccaggaagctgtgggccacagtgtgagcggtccccaaggccagccagggtggccctgctggctcatgtgcagccgccttctcctccacagcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagcacccttgagccc

SEQ ID NO: 168440 - DNA, 601 bp, Human
gagaaggacagcatctccacccctaaagctggagacagggcctgggggaggggtcaattagaggagggctggggaatttggagatgctcaggggtggggctcactttgaggctgggactcccatgtcagggtctgaacctcagctctgccctgactggctgtggaaccctgtggaagacacaggccccctctgcacttcagttctgccccctgcaaatgagggcagcactgggcagtgtgaaggtctgcacctccgtccctctggggcaccccccaggaagctgtgggccacagtgtgagyggtccccaaggccagccagggtggccctgctggctcatgtgcagccgccttctcctccacagcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagcacccttgagcccaagactgggccgggcccctgtgtttggtcctccaggcctcagaga

SEQ ID NO: 168441 - DNA, 601 bp, Human; identical to SEQ ID NO: 39429

SEQ ID NO: 168442 - DNA, 601 bp, Human; identical to SEQ ID NO: 39430

SEQ ID NO: 168443 - DNA, 601 bp, Human; identical to SEQ ID NO: 39431

SEQ ID NO: 168444 - DNA, 601 bp, Human; identical to SEQ ID NO: 39432

SEQ ID NO: 168445 - DNA, 601 bp, Human; identical to SEQ ID NO: 39433

SEQ ID NO: 168446 - DNA, 601 bp, Human; identical to SEQ ID NO: 39434

SEQ ID NO: 168447 - DNA, 601 bp, Human; identical to SEQ ID NO: 39435

SEQ ID NO: 168448 - DNA, 601 bp, Human; identical to SEQ ID NO: 39436

SEQ ID NO: 168449 - DNA, 601 bp, Human; identical to SEQ ID NO: 39437

SEQ ID NO: 168450 - DNA, 601 bp, Human; identical to SEQ ID NO: 39438

SEQ ID NO: 168451 - DNA, 601 bp, Human; identical to SEQ ID NO: 39439

SEQ ID NO: 168452 - DNA, 601 bp, Human; identical to SEQ ID NO: 39440

SEQ ID NO: 168453 - DNA, 601 bp, Human; identical to SEQ ID NO: 39441

SEQ ID NO: 168454 - DNA, 601 bp, Human; identical to SEQ ID NO: 39442

SEQ ID NO: 168455 - DNA, 601 bp, Human; identical to SEQ ID NO: 39443

SEQ ID NO: 168456 - DNA, 601 bp, Human; identical to SEQ ID NO: 39444

SEQ ID NO: 168457 - DNA, 601 bp, Human; identical to SEQ ID NO: 39445

SEQ ID NO: 168458 - DNA, 601 bp, Human; identical to SEQ ID NO: 39446

SEQ ID NO: 168459 - DNA, 601 bp, Human; identical to SEQ ID NO: 39447

SEQ ID NO: 168460 - DNA, 601 bp, Human; identical to SEQ ID NO: 39448

SEQ ID NO: 168461 - DNA, 601 bp, Human; identical to SEQ ID NO: 39449

SEQ ID NO: 168462 - DNA, 601 bp, Human; identical to SEQ ID NO: 39450

SEQ ID NO: 168463 - DNA, 601 bp, Human; identical to SEQ ID NO: 39451

SEQ ID NO: 168464 - DNA, 601 bp, Human; identical to SEQ ID NO: 39452

SEQ ID NO: 168465 - DNA, 601 bp, Human; identical to SEQ ID NO: 39453

SEQ ID NO: 168466 - DNA, 601 bp, Human; identical to SEQ ID NO: 39454

SEQ ID NO: 168467 - DNA, 601 bp, Human; identical to SEQ ID NO: 39455

SEQ ID NO: 168468 - DNA, 601 bp, Human; identical to SEQ ID NO: 39456

SEQ ID NO: 168469 - DNA, 601 bp, Human; identical to SEQ ID NO: 39457

SEQ ID NO: 168470 - DNA, 601 bp, Human; identical to SEQ ID NO: 39458

SEQ ID NO: 168471 - DNA, 601 bp, Human; identical to SEQ ID NO: 39459

SEQ ID NO: 168472 - DNA, 601 bp, Human; identical to SEQ ID NO: 39460

SEQ ID NO: 168473 - DNA, 601 bp, Human
gtttaaaacatttaggggtcagcaatggttgcctgggaagtgatatattaaagcaagaatgccaccaaagtcagcatggtactggatggtagtatgccatagattcaacctcccctaattttcctgctttttccagtatcatgcattttaaaatccaatgattcactaatatgtttttcaaattaggatctaggaaccatctgtatcagaatcacctatggtccctcacccaacccaggcttataaaatcaaaatctctggagacaggatccaggaaacttagtttcaaagtgattcttargccaggcggggtggttcacacctgtaatcccagcactttgggaggccgagacgggtggatcacctgaggtcgggagttggataccagcctgaccaacatggagaaactctgtctctactaaaaatacaaaattagccgggcgtggtggtgcatgcctgtaatcccagctatgtgggaggctgaggcaggagaatcacttgaagccgggaggcagaggttgcagtgaaccaagatcatggcactgcactctagcctgggcaacaagagcgaaactcggtctcaaaaaaaaaaaaccaaagt

SEQ ID NO: 168474 - DNA, 601 bp, Human
gagttgtgtatactttataagggtgaattttgtgttacatgaatatttcagtatttttaatgttaaatttttaaaagttgatttgcaaattagaaattaaaatccaaattactggccgggcatggtggctcatacctgttatcccagcaggaggctgaggcaggcagatcatttgaggtcaggagtttgagaccagtctggccaacgttgtaaaatgctgtctctactaaaaatacaaaaattaggccgagcacagtggctcatgtctgtaattccagcactttgggaggccaaggcaagwggatcatgaggtcaggagttcgagaccagcctgaccaacacagtgaaaccccatctctactaaaaatacaaaaattagctgggcgtggtggcatgcacctgtaatcccagctactcaggaggctgaggcaggagaatcacttgaactcgggaagcggaggttgcagtgagttgagatcgcaccactgcactccagcctggacaacagagcaagactccatctctaaaaaaataaataataaaataaaataaaatccaaattatttttaggctaggtgcagtggctcacacctatactcct

SEQ ID NO: 168475 - DNA, 601 bp, Human
tagtggttgccagtgatacctgctttttccagtatcatgcattttaaaatccaatgattcactaatatatttttcaaattaggatctaggaaccatctgtatcagagtcaccgatggaccctcacccacgtggggcttataaaatcaaaacctgtcagaagctgggggaggacaaaacgggggtgactgcttatgggcaggagttttctttttcaggtaatgaaaatattttggaattacactatggtggtacaactttgtgaacatactaaacgctgctgagttgtgtatactttataakggtgaattttgtgttacatgaatatttcagtatttttaatgttaaatttttaaaagttgatttgcaaattagaaattaaaatccaaattactggccgggcatggtggctcatacctgttatcccagcaggaggctgaggcaggcagatcatttgaggtcaggagtttgagaccagtctggccaacgttgtaaaatgctgtctctactaaaaatacaaaaattaggccgagcacagtggctcatgtctgtaattccagcactttgggaggccaaggcaagtggatcatgaggtcaggagtt

SEQ ID NO: 168476 - DNA, 601 bp, Human
ccagcactttgggaggccgaggcgggtggatcacgaggtgaggagatcgagaccatcctggctaacacggtgaaaccctgtctctactaaaaacaaaaaattagctgggcgtggtagcgggcacctgcagtcccagctactcgggaggctgaggcaggagaacggcgtaaacccgggaggcggagcttgcggtgagccaagatcacgccactgcattccagcctgtgtgacagagcgagactccatctcaaaaaaaaaaaaaaaatacacattcacacaaaaacttgtaaacgaatgttcrcagagcattatttattcataatagccaaaaaatagaaacaacccaaaaattcatcaattgatgaataaactgtgctgtatctatacaatgtaatatttattattctgccatgctacataatggatgaacctaaaaaacattatgttgagtggctcatgcctataatcccagcactttgggaagctgaggcaggcagatcacttgaggtcaggagttcgagaccagcctggccaacatggcaaaacctcgtctctactaaaaatacaaaaaaattagctgggtgcggtagcacgcgcctgt

SEQ ID NO: 168477 - DNA, 601 bp, Human
ccagcactttgggaggccgaggtgggtggatcatttgaggtcaggagttcgagaccagcctgaccaatataaggaaaccctcgcctctactaaaaatacaaaaagtagccgggcagtagtggcgggcacctgtaatcccagctactcaggatgctgaagcaggagaacgccttgagcctgggaggcagaggttgcggtaagccaagatagcgccacagcactccagtctgggcgagaaagtgagaccctgtctcaaaaaaaaaaaaaaaaaaaggtgcagccactatggaaaacactttgstagtttttcagaaagttaaacgtaagaattatcatatgaatcagcaagtctacgcttagatatatacccaagagaatcaaaaatacacattcactgaccgggcgcggtggctcacgcctgtaatcccagcactttgggaggccgaggcgggtggatcacgaggtgaggagatcgagaccatcctggctaacacggtgaaaccctgtctctactaaaaacaaaaaattagctgggcgtggtagcgggcacctgcagtcccagctactcgggaggctgaggcaggagaacggcgtaaacccg

SEQ ID NO: 168478 - DNA, 601 bp, Human
ataaggatgtgcagaaacctgaaccctggaggggatgtgaaatggtgcagccacggctgggcgcagcagctcacgcctgtaatcccagcactttgggaggccgaggtgggtggatcatttgaggtcaggagttcgagaccagcctgaccaatataaggaaaccctcgcctctactaaaaatacaaaaagtagccgggcagtagtggcgggcacctgtaatcccagctactcaggatgctgaagcaggagaacgccttgagcctgggaggcagaggttgcggtaagccaagatagcgccacwgcactccagtctgggcgagaaagtgagaccctgtctcaaaaaaaaaaaaaaaaaaaggtgcagccactatggaaaacactttggtagtttttcagaaagttaaacgtaagaattatcatatgaatcagcaagtctacgcttagatatatacccaagagaatcaaaaatacacattcactgaccgggcgcggtggctcacgcctgtaatcccagcactttgggaggccgaggcgggtggatcacgaggtgaggagatcgagaccatcctggctaacacggtgaaaccctgtctctactaaa

SEQ ID NO: 168479 - DNA, 601 bp, Human
cttaaaaaaaaaagataacaacaagtgttgataaggatgtgcagaaacctgaaccctggaggggatgtgaaatggtgcagccacggctgggcgcagcagctcacgcctgtaatcccagcactttgggaggccgaggtgggtggatcatttgaggtcaggagttcgagaccagcctgaccaatataaggaaaccctcgcctctactaaaaatacaaaaagtagccgggcagtagtggcgggcacctgtaatcccagctactcaggatgctgaagcaggagaacgccttgagcctgggaggcrgaggttgcggtaagccaagatagcgccacagcactccagtctgggcgagaaagtgagaccctgtctcaaaaaaaaaaaaaaaaaaaggtgcagccactatggaaaacactttggtagtttttcagaaagttaaacgtaagaattatcatatgaatcagcaagtctacgcttagatatatacccaagagaatcaaaaatacacattcactgaccgggcgcggtggctcacgcctgtaatcccagcactttgggaggccgaggcgggtggatcacgaggtgaggagatcgagaccatcctgg

SEQ ID NO: 168480 - DNA, 601 bp, Human
ctaagaacacaagaaaacaatgcataagcaggaattaaattatagtcaataaatgctaaaatgtagacagcagtgctcatggagaaaaaaaagagagagggacatcaaactatgaaaaaagttgtccataagagaaggaaatggcataggtgtcaaaaagtgctgtttttcaaataaagaattccagaatgatttagcgcttaaaaaaaaaagataacaacaagtgttgataaggatgtgcagaaacctgaaccctggaggggatgtgaaatggtgcagccacggctgggcgcagcagctyacgcctgtaatcccagcactttgggaggccgaggtgggtggatcatttgaggtcaggagttcgagaccagcctgaccaatataaggaaaccctcgcctctactaaaaatacaaaaagtagccgggcagtagtggcgggcacctgtaatcccagctactcaggatgctgaagcaggagaacgccttgagcctgggaggcagaggttgcggtaagccaagatagcgccacagcactccagtctgggcgagaaagtgagaccctgtctcaaaaaaaaaaaaaaaaaaaggtgcagccactatg

SEQ ID NO: 168481 - DNA, 601 bp, Human
ggtgggaattttaaaatggtgtagctgctgtggaaaagtggttgctcaaaaagttaaacaaaattaccatagaacccagtaattttactcctaggtatataccaaaataactgataacaggtactcaaatacttgtacaccaatattcacagcagcactattcacaacagctaaaaggcagaaacaacccaattgctcatcaataggtgattgaataaaccaatgtggtttatacatataacagaatattactcagccattaaatggaaaagaaagaagagggagtgacagctcaatagtcgttttctttcgtgatgaaattgttttggacctagacagagatgtcattatgaatgcactaaatgacactgaattatacattttataaaagggctaattttggctgggcacagtggctcacacctgtaatcccagcactttgggaggtcgaggtggacggatcacctgaggtcatgagtttgagactagcctgaccaacatggagaaaccctgtctctactaaaaatacaaaattagccaggcatggcacatgcttgtaatcccagctacttgagaggctgaggcaggagaatcacttgaa

SEQ ID NO: 168482 - DNA, 601 bp, Human
tagccattcttttattcctttactttaataaacttgttttcaaagaaagaaaagagaaaagaaaccataggagccagaggcagtaagataaagtgctaaaagaaaaaacctccccatcaaaaattctaacttaaaatggttaagatgccaataaaacctgaagcaacctatagaggcaacacaatccccatcaaaatcccaactgtcttgtttacagaaatggagaagccaaatctaaaattcatacggggcccacacagtggctcacgcctgtaatcccagcattttgggaggccaaggygggcagatcacctgaggttaggagtttgagatcaatcttgccaacgtggtgaaaccccatctctactaaaaaaacaaatattagccaggcatggtggtgggcacctgtaatctcagctacttgcagcctgaggtggttggatcgcttgaacccaggaggcagaggctgcaagtgaaacgagatcacgccactgcactccagcctgggcgacagagtaagactacctctcaaaataaaataatataaaataaaattcatattgaatgacaagggaccccaaacaaccaaaacaattttgaa

SEQ ID NO: 168483 - DNA, 601 bp, Human
ggagtagccattcttttattcctttactttaataaacttgttttcaaagaaagaaaagagaaaagaaaccataggagccagaggcagtaagataaagtgctaaaagaaaaaacctccccatcaaaaattctaacttaaaatggttaagatgccaataaaacctgaagcaacctatagaggcaacacaatccccatcaaaatcccaactgtcttgtttacagaaatggagaagccaaatctaaaattcatacggggcccacacagtggctcacgcctgtaatcccagcattttgggaggccraggtgggcagatcacctgaggttaggagtttgagatcaatcttgccaacgtggtgaaaccccatctctactaaaaaaacaaatattagccaggcatggtggtgggcacctgtaatctcagctacttgcagcctgaggtggttggatcgcttgaacccaggaggcagaggctgcaagtgaaacgagatcacgccactgcactccagcctgggcgacagagtaagactacctctcaaaataaaataatataaaataaaattcatattgaatgacaagggaccccaaacaaccaaaacaattt

SEQ ID NO: 168484 - DNA, 601 bp, Human
acaacagacttctcatcagaaaccataggggccacagcagctctgcctatggagtagccattcttttattcctttactttaataaacttgttttcaaagaaagaaaagagaaaagaaaccataggagccagaggcagtaagataaagtgctaaaagaaaaaacctccccatcaaaaattctaacttaaaatggttaagatgccaataaaacctgaagcaacctatagaggcaacacaatccccatcaaaatcccaactgtcttgtttacagaaatggagaagccaaatctaaaattcatayggggcccacacagtggctcacgcctgtaatcccagcattttgggaggccaaggtgggcagatcacctgaggttaggagtttgagatcaatcttgccaacgtggtgaaaccccatctctactaaaaaaacaaatattagccaggcatggtggtgggcacctgtaatctcagctacttgcagcctgaggtggttggatcgcttgaacccaggaggcagaggctgcaagtgaaacgagatcacgccactgcactccagcctgggcgacagagtaagactacctctcaaaataaaataatataa

SEQ ID NO: 168485 - DNA, 601 bp, Human
gataaacacaaagaaatacacacattgagataaattataatcaaactgttgaaagacaaagacaaatgctaaaagcagcaagagagaagctaagagtcatgaacaagggatcctcagtaagactaacaacagatacaacagacttctcatcagaaaccataggggccacagcagctctgcctatggagtagccattcttttattcctttactttaataaacttgttttcaaagaaagaaaagagaaaagaaaccataggagccagaggcagtaagataaagtgctaaaagaaaaaacctcsccatcaaaaattctaacttaaaatggttaagatgccaataaaacctgaagcaacctatagaggcaacacaatccccatcaaaatcccaactgtcttgtttacagaaatggagaagccaaatctaaaattcatacggggcccacacagtggctcacgcctgtaatcccagcattttgggaggccaaggtgggcagatcacctgaggttaggagtttgagatcaatcttgccaacgtggtgaaaccccatctctactaaaaaaacaaatattagccaggcatggtggtgggcacctgtaatc

SEQ ID NO: 168486 - DNA, 601 bp, Human
ttaatacccaaaatccaaactttctaaaatactgcagacctaacagtccttaggaaggaattttttcttggttataaaactataggtccagtgctttctagatcactaagagagagattcagatatctgataaggcagaattatcgtctgtgaaaatccccacttcttccataaaagcatgaaaaagtgatatgaatctacacatccaagaagctcgatgaactcaaagcaggataaacacaaagaaatacacacattgagataaattataatcaaactgttgaaagacaaagacaaatgytaaaagcagcaagagagaagctaagagtcatgaacaagggatcctcagtaagactaacaacagatacaacagacttctcatcagaaaccataggggccacagcagctctgcctatggagtagccattcttttattcctttactttaataaacttgttttcaaagaaagaaaagagaaaagaaaccataggagccagaggcagtaagataaagtgctaaaagaaaaaacctccccatcaaaaattctaacttaaaatggttaagatgccaataaaacctgaagcaacctatagaggcaaca

SEQ ID NO: 168487 - DNA, 601 bp, Human
aaaccagaaatctgggcctttcaactaaatctaccaatttttaaacattggcaactaattcatttatttttaatactgtatgtgtcaacacacacagactaaatgaaacacatctgtgggctcccaatgttttacctctcatctagattcactactataaatggtactggcttcttcaacaattggttctatcagtgctttttcccccacctggtgatttaaacatcccatgtctgggttcttcccagaaagtcgagtagctacaagagttctaaagtggcaaaaatcacagctagcttgytctgaaaatcgggctccactggcactacaaggccttcagatttttttctccacaaactcccaaagctgattcaataacctgtattatatttaggagctaaagatttgtgtgcctggtctcagtgtcatcttttagttttagtttcttccaaactgcactgtattgggatttttagtgttttgaatttatattttgaaatgtggcctttcatggaaaaggttttgttgtattttcagctcttccctaataatcagcatcagttggggttgaggagttaataatgttcattcataccacatt

SEQ ID NO: 168488 - DNA, 601 bp, Human
ccactgggaatatgggttaagggttatcagattttctgatttttttaaggcaaaaccagaaatctgggcctttcaactaaatctaccaatttttaaacattggcaactaattcatttatttttaatactgtatgtgtcaacacacacagactaaatgaaacacatctgtgggctcccaatgttttacctctcatctagattcactactataaatggtactggcttcttcaacaattggttctatcagtgctttttcccccacctggtgatttaaacatcccatgtctgggttcttcccagraagtcgagtagctacaagagttctaaagtggcaaaaatcacagctagcttgttctgaaaatcgggctccactggcactacaaggccttcagatttttttctccacaaactcccaaagctgattcaataacctgtattatatttaggagctaaagatttgtgtgcctggtctcagtgtcatcttttagttttagtttcttccaaactgcactgtattgggatttttagtgttttgaatttatattttgaaatgtggcctttcatggaaaaggttttgttgtattttcagctcttccctaat

SEQ ID NO: 168489 - DNA, 601 bp, Human
ctgggcccataatccaaactgactgacattcttacaagaagaggaaatttagacacagagacaccacggacacagcaagaaggcagccatctacgagccaaggaaaaaggcctcaaaagaaaccaaacctgctgacactttgatcttggacttctagcctccagaactgtgagaaaataaacttctgctttttaagctacccagtctgtgacattttgttatggcagccctagcaaactaatacagaagttacaaactcaactgcgcacacatgcaatgaataaaatcaatccagactttsgtcaaaatgacatcagaatgtcaaccatacttcagtaaagtgatttttttaatgccatcagattgtattctgacattttgtacatgaaaataagaacatttctatacatctgccccaaaatgctcatttttcttaaaatgtacagccattttaatcagtagtaatggctaacattaatcgaacatactacattgctactaccattccaagtgatttacctcatttaagtctaacaactctatgagatggttactatttaattctcactttatatatgagttagctgagttttagaaaaat

SEQ ID NO: 168490 - DNA, 601 bp, Human
gccaacatggtgaaaacccaaccccgtctctactaaaaatacaaaaattagctgggtgtggtggcacgtgcctatagtcccagctacttgggaggctgaggcaggagaatcgcttgaaccagggaggcagaggttacagtgagccgagatcgcgcctctgcactccagcctggcgacagagcgagactccatctaaaaaaaacaaggctactggggtgctgggcccataatccaaactgactgacattcttacaagaagaggaaatttagacacagagacaccacggacacagcaagaagrcagccatctacgagccaaggaaaaaggcctcaaaagaaaccaaacctgctgacactttgatcttggacttctagcctccagaactgtgagaaaataaacttctgctttttaagctacccagtctgtgacattttgttatggcagccctagcaaactaatacagaagttacaaactcaactgcgcacacatgcaatgaataaaatcaatccagactttggtcaaaatgacatcagaatgtcaaccatacttcagtaaagtgatttttttaatgccatcagattgtattctgacattttgta

SEQ ID NO: 168491 - DNA, 601 bp, Human
agccgggcacggtggctcatacctgtaatcccagcacttcaggaggccaaggcgggtggatcacgaggtcaagagattgagaccatcctggccaacatggtgaaaacccaaccccgtctctactaaaaatacaaaaattagctgggtgtggtggcacgtgcctatagtcccagctacttgggaggctgaggcaggagaatcgcttgaaccagggaggcagaggttacagtgagccgagatcgcgcctctgcactccagcctggcgacagagcgagactccatctaaaaaaaacaaggctaytggggtgctgggcccataatccaaactgactgacattcttacaagaagaggaaatttagacacagagacaccacggacacagcaagaaggcagccatctacgagccaaggaaaaaggcctcaaaagaaaccaaacctgctgacactttgatcttggacttctagcctccagaactgtgagaaaataaacttctgctttttaagctacccagtctgtgacattttgttatggcagccctagcaaactaatacagaagttacaaactcaactgcgcacacatgcaatgaataaaatcaatcc

SEQ ID NO: 168492 - DNA, 601 bp, Human
agggcctttaaagaggcgattaagttaaaacaagtccagccgggcacggtggctcatacctgtaatcccagcacttcaggaggccaaggcgggtggatcacgaggtcaagagattgagaccatcctggccaacatggtgaaaacccaaccccgtctctactaaaaatacaaaaattagctgggtgtggtggcacgtgcctatagtcccagctacttgggaggctgaggcaggagaatcgcttgaaccagggaggcagaggttacagtgagccgagatcgcgcctctgcactccagcctggygacagagcgagactccatctaaaaaaaacaaggctactggggtgctgggcccataatccaaactgactgacattcttacaagaagaggaaatttagacacagagacaccacggacacagcaagaaggcagccatctacgagccaaggaaaaaggcctcaaaagaaaccaaacctgctgacactttgatcttggacttctagcctccagaactgtgagaaaataaacttctgctttttaagctacccagtctgtgacattttgttatggcagccctagcaaactaatacagaagttacaaa

SEQ ID NO: 168493 - DNA, 601 bp, Human
aatgtgactatatttgcagacagggcctttaaagaggcgattaagttaaaacaagtccagccgggcacggtggctcatacctgtaatcccagcacttcaggaggccaaggcgggtggatcacgaggtcaagagattgagaccatcctggccaacatggtgaaaacccaaccccgtctctactaaaaatacaaaaattagctgggtgtggtggcacgtgcctatagtcccagctacttgggaggctgaggcaggagaatcgcttgaaccagggaggcagaggttacagtgagccgagatcgygcctctgcactccagcctggcgacagagcgagactccatctaaaaaaaacaaggctactggggtgctgggcccataatccaaactgactgacattcttacaagaagaggaaatttagacacagagacaccacggacacagcaagaaggcagccatctacgagccaaggaaaaaggcctcaaaagaaaccaaacctgctgacactttgatcttggacttctagcctccagaactgtgagaaaataaacttctgctttttaagctacccagtctgtgacattttgttatggcagccctagca

SEQ ID NO: 168494 - DNA, 601 bp, Human
tcaaactaaaacttttaacatgttgtcgctattcctgagatcccagcaggacttcctggagcctgtgcttaacttgatctctctgcttagattttaattaattttgcttaaatgtaaatcttattctatagaatggaatgagcaaaattttaaataattaaaatatatatcaccacccaaaaagaaaaaaagagaaaatggttatagtatgaatgaatacagaattttataatcacaatttccctaagaactctattaaacatttctccatgcagtaacatttactgtgacagattggaagctaatgccagtctgattctctttcccgtttaagaaagcttttttttttcctccctcctatttcaatttagaagcttgtagtattcttttaatttcagaaatttaaccagggtatgtctcttctctcaatatttatgtgcagcaattgagacctgaagatgtcgtacttcagctctggggaacttttgtcttttatctgttaggattatcgtttctctcctcatctgctccaagtgctcttaatcaatcatctatgatcaggcttttggctctcttagcactcaccttcaatctcttatct

SEQ ID NO: 168495 - DNA, 601 bp, Human
aaacaaacaaattccagacattcaaactaaaacttttaacatgttgtcgctattcctgagatcccagcaggacttcctggagcctgtgcttaacttgatctctctgcttagattttaattaattttgcttaaatgtaaatcttattctatagaatggaatgagcaaaattttaaataattaaaatatatatcaccacccaaaaagaaaaaaagagaaaatggttatagtatgaatgaatacagaattttataatcacaatttccctaagaactctattaaacatttctccatgcagtaacrtttactgtgacagattggaatctaatgccagtctgattctctttcccgtttaagaaagcttttttttttcctccctcctatttcaatttagaagcttgtagtattcttttaatttcagaaatttaaccagggtatgtctcttctctcaatatttatgtgcagcaattgagacctgaagatgtcgtacttcagctctggggaacttttgtcttttatctgttaggattatcgtttctctcctcatctgctccaagtgctcttaatcaatcatctatgatcaggcttttggctctcttagca

SEQ ID NO: 168496 - DNA, 601 bp, Human
cacctggacattatctgaagacttcattcttggaatagaagatgacatttcatccctgactccagtggagttcaagtgtgaataaaatgatatgaactgcttttgtcatttcagaattagactgagtcacttcttggaaaatatagctcctaaaccccagtttaggtgctgttaaaataagtatcatctacctcacgggtactcatggtgactgactcttggagactctagaatgcaccaaaacaaacaaacaaacaaacaaattccagacattcaaactaaaacttttaacatgttgtckctattcctgagatcccagcaggacttcctggagcctgtgcttaacttgatctctctgcttagattttaattaattttgcttaaatgtaaatcttattctatagaatggaatgagcaaaattttaaataattaaaatatatatcaccacccaaaaagaaaaaaagagaaaatggttatagtatgaatgaatacagaattttataatcacaatttccctaagaactctattaaacatttctccatgcagtaacatttactgtgacagattggaatctaatgccagtctgattctctttcccg

SEQ ID NO: 168497 - DNA, 601 bp, Human
tatacagattacagctactttgtgactgatagtgagtggaacttccacctgatatatccctattatactatgaaaatgtacaaatacctgaaatgtaaaaatgagcctaatgttaagatggataggaaggacactgtgactagttctgtgtggagtttggtagcactgtgattcatttgatgcttctagaaaccacaaaaaactatacattggagaaattatggactctgtgttcttatgatgactagttagttctgaagcacctggacattatctgaagacttcattcttggaatagaasatgacatttcatccctgactccagtggagttcaagtgtgaataaaatgatatgaactgcttttgtcatttcagaattagactgagtcacttcttggaaaatatagctcctaaaccccagtttaggtgctgttaaaataagtatcatctacctcacgggtactcatggtgactgactcttggagactctagaatgcaccaaaacaaacaaacaaacaaacaaattccagacattcaaactaaaacttttaacatgttgtcgctattcctgagatcccagcaggacttcctggagcctgtgc

SEQ ID NO: 168498 - DNA, 601 bp, Human
aaaatttctaaatttgccatttttcttaagtttgcaataaacttatttttctatacagtatattctgtactctatttttttcttagtcaaaacttgtactttaaaaatttattttctacaaatgcaaaagtcctaatttcatcagttatgtcagacagggtctgcaggaagcagatggcccactcaaattagattaatttaaagagggtttatttacataaggactatttacaaagctgtgggtgaggcttataggaaatcacaagggataatgcagtaacccaggctagtaacaagagarcagctctcatcaccccgaagcctaaaaggaaggaccaggaggactaagagtgacacagccagccagcccaaggctcctacatacagaatgtatgagatgggggaatcaagaccgggactttttttctcctctttcctccaattccctgccagggctcctcatttccacatccaaatcagaagacagacgacataggggctcattcatgttgtccagaaaggtcccctatgatggaaaacacaaatgctgaatggatctggagagttaaattgaggaatataagacatgtctgcgaaactg

SEQ ID NO: 168499 - DNA, 601 bp, Human
taatcaagtactatataaacctctattatacattttaaaaatttctaaatttgccatttttcttaagtttgcaataaacttatttttctatacagtatattctgtactctatttttttcttagtcaaaacttgtactttaaaaatttattttctacaaatgcaaaagtcctaatttcatcagttatgtcagacagggtctgcaggaagcagatggcccactcaaattagattaatttaaagagggtttatttacataaggactatttacaaagctgtgggtgaggcttataggaaatcacragggataatgcagtaacccaggctagtaacaagagaacagctctcatcaccccgaagcctaaaaggaaggaccaggaggactaagagtgacacagccagccagcccaaggctcctacatacagaatgtatgagatgggggaatcaagaccgggactttttttctcctctttcctccaattccctgccagggctcctcatttccacatccaaatcagaagacagacgacataggggctcattcatgttgtccagaaaggtcccctatgatggaaaacacaaatgctgaatggatctggaga

SEQ ID NO: 168500 - DNA, 601 bp, Human
tctaacttctggcctcaagagaccctcaggccacctctgcctcccgagtagctaggattccaggagccagccaccacaccacttacattcaggaaatttaacatacatacaataccaatatccaattactaaataatcaaaaatatcaatactaacagctaatgcgataaataatcaagtactatataaacctctattatacattttaaaaatttctaaatttgccatttttcttaagtttgcaataaacttatttttctatacagtatattctgtactctatttttttcttagtcaaaayttgtactttaaaaatttattttctacaaatgcaaaagtcctaatttcatcagttatgtcagacagggtctgcaggaagcagatggcccactcaaattagattaatttaaagagggtttatttacataaggactatttacaaagctgtgggtgaggcttataggaaatcacaagggataatgcagtaacccaggctagtaacaagagaacagctctcatcaccccgaagcctaaaaggaaggaccaggaggactaagagtgacacagccagccagcccaaggctcctacatacagaatgta

SEQ ID NO: 168501 - DNA, 601 bp, Human
ctaccattcaggctggagtgcaatggcgtgatcatagctcactgcagcctctaacttctggcctcaagagaccctcaggccacctctgcctcccgagtagctaggattccaggagccagccaccacaccacttacattcaggaaatttaacatacatacaataccaatatccaattactaaataatcaaaaatatcaatactaacagctaatgcgataaataatcaagtactatataaacctctattatacattttaaaaatttctaaatttgccatttttcttaagtttgcaataaacttatttttctatacagtatattctgtactctatttttttcttagtcaaaacttgtactttaaaaatttattttctacaaatgcaaaagtcctaatttcatcagttatgtcagacagggtctgcaggaagcagatggcccactcaaattagattaatttaaagagggtttatttacataaggactatttacaaagctgtgggtgaggcttataggaaatcacaagggataatgcagtaacccaggctagtaacaagagaacagctctcatcaccccgaagcctaaaaggaaggaccaggagga

SEQ ID NO: 168502 - DNA, 601 bp, Human
tctaccattcaggctggagtgcaatggcgtgatcatagctcactgcagcctctaacttctggcctcaagagaccctcaggccacctctgcctcccgagtagctaggattccaggagccagccaccacaccacttacattcaggaaatttaacatacatacaataccaatatccaattactaaataatcaaaaatatcaatactaacagctaatgcgataaataatcaagtactatataaacctctattatacattttaaaaatttctaaatttgccatttttcttaagtttgcaataaacgtatttttctatacagtatattctgtactctatttttttcttagtcaaaacttgtactttaaaaatttattttctacaaatgcaaaagtcctaatttcatcagttatgtcagacagggtctgcaggaagcagatggcccactcaaattagattaatttaaagagggtttatttacataaggactatttacaaagctgtgggtgaggcttataggaaatcacaagggataatgcagtaacccaggctagtaacaagagaacagctctcatcaccccgaagcctaaaaggaaggaccaggagg

SEQ ID NO: 168503 - DNA, 601 bp, Human
ccaggctttctagcactgagctctttccgctgctctgaaaacagaatatatacaagagcaaaatgagtttcttaacacattttttgttaattcaataaactatattaacaaaccagcatacagaattattttaaaggaaaaattagtgcagagactatttttttttttttttgagacggagtttcgctcttgttggctaggctggagtgcaatggcacgatctcggctcaccgcaacctccgcctcccgggttcaagcgattctcctgcctcaacctcccaagtagctgggattacaggcrtgtgccaccacgcctggctaattttttgtatttttagtagagacggggtttctccatgttgattaggctggtctcgaactcccgacctcaggtgatccacctgcctcagcctcccagtgctgggattacaggtgtaagccaccatgcccggccacagactttttaaatgaaagataattttatttcctattacatgatctatttgtttttaagccaaaaccagaaaataacagccctgttttcccataattatcccacctgttttgatactccaccaaccaggtttcaaaacctacacaa

SEQ ID NO: 168504 - DNA, 601 bp, Human
ttaccattttcttctcctgttgttttccgtttatcttcttgtgaaacatggaccagttgcagaatgagaggtctccgggtgacaattccagtacctctgggaagcaggtccctccccaccaggctttctagcactgagctctttccgctgctctgaaaacagaatatatacaagagcaaaatgagtttcttaacacattttttgttaattcaataaactatattaacaaaccagcatacagaattattttaaaggaaaaattagtgcagagactatttttttttttttttgagacggagtytcgctcttgttggctaggctggagtgcaatggcacgatctcggctcaccgcaacctccgcctcccgggttcaagcgattctcctgcctcaacctcccaagtagctgggattacaggcgtgtgccaccacgcctggctaattttttgtatttttagtagagacggggtttctccatgttgattaggctggtctcgaactcccgacctcaggtgatccacctgcctcagcctcccagtgctgggattacaggtgtaagccaccatgcccggccacagactttttaaatgaaagataatttta

SEQ ID NO: 168505 - DNA, 601 bp, Human
aaacaaaaactactcttttttttacattaagaaagatgcatactacttctcacaggacttctaattatgctacagtcactaatttctaattatctaatcaattcatatctttttaagaatagatcaaaaatgaagagctgtaaaataattatctcaaatctgaaatttaccattttcttctcctgttgttttccgtttatcttcttgtgaaacatggaccagttgcagaatgagaggtctccgggtgacaattccagtacctctgggaagcaggtccctccccaccaggctttctagcackgagctctttccgctgctctgaaaacagaatatatacaagagcaaaatgagtttcttaacacattttttgttaattcaataaactatattaacaaaccagcatacagaattattttaaaggaaaaattagtgcagagactatttttttttttttttgagacggagtttcgctcttgttggctaggctggagtgcaatggcacgatctcggctcaccgcaacctccgcctcccgggttcaagcgattctcctgcctcaacctcccaagtagctgggattacaggcgtgtgccaccacgcctg

SEQ ID NO: 168506 - DNA, 601 bp, Human
agcggggggttgctgtgccggctggaatgcccaggcgagtaaggtgcccactcctggagctccggggagagttctccactggccgggacacacttctgttcctgcagatgcaagggcaagagtgtctgctagaaagagtggagtgtggccaggcgcagtggctcacacctataatcccagcactctgggaggccgaggcgggcagatcacctaaggtcaggagttcaagaccaccctggccaacatggcgaaatcccgtctctaccaaaaatacaaaaattagctgggcatggtagtgggygcctgtaatcccagctacttgggaggctgaggcaggagaattgcttgaacccagtaggtggaggttgcagtgagccaagatcataccactgcactccagcctgggcgacagagtaagacctccgtctcaaaaacaaaacaaaacaaaaactactcttttttttacattaagaaagatgcatactacttctcacaggacttctaattatgctacagtcactaatttctaattatctaatcaattcatatctttttaagaatagatcaaaaatgaagagctgtaaaataattatctcaaatc

SEQ ID NO: 168507 - DNA, 561 bp, Human
tctagagtcatagcagatgctcatgaggttttttttccccattaaaaaaaaaattcaagtcatcaccaccaacagctcctacagtaaatgaaaaaatcagacacagaaattaaaataagttcaattttgtcaaaactatcatcccatcttaaatcagaataagaagtagaataaaactgcattgaaaacagatctctgcagataagaaacagatatggtactctgctgcaaaagtaatttaataattagagctatgttacagagttctataaataagaaagtctgagccaaatactgaacyaaataggaagattaaatacgttactctcattcaacatttcaaacctcattaatataagtataattaacataggatacatatttggtaagcaacttaaaatctgctgatagacacagcattccctaatatattttcaatttaatcaaaaaagaacggttataaaggacaatgcctattttcttctttttttttttttttttttttgagacggagtctcactctgtcgcctaggctggagtgcagtggcgtgatctcagctc

SEQ ID NO: 168508 - DNA, 601 bp, Human
aaatttgatgaaatcagtggggatgaaattttataagtgttattctatatatttgaaggtgaaccccagattaatccaacatgattaaattcaaggttcagaacttcaataagtattagagaaatgcaaagtgatgaataacatacccagaagctacctaatgtaattaaaaggctcccacatagccactggcagtctatctaaaaatattacttgcaacatctacaactacactaatttgcttcagtgactaacattctagagtcatagcagatgctcatgaggttttttttccccattaaaaaaaaaattcaagtcatcaccaccaacagctcctacagtaaatgaaaaaatcagacacagaaattaaaataagttcaattttgtcaaaactatcatcccatcttaaatcagaataagaagtagaataaaactgcattgaaaacagatctctgcagataagaaacagatatggtactctgctgcaaaagtaatttaataattagagctatgttacagagttctataaataagaaagtctgagccaaatactgaaccaaataggaagattaaatacgttactctcattcaacatttcaaa

SEQ ID NO: 168509 - DNA, 601 bp, Human
actggctaaataaaatccctacacaaaatgttagtaactgatttcttttttttttttttttttgaaagtttatgtttcttccctttctcctctcttattatcaggctgtcaggtagttcacactcttctagctaactatattgtttatctgcttcatggtttctaattttctctgggttagaatgatttatgatatgctagaattgtttattctaaggataaagaagctttgatgaaaaactaacgaactgtctatgctagaataaaacacgtgaaatctagtactcaaatttatataatmtatattgtgtttggggtagttgagttgtcattttaagcaaatatatatacaaaatcagcactaagcttggaaaaaaacagtaggtaggcagatttactgaccaaccactaagaggagacatcaacaaaacatagtggacataaaaacaaagagataccaaagagctgacactacgatagctgaaatgtacacccttttctaacaagcacaattttatctaaggaaacactgcccacaattcaaatagtttctgagagacaggatatcatgggccctctcaaggtgacagaagaaaatgga

SEQ ID NO: 168510 - DNA, 601 bp, Human
gaagctacatctaagatggattatacttctccatgtcatcttagaatgtactactctgaatctactattggtaacctaggtctttgtcatgtaactaagccttcactggctaaataaaatccctacacaaaatgttagtaactgatttcttttttttttttttttttgaaagtttatgtttcttccctttctcctctcttattatcaggctgtcaggtagttcacactcttctagctaactatattgtttatctgcttcatggtttctaattttctctgggttagaatgatttatgatatrctagaattgtttattctaaggataaagaagctttgatgaaaaactaacgaactgtctatgctagaataaaacacgtgaaatctagtactcaaatttatataatctatattgtgtttggggtagttgagttgtcattttaagcaaatatatatacaaaatcagcactaagcttggaaaaaaacagtaggtaggcagatttactgaccaaccactaagaggagacatcaacaaaacatagtggacataaaaacaaagagataccaaagagctgacactacgatagctgaaatgtacaccctt

SEQ ID NO: 168511 - DNA, 601 bp, Human
acatactgacacctcagttatcccacagttgacagaatgaagaatcctatgctaaataaatgtcctgatgattgaattatacatattaaacactaaaatattttactttagccagttttgatgaagctacatctaagatggattatacttctccatgtcatcttagaatgtactactctgaatctactattggtaacctaggtctttgtcatgtaactaagccttcactggctaaataaaatccctacacaaaatgttagtaactgatttcttttttttttttttttttgaaagtttatgtttcttccctttctcctctcttattatcaggctgtcaggtagttcacactcttctagctaactatattgtttatctgcttcatggtttctaattttctctgggttagaatgatttatgatatgctagaattgtttattctaaggataaagaagctttgatgaaaaactaacgaactgtctatgctagaataaaacacgtgaaatctagtactcaaatttatataatctatattgtgtttggggtagttgagttgtcattttaagcaaatatatatacaaaatcagcactaagcttggaaaa

SEQ ID NO: 168512 - DNA, 601 bp, Human
gggccaagtgtggggctcacacttctaatctcagcactttgagaagccgaggcagacggatcacctgaggtcaggagttcaagaccagcctggccaacatggcaaaaccccgtctctactaaaaatacaaaaattagctgggcgtagtggcacacgcctgtaatcccagctactcaggaggctgaggcaggagaattgcttgaacccaggaggtttcagtgagctgagatcattgtgccactgcacaccagcctgggcaacagagcaagactctgccttaaaaaaaaaaaaaaaaaaaaagactttgcctgagatatctgataacctactacaggaaaagataaattgcctgatttttaaaaatctacaaaatatactaaatacatctttcaaaaccttaaaagttggtaagtatatgcaagtatttgccccattagctaagactggactatataagggtattttatttgaaacatacattggatttaatagaacactgcagaaagttaactcttgaccttcgtggactcagtccaaagggagactactacgtgtatcacagcaccctatgcagaaaaattaatcctatctttttccttta

SEQ ID NO: 168513 - DNA, 601 bp, Human; identical to SEQ ID NO: 33121

SEQ ID NO: 168514 - DNA, 601 bp, Human; identical to SEQ ID NO: 33122

SEQ ID NO: 168515 - DNA, 601 bp, Human; identical to SEQ ID NO: 33123

SEQ ID NO: 168516 - DNA, 601 bp, Human; identical to SEQ ID NO: 33124

SEQ ID NO: 168517 - DNA, 601 bp, Human; identical to SEQ ID NO: 33125

SEQ ID NO: 168518 - DNA, 601 bp, Human; identical to SEQ ID NO: 33126

SEQ ID NO: 168519 - DNA, 601 bp, Human; identical to SEQ ID NO: 33127

SEQ ID NO: 168520 - DNA, 601 bp, Human; identical to SEQ ID NO: 33128

SEQ ID NO: 168521 - DNA, 601 bp, Human; identical to SEQ ID NO: 168473

SEQ ID NO: 168522 - DNA, 601 bp, Human; identical to SEQ ID NO: 168474

SEQ ID NO: 168523 - DNA, 601 bp, Human; identical to SEQ ID NO: 168475

SEQ ID NO: 168524 - DNA, 601 bp, Human; identical to SEQ ID NO: 168476

SEQ ID NO: 168525 - DNA, 601 bp, Human; identical to SEQ ID NO: 168477

SEQ ID NO: 168526 - DNA, 601 bp, Human; identical to SEQ ID NO: 168478

SEQ ID NO: 168527 - DNA, 601 bp, Human; identical to SEQ ID NO: 168479

SEQ ID NO: 168528 - DNA, 601 bp, Human; identical to SEQ ID NO: 168480

SEQ ID NO: 168529 - DNA, 601 bp, Human; identical to SEQ ID NO: 168481

SEQ ID NO: 168530 - DNA, 601 bp, Human; identical to SEQ ID NO: 168482

SEQ ID NO: 168531 - DNA, 601 bp, Human; identical to SEQ ID NO: 168483

SEQ ID NO: 168532 - DNA, 601 bp, Human; identical to SEQ ID NO: 168484

SEQ ID NO: 168533 - DNA, 601 bp, Human; identical to SEQ ID NO: 168485

SEQ ID NO: 168534 - DNA, 601 bp, Human; identical to SEQ ID NO: 168486

SEQ ID NO: 168535 - DNA, 601 bp, Human; identical to SEQ ID NO: 168487

SEQ ID NO: 168536 - DNA, 601 bp, Human; identical to SEQ ID NO: 168488

SEQ ID NO: 168537 - DNA, 601 bp, Human; identical to SEQ ID NO: 168489

SEQ ID NO: 168538 - DNA, 601 bp, Human; identical to SEQ ID NO: 168490

SEQ ID NO: 168539 - DNA, 601 bp, Human; identical to SEQ ID NO: 168491

SEQ ID NO: 168540 - DNA, 601 bp, Human; identical to SEQ ID NO: 168492

SEQ ID NO: 168541 - DNA, 601 bp, Human; identical to SEQ ID NO: 168493

SEQ ID NO: 168542 - DNA, 601 bp, Human; identical to SEQ ID NO: 168494

SEQ ID NO: 168543 - DNA, 601 bp, Human; identical to SEQ ID NO: 168495

SEQ ID NO: 168544 - DNA, 601 bp, Human; identical to SEQ ID NO: 168496

SEQ ID NO: 168545 - DNA, 601 bp, Human; identical to SEQ ID NO: 168497

SEQ ID NO: 168546 - DNA, 601 bp, Human; identical to SEQ ID NO: 168498

SEQ ID NO: 168547 - DNA, 601 bp, Human; identical to SEQ ID NO: 168499

SEQ ID NO: 168548 - DNA, 601 bp, Human; identical to SEQ ID NO: 168500

SEQ ID NO: 168549 - DNA, 601 bp, Human; identical to SEQ ID NO: 168501

SEQ ID NO: 168550 - DNA, 601 bp, Human; identical to SEQ ID NO: 168502

SEQ ID NO: 168551 - DNA, 601 bp, Human; identical to SEQ ID NO: 168503

SEQ ID NO: 168552 - DNA, 601 bp, Human; identical to SEQ ID NO: 168504

SEQ ID NO: 168553 - DNA, 601 bp, Human; identical to SEQ ID NO: 168505

SEQ ID NO: 168554 - DNA, 601 bp, Human; identical to SEQ ID NO: 168506

SEQ ID NO: 168555 - DNA, 561 bp, Human; identical to SEQ ID NO: 168507

SEQ ID NO: 168556 - DNA, 601 bp, Human; identical to SEQ ID NO: 168508

SEQ ID NO: 168557 - DNA, 601 bp, Human; identical to SEQ ID NO: 168509

SEQ ID NO: 168558 - DNA, 601 bp, Human; identical to SEQ ID NO: 168510

SEQ ID NO: 168559 - DNA, 601 bp, Human; identical to SEQ ID NO: 168511

SEQ ID NO: 168560 - DNA, 601 bp, Human; identical to SEQ ID NO: 168512

SEQ ID NO: 168561 - DNA, 601 bp, Human; identical to SEQ ID NO: 33121

SEQ ID NO: 168562 - DNA, 601 bp, Human; identical to SEQ ID NO: 33122

SEQ ID NO: 168563 - DNA, 601 bp, Human; identical to SEQ ID NO: 33123

SEQ ID NO: 168564 - DNA, 601 bp, Human; identical to SEQ ID NO: 33124

SEQ ID NO: 168565 - DNA, 601 bp, Human; identical to SEQ ID NO: 33125

SEQ ID NO: 168566 - DNA, 601 bp, Human; identical to SEQ ID NO: 33126

SEQ ID NO: 168567 - DNA, 601 bp, Human; identical to SEQ ID NO: 33127

SEQ ID NO: 168568 - DNA, 601 bp, Human; identical to SEQ ID NO: 33128

SEQ ID NO: 168569 - DNA, 601 bp, Human; identical to SEQ ID NO: 168473

SEQ ID NO: 168570 - DNA, 601 bp, Human; identical to SEQ ID NO: 168474

SEQ ID NO: 168571 - DNA, 601 bp, Human; identical to SEQ ID NO: 168475

SEQ ID NO: 168572 - DNA, 601 bp, Human; identical to SEQ ID NO: 168476

SEQ ID NO: 168573 - DNA, 601 bp, Human; identical to SEQ ID NO: 168477

SEQ ID NO: 168574 - DNA, 601 bp, Human; identical to SEQ ID NO: 168478

SEQ ID NO: 168575 - DNA, 601 bp, Human; identical to SEQ ID NO: 168479

SEQ ID NO: 168576 - DNA, 601 bp, Human; identical to SEQ ID NO: 168480

SEQ ID NO: 168577 - DNA, 601 bp, Human; identical to SEQ ID NO: 168481

SEQ ID NO: 168578 - DNA, 601 bp, Human; identical to SEQ ID NO: 168482

SEQ ID NO: 168579 - DNA, 601 bp, Human; identical to SEQ ID NO: 168483

SEQ ID NO: 168580 - DNA, 601 bp, Human; identical to SEQ ID NO: 168484

SEQ ID NO: 168581 - DNA, 601 bp, Human; identical to SEQ ID NO: 168485

SEQ ID NO: 168582 - DNA, 601 bp, Human; identical to SEQ ID NO: 168486

SEQ ID NO: 168583 - DNA, 601 bp, Human; identical to SEQ ID NO: 168487

SEQ ID NO: 168584 - DNA, 601 bp, Human; identical to SEQ ID NO: 168488

SEQ ID NO: 168585 - DNA, 601 bp, Human; identical to SEQ ID NO: 168489

SEQ ID NO: 168586 - DNA, 601 bp, Human; identical to SEQ ID NO: 168490

SEQ ID NO: 168587 - DNA, 601 bp, Human; identical to SEQ ID NO: 168491

SEQ ID NO: 168588 - DNA, 601 bp, Human; identical to SEQ ID NO: 168492

SEQ ID NO: 168589 - DNA, 601 bp, Human; identical to SEQ ID NO: 168493

SEQ ID NO: 168590 - DNA, 601 bp, Human; identical to SEQ ID NO: 168494

SEQ ID NO: 168591 - DNA, 601 bp, Human; identical to SEQ ID NO: 168495

SEQ ID NO: 168592 - DNA, 601 bp, Human; identical to SEQ ID NO: 168496

SEQ ID NO: 168593 - DNA, 601 bp, Human; identical to SEQ ID NO: 168497

SEQ ID NO: 168594 - DNA, 601 bp, Human; identical to SEQ ID NO: 168498

SEQ ID NO: 168595 - DNA, 601 bp, Human; identical to SEQ ID NO: 168499

SEQ ID NO: 168596 - DNA, 601 bp, Human; identical to SEQ ID NO: 168500

SEQ ID NO: 168597 - DNA, 601 bp, Human; identical to SEQ ID NO: 168501

SEQ ID NO: 168598 - DNA, 601 bp, Human; identical to SEQ ID NO: 168502

SEQ ID NO: 168599 - DNA, 601 bp, Human; identical to SEQ ID NO: 168503

SEQ ID NO: 168600 - DNA, 601 bp, Human; identical to SEQ ID NO: 168504

SEQ ID NO: 168601 - DNA, 601 bp, Human; identical to SEQ ID NO: 168505

SEQ ID NO: 168602 - DNA, 601 bp, Human; identical to SEQ ID NO: 168506

SEQ ID NO: 168603 - DNA, 561 bp, Human; identical to SEQ ID NO: 168507

SEQ ID NO: 168604 - DNA, 601 bp, Human; identical to SEQ ID NO: 168508

SEQ ID NO: 168605 - DNA, 601 bp, Human; identical to SEQ ID NO: 168509

SEQ ID NO: 168606 - DNA, 601 bp, Human; identical to SEQ ID NO: 168510

SEQ ID NO: 168607 - DNA, 601 bp, Human; identical to SEQ ID NO: 168511

SEQ ID NO: 168608 - DNA, 601 bp, Human; identical to SEQ ID NO: 168512

SEQ ID NO: 168609 - DNA, 601 bp, Human; identical to SEQ ID NO: 33121

SEQ ID NO: 168610 - DNA, 601 bp, Human; identical to SEQ ID NO: 33122

SEQ ID NO: 168611 - DNA, 601 bp, Human; identical to SEQ ID NO: 33123

SEQ ID NO: 168612 - DNA, 601 bp, Human; identical to SEQ ID NO: 33124

SEQ ID NO: 168613 - DNA, 601 bp, Human; identical to SEQ ID NO: 33125

SEQ ID NO: 168614 - DNA, 601 bp, Human; identical to SEQ ID NO: 33126

SEQ ID NO: 168615 - DNA, 601 bp, Human; identical to SEQ ID NO: 33127

SEQ ID NO: 168616 - DNA, 601 bp, Human; identical to SEQ ID NO: 33128

SEQ ID NO: 168617 - DNA, 601 bp, Human
cttatacctgtgaaatctgaaaatacaacccccacatccaatatgaacacacctctcctttagtttgttgaactctgggtagagaattttctcatcctggagatccttagcaacaatctgattgttgttcattgaggcaaaggcaaatatcaggtgggtgcagagaaaggggtccaggtcatggggcaagatcgaggcagggcctggccgactgtgtgcccagttggtgaaataacacacgagtttatgggcagcacctggtaagggagagcacacattagttggcaaaaaccaagggagsggatggagctcagcttccagaaagcaatgtgaacgcagcccaagagaccaggccacattttcacatcctctctccctggccctgaagtacacctcagaactacactgaggttctattcctcccccactgctgaggtctcaggaagaaaacaatgccttgtgaaatcctggtcagaacagattctcaagtctggaccaaggcacacagtcagcgacacaaacagcaggtgaccaaaaatcctctgagaaactgtgttggatcaataatccctgtcagagaagccagggcaaggtgggctgc

SEQ ID NO: 168618 - DNA, 601 bp, Human
aatagactgttatcttatacctgtgaaatctgaaaatacaacccccacatccaatatgaacacacctctcctttagtttgttgaactctgggtagagaattttctcatcctggagatccttagcaacaatctgattgttgttcattgaggcaaaggcaaatatcaggtgggtgcagagaaaggggtccaggtcatggggcaagatcgaggcagggcctggccgactgtgtgcccagttggtgaaataacacacgagtttatgggcagcacctggtaagggagagcacacattagttggcaraaaccaagggaggggatggagctcagcttccagaaagcaatgtgaacgcagcccaagagaccaggccacattttcacatcctctctccctggccctgaagtacacctcagaactacactgaggttctattcctcccccactgctgaggtctcaggaagaaaacaatgccttgtgaaatcctggtcagaacagattctcaagtctggaccaaggcacacagtcagcgacacaaacagcaggtgaccaaaaatcctctgagaaactgtgttggatcaataatccctgtcagagaagccaggg

SEQ ID NO: 168619 - DNA, 601 bp, Human
caacacagataagctccccactttcagggagtttataatctagtagcatagaacttttactctgcccatctataaccattaatgcagtaacaagccttcctttgggcacagagagatcccaggagttccggagagaggaaaatgtaagcaaacacttactgagcaccaaccctgtgtgagacactgacctagccactggggatacaacaacacagcagacactgccccttccctggagtagctcaccggtaacaaacggtaataaaaacatgagcatttgttgagcatttgggatgtgtargcccactttaacagcattaataactaaaatcctcacaactaggttcaaaggctgagttgggttttgccaggcagagaagagagagaagcacattccaggcagagacaacagcaactacaaaagtaaggaggcaggaaagagctcaaggtgtctgtgacaaggagttctcaagttgggggtgctctggacccctatttgagaggaaggtaggactggaagaaatagaagaaagttgaagagtaacaggagaaatagactgttatcttatacctgtgaaatctgaaaatacaacccccacat

SEQ ID NO: 168620 - DNA, 601 bp, Human
catttactgctttaggcactttagaacaaagaacaacacagataagctccccactttcagggagtttataatctagtagcatagaacttttactctgcccatctataaccattaatgcagtaacaagccttcctttgggcacagagagatcccaggagttccggagagaggaaaatgtaagcaaacacttactgagcaccaaccctgtgtgagacactgacctagccactggggatacaacaacacagcagacactgccccttccctggagtagctcaccggtaacaaacggtaataaaarcatgagcatttgttgagcatttgggatgtgtaggcccactttaacagcattaataactaaaatcctcacaactaggttcaaaggctgagttgggttttgccaggcagagaagagagagaagcacattccaggcagagacaacagcaactacaaaagtaaggaggcaggaaagagctcaaggtgtctgtgacaaggagttctcaagttgggggtgctctggacccctatttgagaggaaggtaggactggaagaaatagaagaaagttgaagagtaacaggagaaatagactgttatctta

SEQ ID NO: 168621 - DNA, 601 bp, Human
aaaagggggaaggtgatagaaggagagagatgatgagcacaggagagaggaggaaagacagagagaacaatcaacccaagggccatcacagcccaacaactccaaggctgcacaaagtctgccaaactcgcgcatgtccctatgatgcttccaaaaaaagagcagtctaaaatgtttctctttttcctattcaacaaatatttattgagcaatgtctatgtgccatttactgctttaggcactttagaacaaagaacaacacagataagctccccactttcagggagtttataatctagtrgcatagaacttttactctgcccatctataaccattaatgcagtaacaagccttcctttgggcacagagagatcccaggagttccggagagaggaaaatgtaagcaaacacttactgagcaccaaccctgtgtgagacactgacctagccactggggatacaacaacacagcagacactgccccttccctggagtagctcaccggtaacaaacggtaataaaaacatgagcatttgttgagcatttgggatgtgtaggcccactttaacagcattaataactaaaatcctcacaactaggt

SEQ ID NO: 168622 - DNA, 601 bp, Human
cgccgatggacagtagtgttttcagctctctgttcctatgatgtgagagagagggttgatgagctgggttcttcactccggtgggcagctgctgccacattcttttattttgctcattggaagaaaacaggaaacaggagagatgggaggtaaggaaaggaaaagggggaaggtgatagaaggagagagatgatgagcacaggagagaggaggaaagacagagagaacaatcaacccaagggccatcacagcccaacaactccaaggctgcacaaagtctgccaaactcgcgcatgtcccyatgatgcttccaaaaaaagagcagtctaaaatgtttctctttttcctattcaacaaatatttattgagcaatgtctatgtgccatttactgctttaggcactttagaacaaagaacaacacagataagctccccactttcagggagtttataatctagtagcatagaacttttactctgcccatctataaccattaatgcagtaacaagccttcctttgggcacagagagatcccaggagttccggagagaggaaaatgtaagcaaacacttactgagcaccaaccctgtgtgagacact

SEQ ID NO: 168623 - DNA, 601 bp, Human
aaagttccacccgccgatggacagtagtgttttcagctctctgttcctatgatgtgagagagagggttgatgagctgggttcttcactccggtgggcagctgctgccacattcttttattttgctcattggaagaaaacaggaaacaggagagatgggaggtaaggaaaggaaaagggggaaggtgatagaaggagagagatgatgagcacaggagagaggaggaaagacagagagaacaatcaacccaagggccatcacagcccaacaactccaaggctgcacaaagtctgccaaactcrcgcatgtccctatgatgcttccaaaaaaagagcagtctaaaatgtttctctttttcctattcaacaaatatttattgagcaatgtctatgtgccatttactgctttaggcactttagaacaaagaacaacacagataagctccccactttcagggagtttataatctagtagcatagaacttttactctgcccatctataaccattaatgcagtaacaagccttcctttgggcacagagagatcccaggagttccggagagaggaaaatgtaagcaaacacttactgagcaccaaccctg

SEQ ID NO: 168624 - DNA, 601 bp, Human
cgttttttgtttgatatttttctattttacttgttttctcttccgtagtgatgacactttggaaaaattctaacttattggacctgaactttaagcaactctggggtaatcctgagatgagccatgattaaaaaattaaccagactcataaatagatctgggttccatggtcagtttcccacctccttgctgggcaatctctgaggaatacctgtgacaaatctggcaagttccttaataactgtgacttgtgctttctgctctaccaattttgaatacaaccactttgtaaagcttcctscaagtgttcacgggataatgcgtgtacagccctagcccagcatctggagcacagggagtgttcagagatgggaagaggtgaatcctgggctgggcagagctagttctcacccccctgccctgaatctttcctccatcttgtaaagtgcatcctcacacactcccagcccaccaggcctccctctcgtgtatctcatgcctttaaggcaacaaggcaagtacggcctctaacccaggcctcagccatgaaataggggaaatgtttcttcagaaaatatgaaggcagtttgtaatctccacg

SEQ ID NO: 168625 - DNA, 601 bp, Human
cagctgggggtgggagagtcctaactgctagacagagactgatattcccatcacctcaaaataagccaagaagccttcttgcttggtgtacttccctggagatgctggtccgatcgctctggcctgcaacccattcttagaggctttgaggaggcgaaaggtacgtccataggtggggatccccatgatgagcttctctgagggtgccccaagctttctccaataattcatagcatatgcctgcaggtaagaagaatccagactcctccttgttactaagagccaatggcctgagctcagsggggcagatgtctggaccacctgagatctttcctttccttaccgaagatttggggtcttcaggcagagagaagagggggctattatgtcctgtgaacctttcccaacttccatgtaagtcataagacaagacattgatgaaatccaggagtctgtaaggggcaggaggaagagatataaagactgggctagccagattttcaagtcagagcatcacagcactgtctagctaactagctagacattggtcaccagagcttccctgctccttctgcctgtggggcctgcccaggctgtgcta

SEQ ID NO: 168626 - DNA, 601 bp, Human
tcatccatccagcgcagagcagagattggagagacttgcagcacctccactactgcctaaagtactcaccctgtccctctgtacctgctgtcctctacctgggaagtccttcccgtctagtcattcctgtccatcaggattttcctgtgcttcaaactctgctcaaactctacctgctccataagacctttccaggtcactacagccacacagttatgtggctcgtattgccacctctggtggttacattcccttggaaacatgtctctttccgccacccaatagcaagcttggttgagaygaagatgaagagggtagagctggagtggagagaaagaacctgtagtagataatgtcttggaattgcttcaaaatcatctagtagtagggagggagggagccagcagagatgagacaaaattggccatgaattattaatgattgaagctgagtgagtagtatgtgggggaggtacagaggctatactattcttttaattttgcatatgtttgaaattatatatattgcaaatattaatgatttttatttaggccatacagaaagtcagggtttacctgtatagcatataagatcatttttg

SEQ ID NO: 168627 - DNA, 601 bp, Human
gtctatcaaagcttctttgcccttcaagaacattgtttcaactatgccagcactcataaaaatgcttcattgggttagaaaaacaccctcatccatccagcgcagagcagagattggagagacttgcagcacctccactactgcctaaagtactcaccctgtccctctgtacctgctgtcctctacctgggaagtccttcccgtctagtcattcctgtccatcaggattttcctgtgcttcaaactctgctcaaactctacctgctccataagacctttccaggtcactacagccacacasttatgtggctcgtattgccacctctggtggttacattcccttggaaacatgtctctttccgccacccaatagcaagcttggttgagacgaagatgaagagggtagagctggagtggagagaaagaacctgtagtagataatgtcttggaattgcttcaaaatcatctagtagtagggagggagggagccagcagagatgagacaaaattggccatgaattattaatgattgaagctgagtgagtagtatgtgggggaggtacagaggctatactattcttttaattttgcatatgtttga

SEQ ID NO: 168628 - DNA, 601 bp, Human
taagagtaacatacatgatccttgaccaaatctgtatctcattcaaagtgttttcataaacaagtctctcctgttcattagatcccagcacagactgccccatataggtggttctcaaactagcacctgaacttctagtagatttaaagttcttgaaggcagggagaactaggttgctataaataattaagcatttgagtgtccactgagtgcccagcattgtgctaaaaactatatgctgcaaaaaagtagaggtacgcaagctgtgctgcagaagttaatgtctaagccattccttttytcctttggtgcttcaaagggtctgtctatcaaagcttctttgcccttcaagaacattgtttcaactatgccagcactcataaaaatgcttcattgggttagaaaaacaccctcatccatccagcgcagagcagagattggagagacttgcagcacctccactactgcctaaagtactcaccctgtccctctgtacctgctgtcctctacctgggaagtccttcccgtctagtcattcctgtccatcaggattttcctgtgcttcaaactctgctcaaactctacctgctccataagacct

SEQ ID NO: 168629 - DNA, 601 bp, Human
atgcattgtacaaataaggaccccatagaaaccggtaggaaaccatgtgctggagcatgaaagagccagggtctcaccttgtaactgaagctgatggcattgtcatagccaacccactctttccccttgttggcatacgggacatactggtaatcaatccagtgcttcttcgctccccagacaaaggaacaaatctgccaagaggaccaccaggttagttctgggaagtgccatggagataagcaccaagagacagttgttccttgcccaaggataaagaatccaagaatccctaaccagygaatgagaagaaggtaaaccaaagagagaatggagaggccactcacaaatgagttcctctctattttgaataaattcctactgttaccctttcctctctctactgtccatgatggaaaaaagggaaccaaagagtggatgacatccttaagaaaccaagccaggggtataatgccagtaccaaaatagtaagagtaacatacatgatccttgaccaaatctgtatctcattcaaagtgttttcataaacaagtctctcctgttcattagatcccagcacagactgccccatataggtggt

SEQ ID NO: 168630 - DNA, 601 bp, Human
tacataggaatgctacataagttttcctaaagagttcccatgcataagatatttggatcaatacctggcacatagtgaatcttcaataaaagttagctactaaccctctgggttccccacctcattaatcaccattattatcctattaaactgtagatattgctctactgtttaaaattcatttccttatctcaccgtgatgctataaaatacagtagagcacaaaatattatatgcttctcacagatgagaaaataaaggctttcatccacactttttaaaacctccactacaactaaayggcagagcttagattcaagtccaggttttattattaccttgccagtgctctctgtcaagtctgatggaaaagacagaatctatcaggtccaaatagctgtgtgccttagccaagtcaattggctcctttcaggagttgactttccccaaatgtaaaataagaggaaggaggaatccaatcattaagtctgaaactgtgaagtttctgagacttttatgctacttacaagctaagaaattagtctgccagttttgtgtgtatacacacacacacacacatgcacacacacacacatactca

SEQ ID NO: 168631 - DNA, 601 bp, Human
cagaacgtgcccctgacgtcatccatgtccaatgtccacaccatggcccccccaaaatgctctcgccttataaaccatgcctgtaaaagtaacagtcagtcaacctgctgtacttgtcagtctctagactgggtacaatggcaaaaaactgaagatagtccctcaggaagcaatgtagctgggtggttaggagtgtagccagcatttgaatctagcttttactgtttattagctatgggatcctgaagaagttatgtaacccttatgtgtcttaactgcctcatttgtgaaaaaaaaaaaagaggataataacatgtccaacatgtttagacccaaaagattcttacatgcacatattacatacgatatggatgaagcgtgaagacactatgctaagtgaaataagccaggcacaaaataagaaacactgtatgactccatttatgtgtggtacctagagtagtcaaattcacagaaacagaaaatagaatggtggttgccaggggacgtgggaaggaggaaggggaagttactgtttaatgggcacagggtttccattcgagaagatgaaaaagttctggagatggatggtggtgataat

SEQ ID NO: 168632 - DNA, 601 bp, Human
tgtgtttacagtttatttaatggaaaagagattggcctattctggttttgatgcctgctttgccccgggatgagaaggcttccaacatgtcacttagaagaaaagacaagggttttccctggtttctgacaccagaggggcttaggcttcttcatccacagcagagttttctgggatttctttttttagagaaagaggacttgtttgaggggttactgagttgacagaggaatggtttccatagatgggaacaaagcggttgtcaaaagctagaggagtttgttccgggagctggatgacrgggctggaggacagcatcatcctgttttcagcttccatctgaagacccaagttacccatcctggggtgagtgcccacctcagaagtcaaattctcccctcttaaaggcatagtctgcccttcaggggtgactgatatgtttctggaggggacagtcaccttttcacgggccacagccttccttctaggggccactgtattctgtctaagggtctcagtctgaaaatggacaggggtcatagtcgttcctccagggctcacagactgatgactcacaggggtcacagactgatgacccaca

SEQ ID NO: 168633 - DNA, 601 bp, Human
gtctttgttttcactaccttttatttcccgattcctgcccccacccccttagctttaggtcagaaatttctttccgataattttgggacacttaaaccctctttcagacaagacacttgttcctgtaactgccaggaacgctctcatgtcacctaatgaccaagattttagcaggataagtaacgtattctaactaaactagaaattggttttgctgtcttctatacccgccctactcctttgtgaccttcccttgggaccttatgacatgtagcttccacagcctgaatccgagtagatkacatacccaagaataaattttgttcaataaaacagtaaagcatgttgtttacagtcggtttcccagatacctagtttttgctgccatatgataacaatcagagaaatcattcattgattcagtaaatatttatgttgcctaaaaacataaccaaggatacaagaatgagtatggctaattacctgccctcatggagctcacagtctaggaatgggaggcaccttaagagtattggtttagagtgagggctccacagccagtacagggtccctggcccctccacttactggctgtgtgacc

SEQ ID NO: 168634 - DNA, 601 bp, Human
gagaaatcattcattgattcagtaaatatttatgttgcctaaaaacataaccaaggatacaagaatgagtatggctaattacctgccctcatggagctcacagtctaggaatgggaggcaccttaagagtattggtttagagtgagggctccacagccagtacagggtccctggcccctccacttactggctgtgtgacctcaatttcctcatctataaaatggcgataatagtgcattgtggcttttgagaattaagagacaattgctgtgaaactcaaaaacagttcttggtacatagygtgtgcttagtaaatttagcagctgttaccgttaaaattgttccataagacatgtccattttcctagagatttctctttttacttccaaacttagttctaaagcttgcaaaatacggtaactcaaattgaaaaaaaatggacttgaaaaagtggtcttatctataattaagtctcatgtatgcaaaaagtaaggctataattgactgcttccaacttagaagaaaaaggaccccatacagactggtaaacaaataattgtaataccaggtagtaaataacttatacttacaagatacaag

SEQ ID NO: 168635 - DNA, 601 bp, Human
ctccacagccagtacagggtccctggcccctccacttactggctgtgtgacctcaatttcctcatctataaaatggcgataatagtgcattgtggcttttgagaattaagagacaattgctgtgaaactcaaaaacagttcttggtacatagcgtgtgcttagtaaatttagcagctgttaccgttaaaattgttccataagacatgtccattttcctagagatttctctttttacttccaaacttagttctaaagcttgcaaaatacggtaactcaaattgaaaaaaaatggacttgaaraagtggtcttatctataattaagtctcatgtatgcaaaaagtaaggctataattgactgcttccaacttagaagaaaaaggaccccatacagactggtaaacaaataattgtaataccaggtagtaaataacttatacttacaagatacaaggaatatccttggttttctttcacactccatgtccagtacctcagcaaggctcttcctctagaaatttggactctgactgctgcttccactaccgctaaagtaggaaccactataaactttcacctaggtattttagtagtctcttaat

SEQ ID NO: 168636 - DNA, 601 bp, Human
gtaactcaaattgaaaaaaaatggacttgaaaaagtggtcttatctataattaagtctcatgtatgcaaaaagtaaggctataattgactgcttccaacttagaagaaaaaggaccccatacagactggtaaacaaataattgtaataccaggtagtaaataacttatacttacaagatacaaggaatatccttggttttctttcacactccatgtccagtacctcagcaaggctcttcctctagaaatttggactctgactgctgcttccactaccgctaaagtaggaaccactataaaytttcacctaggtattttagtagtctcttaattagtcttgcatctctattcttgtcccattacagcccattctcataatagccaggaggattatgtcaatcccccaccaaggccttccagagctccccatcccacttgaataaaatccaaacttagcataacccagaaggtccaacatgaattgattccatcctatctcttgacaccatctccttgtggtctctttttagctcattctccaaccttggtgttcctctgaaaactaccaagcgcattcttgcctcaatatctttctacttgc

SEQ ID NO: 168637 - DNA, 601 bp, Human
gtctcttaattagtcttgcatctctattcttgtcccattacagcccattctcataatagccaggaggattatgtcaatcccccaccaaggccttccagagctccccatcccacttgaataaaatccaaacttagcataacccagaaggtccaacatgaattgattccatcctatctcttgacaccatctccttgtggtctctttttagctcattctccaaccttggtgttcctctgaaaactaccaagcgcattcttgcctcaatatctttctacttgctcttctctcttttccccagatsattgggtcaaatgtcatctgactccctaccaaaaaactcttccccattttgttgctccctatccgcttaccttgctcagtttttctccatagcacttagagctgcctgaaattttgtatggagatacacactcacccttcccatacccccactagaatgttgaaggctggagctttgttcattgccatgttaccggtgcctagcattagtagaaagtcagtaaatgttttttttaattgattaaaagaatgaatgttagcccaaaatggggggagggctttacaaatctggaggctaatt

SEQ ID NO: 168638 - DNA, 601 bp, Human
ggattatgtcaatcccccaccaaggccttccagagctccccatcccacttgaataaaatccaaacttagcataacccagaaggtccaacatgaattgattccatcctatctcttgacaccatctccttgtggtctctttttagctcattctccaaccttggtgttcctctgaaaactaccaagcgcattcttgcctcaatatctttctacttgctcttctctcttttccccagatgattgggtcaaatgtcatctgactccctaccaaaaaactcttccccattttgttgctccctatccscttaccttgctcagtttttctccatagcacttagagctgcctgaaattttgtatggagatacacactcacccttcccatacccccactagaatgttgaaggctggagctttgttcattgccatgttaccggtgcctagcattagtagaaagtcagtaaatgttttttttaattgattaaaagaatgaatgttagcccaaaatggggggagggctttacaaatctggaggctaattggtcttggtagtcattgctcctgattggtcttgatagtcattgctataaagtcatggtatgaagg

SEQ ID NO: 168639 - DNA, 601 bp, Human
tactgtgcggggtattgtgcttaacattatttctcaaatttatcagactgaagaaggtactgtccccattttacaaataaggaactaaattcagagattatttagattgctcagtttctttaaaattgtagagtcagtatacagatttccctgagtccatatctttgttctttcaactctaccatactgcttcccaatccagtgttttgtctttgaatctaattaagtcattactttgccttcagctaatcaaatatagaagtacctttctatcttccctcttttaggcatagcatatccmttcataaaataactctttcttcttttaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgaggtaagaaccataaactttatttcctattttagactagcagaaacatgaaggtcatctagtgatatttttgatatgagtgttaggggagcaacatatagaaatgaatct

SEQ ID NO: 168640 - DNA, 601 bp, Human
ggcttccatccaacacatccagaatgcaattgatacggagaagtcacaacaggcactggttcagaagcgccattacctttttgatgtgcaaagggtaggtttcagaagtttctaggaagaatgaagttacttgttgtgtgcatttttttaattcagaattttttatgaagaatggttaaatagattgaacgtattttatttagaaaagagaagatttgtgtaggagttggcattcacggctattcaaacatttaagaactgtcaagtggaaaaatagttcaaattattataaaattagaawctatagaagctattaaaaaaaattttggatccacacaaaatgaaatagtcattaagttaaagctgatttaaaaatggcatgcactgtgtaaggaagactaggtaaaatacatcctgtgtatttcatacacacttgctgcaagaacatcttaacatctttgctgtaaggaaatctgatactgtacattctaaatccacaaagcaggcagggcacagtggctcacacctgtaatcctaggacttgaggagggtgaggcagcaggactgcttgcacccaggaggtcaaggctggagttagctg

SEQ ID NO: 168641 - DNA, 601 bp, Human
tttctagccagcctttgggagaagcacagaaaataaataattgaacagatgcaaatgtcaacaggtaataaatgccagatagaaaaataaactagtattaaaaagattgcaggccaggcgcattggctcatgcctataatctcagcactttgggaggccaaggcgggaggatcacttgagcccaggaatttgagaccagcctgggcaacatagaccccctttctacaaaattgcaggaggagggagtcactgtttttatagggcattcaagaaatgtctctaatatgatatttgagcagasacctgaaagaactaatagtgcaaagtatgtggatttttggggaaataagttccaggctgagggaagaacagttgcaaatgccctaaacctggaagtttgcttgatacagtcaaggaaaagtaagaaggcccatacagctgaagtagaattggtcgggggagaataaaaggagatagagggaggcctgggactgtgatatataaagaccttaggctcctataagaactttgacttggactctgaatgagagaaagtcattgaaggatcattctgattgccttgttgccaatagccttcagt

SEQ ID NO: 168642 - DNA, 601 bp, Human
agctgctggacaaacaaagaggttttgctttctcaatcttgaggagaatctgtactattttgaaattgtggttgaatgggagcaaagactgaactgaaacattatttcctgtgatgtttcctgtgtgggccagttaagaacacttaatttttaaatgaaaggattgggtacctttatattcatgaggaatgattccaagttcatgccttcacagctatggttaccaccacctaagtgacctcacctttgttcactgacaagaggcacaaactggaaaggacaaagtctgttggtccttggktttttgtgccctctgattgacctctgactgcacagaggccctcggactctggttctcctttcccactcctaccccatggccagatatggcacttggtgctggagatacaggataacagaaaagattatcatctgaaaggagttgtagagtttattatggatgacagtcacagcaatatacaaatacagtgcaatgtgctcttttctataatagatggagaacgtgcacaaactgtaggagttaggagtgtgccaaaaactgcctagagaggtgactggtgggttcactttcacagaagta

SEQ ID NO: 168643 - DNA, 601 bp, Human
ataggagctgtcgcaactgtccaatctgcttacttttcaggtaaaatgacttgtccaaaaatcataaaattacttaatagttattcagaatgtcttctgattctctatggcatgctctttcttctacattatactatagtcccttttctaagagattttttattaagtaagcatcattagactgtattcttcatttacataaattcctagtgcattttaacataagcaaacataaaaataccacttaattgtaaatgtaattgatcttaagctactatgctagcaaactaaatacttaacrtatattttattttccaaacctttttgtttggccttttctatttcaggagaactagattgaggaataggggtaagaaatgattttaatgcctcatatcttttaaaacttgttaaagtttacttgttaaagtaaatttgaacttatggcttaccttatatcaggagcaaataaaggcattcaagaattattccatagtttagtcttcttaaaataactattgtagaatctcagtatttataacatagaagacaaattgtaatgattttgagatgagaatcccttagatcatttatttatttc

SEQ ID NO: 168644 - DNA, 601 bp, Human
ttcctgaatttttcttgccattgatattcttgaagagtaaggtcagttcttttttagaatgtttctccatttgggtttatctgatgtttcctcatgattagattcaggttatttaaatttttgataggaataccaacaaagtggcttttcttatcccacaaagagtcttgcttaatctgagcatagccagcctgcagacaccatggacaggcctctagccgagggaccccgtatgtaaagttctgcatatttctacctaggaggacggagaacctctggtctcttgactctgtaacagtgytaactgttttaggtaactgttcctgatttacgaagtaagcttattagaagagtccctgtcccacctcagctgttattagtatcttgctaagctcccacatgggaggaagtgagcttccaagatcatctggatttgtctttcttcactttttctctcctcttttcttcttccttatttctctcttcttctataaatcgccaaatcctctcccctaacagcgacctagaagaaacaaaatttttatcagattacaattttaggaaggaataagataacagatattccttgattagttgatgg

SEQ ID NO: 168645 - DNA, 601 bp, Human
taggaaggaataagataacagatattccttgattagttgatggagagatgagtggacacgaatacatgagagttgatgctttggcttcgttttattttactcctacttcttcctctacaactgcttattactcttcaaaaggacgtacagcgataactttgattgcacctcagccactgctcacaggagttcaaacgagctgatgaaaaatggaaggtcttctcctggatgctcaacacattgcaccaaatgagttgggaagtaataggcacaaaaccagagcctgggacggtggaaagarcatgggctttggaggctgaaagaacttggccttcaccctgcctttgatgattcttagctgggtgaccttgtgccagtcctcggcttctctatttgcagaatggggctaatgacacctaagttgtcaggccgatttgaggattataaataagacatttatgaggaacttagttattttgtgggattcagtgaactatctattatgtatctcagtttgtttgagcaaggcctacatttgggagccctcactggggcagattttcgctcctatttagaaaaactttttcttaatcacagcctc

SEQ ID NO: 168646 - DNA, 601 bp, Human
gatttcagaagattttatgctttcttctttatacttttctttattttttaaatgtagaatttttttttaaagaaagcatgcttacatttgctttctattgctggatttttcaactttttctaataggtttgaatggagtaagaaatgtgttctaataatatatattctcaatcttagcttacaaaggtgtttctctaccaaacacttccattcactgaaagaaaacaatttatgcatcttaaagaaactgtgcttacatttgccttttattgctgggattttccaacatgtcttaacagakttcagtggagaaagaaatgtgttctaataacgtattctcaatcttagcatacaaaggtgtttttctattaaacgcttttcttcactgaaaggaagtcttacagaaactgtacttgcatttatttatttatcttttattactgaaatttaacattttcaatttgttctaataggtacaaatggaaaaaaaacatgtgcttttctttattgtttgatttctttttgtttttttattttttttacaaatggcacacgaaacctctttttaaaacgtatgaaacaagcaagggattattcttgc

SEQ ID NO: 168647 - DNA, 601 bp, Human
tgtgttctaataacgtattctcaatcttagcatacaaaggtgtttttctattaaacgcttttcttcactgaaaggaagtcttacagaaactgtacttgcatttatttatttatcttttattactgaaatttaacattttcaatttgttctaataggtacaaatggaaaaaaaacatgtgcttttctttattgtttgatttctttttgtttttttattttttttacaaatggcacacgaaacctctttttaaaacgtatgaaacaagcaagggattattcttgccccgtgtatgttttattmctaaaaatctgttagaagctaagggttacccttaggaatggactggtaggtaaggtctgaacttgatctttcagtgagttttcactgaataaggcagatacacagggactgagccatcctggaaatagtatctcatttagccctcagaacaacctctgaggtaagtattaataaccctatttcaaagatatagtgaaagacaggttaagcaagttgcccaaggtcacacttctgataagtagcactaacagaattcaaaactagacctgtctgattccaaagctagtgtttatcaaactg

SEQ ID NO: 168648 - DNA, 601 bp, Human
ctcagaacaacctctgaggtaagtattaataaccctatttcaaagatatagtgaaagacaggttaagcaagttgcccaaggtcacacttctgataagtagcactaacagaattcaaaactagacctgtctgattccaaagctagtgtttatcaaactgtgttccacagaatactatgttatttgacctgttaataagtgatctgcaacataaaactaggtttgtagttatataaacatatttttgtcttagagactcacagtgcacattagcatataacaggtttttctcttacactgttyttttttctttatcttggcttttgtttgaggagcacttactaatatctcataagcgtaatggtctatgtagcaccaaagctgtcttatgtggctccagcctagcttgtaatattggatcagataaggctgaagatgaagaactgatagaggttcttttttttttaacttaaaaaaattttaaaatagagacagggtctctctatgttgttcaggctggtcttaaactcctaggctcaagggcttctcccacctcagcttcccaaatggctgggattacaggtgtgagccaccatggcgagc

SEQ ID NO: 168649 - DNA, 601 bp, Human
gacagggtctctctatgttgttcaggctggtcttaaactcctaggctcaagggcttctcccacctcagcttcccaaatggctgggattacaggtgtgagccaccatggcgagcctgatcgaggttcttgaagcctctatccaaccttaaccacttctaagcttgattaaattcaagagtagattacatggtgctgttagtacaggtcaaaaaaaagacagggatggaattagaaatccgcaggttctaccagctcaagcccattggaggaaactaaagagcaaagttgatccctaacctcyatgttgagttgtggaaggtagccacagttaagtgcagtttggtcacgcaggtttcctggaaactgatattggtggctttttgcatagaaccatgagtcatgcatctaagagtcatagactttgactgtgggaggggtgtcagttcctctagatggtagttggaaggggtgggaggcttaatcactgcccagtaacagtgaaaaggggaaggggaaacggagcagcattctctctggggcccttatggcatgtggcaaaagtagtgacaatcttcaccaggtgagaagattttcttactca

SEQ ID NO: 168650 - DNA, 601 bp, Human
ttttgtcccttctgtgccttgtcttttcattctcttaacagtgtcttttgaagagcagaagtttttaattttgaagaagtccaatttatcaacttattgtgcttttggtgtcttatctgagaactctttgcataaccaaggttgcaaatatttccttctggagaattatagttttggattttacctttagatctatgattcatcactagttacgatttcgtatggagagaggtataaatgcaagttcatttttgcatattaatagacaattgttccagcaccatttgttgaaaaaagtatycttcattctgtaatatattaattttgtattttttttgaaaatcagttgtccatatgcatatggactctattctgttctcttgatatatttatttaacaccagtgctatcctgtctttattgttgtagttttatagaaagcaatataattaggtagtgtttgtactccaattttgttctttatcaaactcatttttactattctaagtcttttgcattcccaaatgaattttagaattaatttcttgaagcctacaaaaaattctgctgtaatattgatggggattacaatctatagataa

SEQ ID NO: 168651 - DNA, 601 bp, Human
tctctacactattattatcataaagtttacttttacatttattattaatgcaatgcaatactgttactatttttgtttgaacagttcagtatctattaaagagatttgggcaggcgcggtggctcatgcctgtaatcccagcactttgggaggccgaggcgggcggatcacaaggtcaggagatcgagaccacggggaaaccccgtctctattaaaaatacaaaaaattagctggacgtggtggcaggcgcctgtagtcctagccactcgggaggctgaggcaggagaatggcgtgaaccrgggaggcggagcttgcagtgagccgagatcgcgccactgcactccagcctgggcgacagagcgagactctgtctcaaaaaacaaaaaacaaacaacaacaacaaaaaaagagatttaagacgaggtgcggtggctcaagcctgtaatcccaacactttaggaggctgagacaggcagatcacctgaggtcaggagttcgagaccagcctggccaacatggcgaaaccccctctctactaaaaacacaaaaaattagctgggcgtggtggtgcatgcctgtaatcccagctactcaggagg

SEQ ID NO: 168652 - DNA, 601 bp, Human
acctgaatgtatacttctgaccttcagaactgtaaaataataaatttgcgttgctaaggcacgaagtttgtggtaatgttttagcagcaataggaaactgatgcaagcacccgctgcgaatctctggggtttgctctctgtgcacctttcttttgtacattgcggtgtcctgtaaaccctagctgccttggtctcctcaaaatctcagctctgccaggctctccctctatgctccatggtttggaaactgtctgtgaatataagctgaggcaatcacagggctcacaccatttatttcccrtctctcatgggtccgtgcccttcattgtctcacattcagtgttttgcagaccattattttatagtctacattttttagctgtttcaggtgagggggtaaatctggtccctgttaatccattggccagaggcacatttcccaaatatatgattttatatttttacgttaagaaaaggaaaatgaaaaaggtgaaatgaattttaataacattttagttatctcaatatgtacaaaatactataatttaaaaatgtaatccatattgaaaaattactgatataatcctttttgtactaagtg

SEQ ID NO: 168653 - DNA, 601 bp, Human
agtttgtggtaatgttttagcagcaataggaaactgatgcaagcacccgctgcgaatctctggggtttgctctctgtgcacctttcttttgtacattgcggtgtcctgtaaaccctagctgccttggtctcctcaaaatctcagctctgccaggctctccctctatgctccatggtttggaaactgtctgtgaatataagctgaggcaatcacagggctcacaccatttatttcccgtctctcatgggtccgtgcccttcattgtctcacattcagtgttttgcagaccattattttatartctacattttttagctgtttcaggtgagggggtaaatctggtccctgttaatccattggccagaggcacatttcccaaatatatgattttatatttttacgttaagaaaaggaaaatgaaaaaggtgaaatgaattttaataacattttagttatctcaatatgtacaaaatactataatttaaaaatgtaatccatattgaaaaattactgatataatcctttttgtactaagtgtatattttacacttatagcacatagtaattcagactagccagattctaagtgctcaaagctgta

SEQ ID NO: 168654 - DNA, 601 bp, Human
ttttttaaaattctagataaaatgaataagattatttattcatagatgtgtcttactctatgagatattttgtcagtgtgatactgataaagggctgggaaacactcaaattcatcattcactcctgataaacagagtagttctttaagactcaataattggccgggtgtggtggctcaagcctgtaatcccaacactttgggaggctgagacgggtagatcaccaggtcaggagttcgagatcagcctggccaacatggtgaaaccccgtctctactaaaaaaaaatacaaaaattagcygggcgtggtgacgggcgcctgtaacccagctactcgggaggctgaggcaggagaatggcttgaatctggaaggtggaggttgcagtgagctgagatcatgccactgcatgccagcctcggcgaaagagcaaaactccgtcaaataaataaataaataaataaataaataaataaagactaaataatcatgggttcaatttattgagtaccggtcttgctgtatgccagtctgtgtgataagatcatttaatattcacaaccaccctataagggataagtgttggcccgttttacatagga

SEQ ID NO: 168655 - DNA, 601 bp, Human
ttaaaattctagataaaatgaataagattatttattcatagatgtgtcttactctatgagatattttgtcagtgtgatactgataaagggctgggaaacactcaaattcatcattcactcctgataaacagagtagttctttaagactcaataattggccgggtgtggtggctcaagcctgtaatcccaacactttgggaggctgagacgggtagatcaccaggtcaggagttcgagatcagcctggccaacatggtgaaaccccgtctctactaaaaaaaaatacaaaaattagccgggygtggtgacgggcgcctgtaacccagctactcgggaggctgaggcaggagaatggcttgaatctggaaggtggaggttgcagtgagctgagatcatgccactgcatgccagcctcggcgaaagagcaaaactccgtcaaataaataaataaataaataaataaataaataaagactaaataatcatgggttcaatttattgagtaccggtcttgctgtatgccagtctgtgtgataagatcatttaatattcacaaccaccctataagggataagtgttggcccgttttacataggaagaa

SEQ ID NO: 168656 - DNA, 601 bp, Human
ttctagttgaaaaaaataaagcttacattgctatctctttttacttccccattgcatatttgttggcttgttttatctttgctgtaagactgttgtcttctggaggatagctactgcttagtcatggttgcatcttccacaacatctagaacagaaaacataaatgtttctgcaataaaagaataaatgaggcgtggatatgttccccctactttcatgtggagaagtttactgatcaaatgtagcatgtacataaatcacagagtatttaagaaactggctgatcaagctgttggctttyttgatggctgattgaccagtccatccctgacttcaagggcttaagtgcccaggcactagttgctaatgctgcagttagagctaaagcactggcctggtctctgtcactgtgactcatcctcttctaagaatggctctattttcttctacaatacttaattcaatgttaagcattgttggcttgccgaattgggcaaaaactgaatgtctaagatgagccagttggtatttcagtttagaactaggaaagcgcagagtttggggaaactttccagaggagagccacagctcaaacccaagg

SEQ ID NO: 168657 - DNA, 601 bp, Human
ttttcttgtctttttttctagattccttgaaacaataagtgattgaaaggaaagtcaccctttccagggaggtttcactgtataaaattcagcaattgaatttcagatataggatgggttggtacttgtgtatatgagaagattattataagtttggcttctctagttttctgcctagcaagatgagcttcctcaagcagggcatcttctctacatggtcatggtttctacagagaaagccatgtgtgagcgactgaaaagataaggaaaaagaagttagacctatatatggtgaagataytgtgtggctcacagaagtgatctttccttggtatctggagatgggtaggaagagttgtgagtaggtctccacatgagaaagctgagattgcctctccaatgtaagcatggaaaagtttggtaaagaaattgttcatgagactcttgattgagccagttaaaaataaagtgattctgatctcaaggaagtgagaatatgaggagatacccaagaaccacattttgcttcaggatgttgtgggattcttcctttcagatctgtggctgctgcattttgggctttgggatctacctgctgatc

SEQ ID NO: 168658 - DNA, 601 bp, Human
tcagcctcccgagtagctgggattacagtcatgcgccaccatgtccggctaattctgaatttttagtagagacagggtttctccatattggtcaagctggtctctaactcccgactttaggtgatccacctgcctcggcctcccaaagtgttgggattataggcgtaagccactgcgcccagtctgtatgggtcaactcttaaactggagccaagagaaagaattttttaaaaagtccctcttctcagatagttgtcagactaatggcaaaggatggaagatagcagacatggggtaaggyaaatgttttaagcagtcaaaattaatgttggggtaaaaaaggtgaaggagaaggaataagtgaaaatgttttctgttgtgtgttattagcataaaaggagtaagcatcgaaagctggaaacaaatatgagttagaaccatggctaggacccttctttctaccattgtacagggctcctctcagccactaccagcagtcctccacccagaggtatccctgatcttgtagaaaggaccaggccccaaatgatctagtttaccaaccttttgcttaactgcttcaataggcagatgtcaaaat

SEQ ID NO: 168659 - DNA, 601 bp, Human
tcctccacccagaggtatccctgatcttgtagaaaggaccaggccccaaatgatctagtttaccaaccttttgcttaactgcttcaataggcagatgtcaaaattgcttaacttattcaacaggtggtggtgtgtatgtattatgcatgtagtgctctgataggcacagcaggtaggagagagcaaagaagacagttgatctgccctctagagtctaattgtagaaaaagaacacatattttcacaaaacaaaagaaggcttacaacggcctgaggaggcagaacaggaacaccctgtackcgtgcaaatgcccctggatgctcccagagctgagtgggagtgggacgagaatggggatcagtgctgtgagaatgtatctgctttgtcccagttcttcatcctgctgctgattatcctccttgctgaggtgaccttggccatcctgctctttgtatatgaacagaaggtaagttataaagacaacaacttattgtcttaatactgaaagtggggagtatgcagtggagaagttggtacaaagttacagaataagttctataatagagatagacatgaagtggaaggatagaggaaacagag

SEQ ID NO: 168660 - DNA, 601 bp, Human
cctccacccagaggtatccctgatcttgtagaaaggaccaggccccaaatgatctagtttaccaaccttttgcttaactgcttcaataggcagatgtcaaaattgcttaacttattcaacaggtggtggtgtgtatgtattatgcatgtagtgctctgataggcacagcaggtaggagagagcaaagaagacagttgatctgccctctagagtctaattgtagaaaaagaacacatattttcacaaaacaaaagaaggcttacaacggcctgaggaggcagaacaggaacaccctgtacgygtgcaaatgcccctggatgctcccagagctgagtgggagtgggacgagaatggggatcagtgctgtgagaatgtatctgctttgtcccagttcttcatcctgctgctgattatcctccttgctgaggtgaccttggccatcctgctctttgtatatgaacagaaggtaagttataaagacaacaacttattgtcttaatactgaaagtggggagtatgcagtggagaagttggtacaaagttacagaataagttctataatagagatagacatgaagtggaaggatagaggaaacagaga

SEQ ID NO: 168661 - DNA, 601 bp, Human
gaggaggcagaacaggaacaccctgtacgcgtgcaaatgcccctggatgctcccagagctgagtgggagtgggacgagaatggggatcagtgctgtgagaatgtatctgctttgtcccagttcttcatcctgctgctgattatcctccttgctgaggtgaccttggccatcctgctctttgtatatgaacagaaggtaagttataaagacaacaacttattgtcttaatactgaaagtggggagtatgcagtggagaagttggtacaaagttacagaataagttctataatagagatagamatgaagtggaaggatagaggaaacagagagtaattgtaattggggggaaaaatttgtatgaaagagattgtatctgagtggtatcttgaggggtgcctggaaagagcagtaaaacaagtgtctcttcctctacttgctttcctctgtgtgtttggcaggagagaatgtctgcctcagtgcctaaggatagcccttgctttaattgctccttttcctcccttgtaaagccagagctctagaaggaagcaagcctactaaatacttcttccttcaatgccacctcatgctcagcatgtatgc

SEQ ID NO: 168662 - DNA, 601 bp, Human
tcactgttgactttctaaccatcatcattttgggggtttggcttttagctgcagtgttgtggtataaatggcacgagtgattggaccagtggcccaccagcatcttgcccctcagatcgaaaagtggaggtaattttgtcggcaatgtttctgttattgacctctttgtttaaatgtttaattacctcggaaactgcagtcatagaggacctagaccttctattgagaaacaggggaccttgaataaaagagaggccagggcaacaaccttgggtaattagaaaagtcagaaaaacatacraacaaactcatttagactagagacactgtgattgatcttgctacactagactattacattagaggggaacagttacttttgtgtgaaagtaggagagggttgtgtctagatatttcttaagcaagaagtaggtctccttatggttaaagtgaaatgtatagggttgagatagaaaagtttctccctctccctctttctctgctcttcttccttggagatggcagaatccagccccttagggaaatgaatcataggtgaaggagtaaggagttgagggagacagagttagtggaactactg

SEQ ID NO: 168663 - DNA, 601 bp, Human
accatcatcattttgggggtttggcttttagctgcagtgttgtggtataaatggcacgagtgattggaccagtggcccaccagcatcttgcccctcagatcgaaaagtggaggtaattttgtcggcaatgtttctgttattgacctctttgtttaaatgtttaattacctcggaaactgcagtcatagaggacctagaccttctattgagaaacaggggaccttgaataaaagagaggccagggcaacaaccttgggtaattagaaaagtcagaaaaacatacgaacaaactcatttagaytagagacactgtgattgatcttgctacactagactattacattagaggggaacagttacttttgtgtgaaagtaggagagggttgtgtctagatatttcttaagcaagaagtaggtctccttatggttaaagtgaaatgtatagggttgagatagaaaagtttctccctctccctctttctctgctcttcttccttggagatggcagaatccagccccttagggaaatgaatcataggtgaaggagtaaggagttgagggagacagagttagtggaactactgaaacaacctgtccaatt

SEQ ID NO: 168664 - DNA, 601 bp, Human
tttatacttgacataaatattaaaactttatcagttgaataacaacttgttttagctggatcagaaacaataatctgaagaaagtgaaataattagataaaccacttagcagtgtgatatggcaagtagataagtaatagctaaaagtagaatatccactgtttatccatgatatatattagttcactgatgttcactgatctttgaaattatactgcttcttgtgttttttgtttgtttgtttaaggcttagttacagtgcttctgtagcagtgttggaaatactctgcctttctcagayaaccttctctcccacactttggaggtgaatcaggaatttcagttctcaatgaatgcaagaaatgcaacactctctctttctataacacaatcaggctctgtctcactattcctacagtattatttatacttgtaactttaccgtaatcaaagtggctcctaactaagaaaaaaataaaagactaaagaaactttcaatataggttaaataatataagaactagaattaaaaataaagctcaagatcacagtaaattttttttatttctaccaattgctagttattagtggtgtgatatca

SEQ ID NO: 168665 - DNA, 601 bp, Human
gaacatatgattgttttcttcttttgttttgtatcatattttataaaaatgtattagaaaattagttagaaggatattaattagaaaactacgttttaattaaaatacttctttttgaaaaatagttaaagacctgttcttggggcaatattttcccaggctaattgtgagatgcaagcttaaaacacagttatattcagaaatggtaaaattttgaaggataatttaaatctaggagttacaaaaaagagtcttagttaaatatatatatacatatatatatgtatatatatatatatakagagagagagagagagagagagagagtcattcttttttgtttggtttggtttttggagactgagtctagctctgtcacccaggctggagtgcagtggcatgatctcggctcactgcaacctctgcctcctgggttcaaactattcttctgcctcagcctccgaagtaactgggattacaggtgcctgccacctcgcccagctagatttgtatttttaatagagactgggtttcgccatgttggccaggctggtctcagactcctgacttcaggtgttgtgcctgcctcggcctcccaatg

SEQ ID NO: 168666 - DNA, 601 bp, Human
acaaagtaaattgaagtaacaccatgaatacagtggttaagagttctggtatcagtatgatttaagaccataaaaatacaaatttgaataaacactcaatcacaactgtttaattatgagaaaatcgtaagtatattgagaatagtatttggtttactgactattgtatcacaggaccataaacaatgcttgaaaattagtagataatgaacatatgattgttttcttcttttgttttgtatcatattttataaaaatgtattagaaaattagttagaaggatattaattagaaaactacrttttaattaaaatacttctttttgaaaaatagttaaagacctgttcttggggcaatattttcccaggctaattgtgagatgcaagcttaaaacacagttatattcagaaatggtaaaattttgaaggataatttaaatctaggagttacaaaaaagagtcttagttaaatatatatatacatatatatatgtatatatatatatatatagagagagagagagagagagagagagtcattcttttttgtttggtttggtttttggagactgagtctagctctgtcacccaggctggagtgc

SEQ ID NO: 168667 - DNA, 601 bp, Human
tataataattatgtcaaaattttatatcaattttgtattttgttattaatatttacttatttaaatatattctggtaaaatacagtgaaaaggaatttttagaaatcactaaattttgaatgactccaatcatcctttatcaaattacataaacatgggcatttggtatccactcaacatttggttttgaaatataatatttaaagtaattgaattcccttataaatagaaaatattatacctgaacttgaacctaatacattttttgtagtgtgatgactccaattatatatttatttckacattttcaaatattagcaggcaaggttgggataaaacttacataattaagaagatttttttttttagtttctagaagttaaccactgtccacaactacaagcatcactcacgttacctaactattattgataacattttcataattggaaacaattaggaaatgtgtaactacattctcaagtgcttttccatgttataatctttattatattgaaacatagcctgttttttctttcctaggatatattaacttaaacactgcttcatgtaatactccattgagtttacaaagtaaatt

SEQ ID NO: 168668 - DNA, 601 bp, Human
aagttttcattttgttgtagtcaaatttatgtatgtttctcttaagatttattctccttgtattctgcttaagaaattatttctctaacctgatgtcataaatttaccattttatattttcttctgaaatggataaagtttattttacacacataggtcccttaatctatctgggactgtttattgtgcatggtgtgagaaattgacacattttatattgtttcctaaatactgagtcaatagtccatataaatagttgatacttcccttcactgctgtcatttaacaaattatacatgcrtgggcctgtgtcttattttgctgtgttaatctatttgtatatccacagtccagtatcattgtgttaataactacagctttatctggttagaactaatcctcattctttttctctacttctttaaaatgtattgttttccatatgaagtttagagtcaccttttatgtttcccaaaatcccttttattgtttaaattggaattccacaaaattttgataacattttgtagagaatgcctattcctaatatattgagccttcttattattgaacagggtatatctttaatttacttagctat

SEQ ID NO: 168669 - DNA, 601 bp, Human
acatggagaacaagaggctcttacttcatatccgtcagaattatggtttctggaaaatggataaaatgccccaagttgcatccatcttctgcaaagttcttctgtggtttcagccacaaatccacagatgtctgctccaacctaaataacaaatatatttactatttataatgttaagattctcaaatttgcctagagcatcacactgtatgcctcaactgatgaatgtgccttatatacaatttgttttactccttttatatatgcttccttaaaccaatttattttccgtttttgctgyatccttgtctctagttgcattattttatatgttctttccttcattgtccctttatgcattttcttatccttttgtatttacattttactcattttttattttgatgttctcattaattcattgtaaaagatgaaattactgtattaaaatatgttggttgcttcttaatccctaactcaacttctttgatttgatttttcttatttataatataatatgtaactgtaggaataaaataacaaactgtgaccatgtgttcatgttgagctttgaaattaattattctgaataaaattgagc

SEQ ID NO: 168670 - DNA, 601 bp, Human
aacatggagaacaagaggctcttacttcatatccgtcagaattatggtttctggaaaatggataaaatgccccaagttgcatccatcttctgcaaagttcttctgtggtttcagccacaaatccacagatgtctgctccaacctaaataacaaatatatttactatttataatgttaagattctcaaatttgcctagagcatcacactgtatgcctcaactgatgaatgtgccttatatacaatttgttttactccttttatatatgcttccttaaaccaatttattttccgtttttgctscatccttgtctctagttgcattattttatatgttctttccttcattgtccctttatgcattttcttatccttttgtatttacattttactcattttttattttgatgttctcattaattcattgtaaaagatgaaattactgtattaaaatatgttggttgcttcttaatccctaactcaacttctttgatttgatttttcttatttataatataatatgtaactgtaggaataaaataacaaactgtgaccatgtgttcatgttgagctttgaaattaattattctgaataaaattgag

SEQ ID NO: 168671 - DNA, 601 bp, Human
ttatttcgcaacatggagaacaagaggctcttacttcatatccgtcagaattatggtttctggaaaatggataaaatgccccaagttgcatccatcttctgcaaagttcttctgtggtttcagccacaaatccacagatgtctgctccaacctaaataacaaatatatttactatttataatgttaagattctcaaatttgcctagagcatcacactgtatgcctcaactgatgaatgtgccttatatacaatttgttttactccttttatatatgcttccttaaaccaatttattttccrtttttgctgcatccttgtctctagttgcattattttatatgttctttccttcattgtccctttatgcattttcttatccttttgtatttacattttactcattttttattttgatgttctcattaattcattgtaaaagatgaaattactgtattaaaatatgttggttgcttcttaatccctaactcaacttctttgatttgatttttcttatttataatataatatgtaactgtaggaataaaataacaaactgtgaccatgtgttcatgttgagctttgaaattaattattctgaat

SEQ ID NO: 168672 - DNA, 601 bp, Human
tcaaacaagaaaaattaaatgtcttattaaggctcaactcaacctgtgtaatcctaaatctcaatgtattaagtctacatcttatgagaaaaaaaaatatgattaaaatttaaaaaaagtttagtggaatctgtaagaatcttataaatgaaatgattataacaggagtaatgagatgtagtcaagaaatatggtttttttttttagttacattttaccaggcatctcctggactgtataggatgtattccttccagtatgcatttaccaaagtgtttgttgctgttgatcattacagctstggtgtataacaattttttgagaacatactcttgtatcagttacattgtgatactagtccattccagaatgccaaaacagttaaattactaattactaatgcgtatcgctaacatactacatacaagaaaagaataaataatataatttcagatattcttaatgttatgaagaaaatacagtagggtaaggaataaagagtaacttcctgttgggttgtggcagaatagggaaaagtatgtaaattcaatacggcactttctgtgctctttgtactcagaatgaatatgtgaaatggagc

SEQ ID NO: 168673 - DNA, 601 bp, Human
tattagagtcataaagttcacaataagcttgtattacttaatttatatcaatttattcttatagtgctaggaaatataaatcataatatgcctattaaataaaaaataattgaccagtacatattttctgaaaactaataattgaaaagccctgggccagaggtcttatgagttaaaacaaaaatattataagacaatgttctatatcttaaataatttagaaattatttatggtaatattactaataatttagtattatataaatggagaaaagataaatgacaaaaataattgctttcrtgtttttaaatattacagtctcttttttaatacatcaatctactacccaaagcaacattatgattgaaatattacattttgcaaatgagaaagctaaaataatgagagattgatttaatgcgtttagaagcagagatagcagagttataatctgtgcatccaataacagtgcatccaattttgttattttttcccctctatactacaactgtaaaaagagacaaaaatcacaatataaggaaggctttctacaggagaagaaaagtgtaaacacaaaattaaagttagaaaagtacaaga

SEQ ID NO: 168674 - DNA, 601 bp, Human
ataatccagatatagttttagatattatttgtacatatcttgacaataccagaaaacatcctgataacatcatctaaggaatggcatggcaaacttaaattacataaaagtatattttaatatattatagtttatagatcttttgaataaaataaagactacaattttaaaattaaatttattcattgtaacataaaaatatatctagacttacatgttgtaacttattttcactaatacctggcagataaattattaattctatcagattcaagcaccaataaactatttcaacagtttyaataaaatatttacttcacttgtttccaaatacttatttttgccaacacttatcatgctttttaaaagaggttttggttttggttctcaacttgattagaagaatgagtctgatactaatagtgaaattgaacacctccaaagtgtagataaaattgtgggccaatcctttaaaatagtcccatggactatgtttagctagaaatattaaaatgggcaaagttatttaacacgtcttaaatttttttgtgtgatgctactctaggacagtgaaggctgttaatcattttacttttccctt

SEQ ID NO: 168675 - DNA, 601 bp, Human
ttttcattaaaatatattttttatgatatgtttggaatattatagataatattatttgttgcacagtacattaaatattcataaaatgtgttgcattaacgagacaaatctttggaaaaagagtcatgagtatataaaaacacattgtaaagatgtaattagcactttggccacataaagttacccaactgcaactgaaggttataaagggaaaaaagatcaaatcagtacctgagaagtaaaaacaatcaaggaaaactttaggcagttattttctaaaagctggagtaaaggtaaactygacagggaatacagaatcagcatattctttgtatgcatttgaaacagttaaggtattgagtcaaagcctggcttctcacagtagtcaagcaaattgttatccatccactcctctacttccacctgtaatttatggtgactttttgggtttgtttctcagaaaattgctatagctgctctggagatctctagctaatgcctttgtcattacttcaatcctaaagcacaggcccataaagaagtggcttggattctactcatggtcttagttgcctcgtggagtggtcatatgttggtacct

SEQ ID NO: 168676 - DNA, 601 bp, Human
gaactcctgggctcaagcaatcctcctacctcagccactcaaactgcaagcattacatgcatgtgccactgtgcccagccctgtctatattcttcactcagctttctctaatgttaacatgttatataacaatagtgaacttatcaaaaccaggaaattaatgttgatacagtacaatcaacatttattgaacatgtttgcattttgcagatttaatcactaatgtcttaattttggcccaagattcaaaaagcctctcacatttcatttaattgtgtctctcatcatagatttttttttkttgttgttgttgttgttttgagacggagtctcgctctgtcccccaggctggagttcagtggctcgatcttggctcactgcaagctccgcctcccgggttcactccattctcttgcctcagcctcctgagtagctgggactacaggcacccgccaccatgcccttctaatttttttgtatttttagtagagacggggtttcaccacgttagccaggatggtctcgatctcctgatctcatgatccgcccgccttggcctcccaaagagctgggattacaggcgtgagccaccgcgcctggc

SEQ ID NO: 168677 - DNA, 601 bp, Human
tcatgagtaggtttcatctgtgaccatccatagagattgtgaacatcgtaatgcaaaactgatgttccatcactaagaatctgctcagcttccatgcaaattgttctgaaatgtaatccatcagttctttttgtgagttctggaaagaatcaatgaaaaaatattaatatattatacagtgccctacaatgaaacgtgtaactcataattatgtattccttgacaaagaaattaatcagtgttttataaaacctatgtatattttaaccatttgtatactttgtatgagttaattatcaamttaaaatggcctgaaattgtaactgaattacatgaattaataaaaacctgaaaaataagtacactcctcaatgtctactctttctagtgcatttagatggaaaacactgattagagttttattaaaaattcacttggtatcataaagcccagagtttaagggctaggcaaatgttataacactgccttttgatccacattttctcagtttaagatttttttccagagttttgccatcacttaatatgctaatagtttgtgacgttttctgcctgcataagagaatgatgatgaatatgaa

SEQ ID NO: 168678 - DNA, 601 bp, Human
cctataatgtccctgacactggtagcttctgccctgacacccatgatctctactcatccatctacccatacctgactgtctctctgctgaactatggaggacagagattcaccctgtccaagtcatgtttggaaccctcttcctccttccttgtccatgtccattccctaattcaccattaaatagcaatcaatccctagtcttgactagggtagtcttactgtgatctataaaatctatattagtgatcatatcagttttttgacttgaaggataatatattttgtagatttttttttttcagaatgttctggacaattaattttctctaggccagatcacactgcctcctccatgagaattggcggcttcacctgtcagtcacatacccaatgccttaaattattgacctttgtattttctgcccttattctctacaatcagtcagttatgacagacaactttcaaatacctttctcttggctccaaaatttaccattgttttgcttaaggtctcaccttccatgtaggatagaaaacattctttcatctaaaaggtccccctcctccacctggccttagagcctcctaatgtccagga

SEQ ID NO: 168679 - DNA, 601 bp, Human
cctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcarggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttct

SEQ ID NO: 168680 - DNA, 601 bp, Human; identical to SEQ ID NO: 31598

SEQ ID NO: 168681 - DNA, 601 bp, Human; identical to SEQ ID NO: 31599

SEQ ID NO: 168682 - DNA, 601 bp, Human; identical to SEQ ID NO: 31600

SEQ ID NO: 168683 - DNA, 601 bp, Human; identical to SEQ ID NO: 31601

SEQ ID NO: 168684 - DNA, 601 bp, Human; identical to SEQ ID NO: 31602

SEQ ID NO: 168685 - DNA, 601 bp, Human; identical to SEQ ID NO: 31603

SEQ ID NO: 168686 - DNA, 601 bp, Human; identical to SEQ ID NO: 31604

SEQ ID NO: 168687 - DNA, 601 bp, Human
cagcaatgaacaaaatagacaataaacctctctctcatggaggtggcattctgattgagcagctgggtaaacacgtttatgaataacttcagagagagataaggtgttgtggaacccataaaatggggtggcgtgaaggccaagggcgtgggttccttgggtaggtggtcagggtgggttttctggagtaggacgttttggagctgagaacttcctcagaagcgggtcttgctgagatctggagaaagagcttccaggtggcagcaacagtgcaaaggccctcaggcaggaatgagtttgwgtggcccaggccaggatggccagagcacagcgggcagggcactgaggtcaaagggatggcagagaggtgtgcagggctttgtaagccgtggtgagaagttcagattttattgcaaatgccacggcaagctggagaagggttttaagctggagcggggccgtgacctgaattatcttttcttttttttttcttttttttgagatgatcactctgtcgccaggctggagtgcagtggcgtgatcccgctcactgcaacctccagctccctggttcaagcaattctcctgcctcagcctccca

SEQ ID NO: 168688 - DNA, 601 bp, Human
ccccttaggagagtggctggctatagtgggtactccaagtatcagctgtggctgcaattgctgggacatttggaagccggccatctgcaagaggatattcatacagttcaatttcacttctggcttctccctggagcttcagggaaagccacagcaggtctctggtgcaggagggacccagtgctctgtgacctctggttgagacactactctagtgtcaccaacgggaggcctgggacttgcagctggagatacttgcatcccaaaccagggttctcccccctccccctgccccctgacyctgtcccggggaagctgtgccctccacagcgaggggcttagaggattaagggatttcctccagtgtgggacatcttcactacagcctatgttaggcaggttattaatagaaaggatgcacacttgctaaacttaggtcaagccgtcttaatgtgttctccttaattttctttcttttctttttttctctttctttctttctgtcttctttctttctttttttttttttttttttttgacaaagtctggctctgtcatctaggctagagtgcagtggtacagtctcggctcactgcaacct

SEQ ID NO: 168689 - DNA, 601 bp, Human
gggcccaggaatttgctgattgattggatctggatcatggacaccaccctggggctgggcactgagggtggaggtgggggcagtcatctccacccaaaccaggagactgtgagacaaggaaaaggggcggctccctgcaacggaagatgaggagcggatgccaaataacagatgtgtatacctggaggctccttggggaggtggcacaggacctgggactgaagagggagagtagaggaacaaggggaccctttccttggggaacaaggacagtgcacgtaggaggcccagcacgtgcagwggtggagcggcatgaaagcatacagtatgtgccgggaacaaacatgttggcaaggtgtgtggggcggggctgtggcgacagagtccgggaggaggcgaagtggctgaggagttaggccagcccatgaagggccttgcctgtcatgctaaggtggtgggactgactcaggtgatgggaaccatggaaagggaatgttcttcctcgtcttcctaatggctccaactcctttgaggtcctcctttatatctacagtcccatgccacagtatcatttcaccatgctttatcccttggggttttc

SEQ ID NO: 168690 - DNA, 601 bp, Human
tcaattattcaagatttttaatctttattttatttattctcattcagtaggtggttatttctattttgtttcttctttatgccaagtaatttagatgtatattttatattttattttattttttaaagatagggccttgctctgtcacccaggctgggatgcagtggtgtgatcatagctcactgcagcctcgacctcctgggctcaagcaatccttctgcctcagcctcctgattagctggaactacaggtatgcaccaccacacccagctaatttttaaagaaaatttttctgtagagrtggtgtctcactatgttgtgcaggctggcctcaaactcctggcctcaagtgatcctcctgctttggcctcccaaagcgatgagattacaggcatgagctaccacattcggctttagctgtgtattttaagtttctccatgtatatttgggcggaggggggtgttgttgttactggttgttttttttttctctctgaatgaaaaagccatggttggaaaaaaaaaatgcttgtctgcaatgccaggaaccaacaggcttagttttgctatttggcctgttccctttgcactagatctgcag

SEQ ID NO: 168691 - DNA, 601 bp, Human
catattctggtggttaaaactagtcacagagctactcagattcagtgtgagagggaaccacataaaggcataacaccaggaggcatgactcattgggagccatctttagagaccagctcccacagcccaaaaagggcaagtgactggcctggtgtcacactgcaagttagttaccaaaacagaaaagaaccttgttttgcaaatctctaaattattgtcctgtcctcactactatatatgtgtaaaaatgacttgggggccctacaaatccctcaattagcaaaaaaaaaaaaaaaagagwgagagagacattgcaggtttttccatgagtctggaaattctgttgctcagtgtactaattgggagcttttaaattataatttacagaaaccaactcaatctgactaaaagaacaaagagtattggttggctcatgtaacgagagcccagtggattgggtaagcttcaggcactgctagatccatgggttcatgcaataatattgggatctatttcttgttatcttttggctctgctctcatctgtgttggtttcattttcataaaggccttctgcacagcatgaccaatgactattttgt

SEQ ID NO: 168692 - DNA, 601 bp, Human
catttaaaaatcagaaaatagtttataaaaatctggatttatggtttctctttaaaaaaaaaaccagatctggcagttcttgaccttcctgttttccaatttccttatctgtgacatggagatattagtaatacctaactcgtgaggttactgttccatggtgagcaggtctatgcaaacctacctctgaaggctgaggagctgagaggccaaagaaagaggctgacaaatccagtcttgcagaaagaaatttcacagggacataaaaacaggagccatatctcaggtagccacaagaccrtggattcccatacctgacctccagaaagtattcttaatatatcaagcttttagcataaaacatgtgcagctgatcatgtcttcagactttcttgccaagacttgtgaccactggagaggctggataagcatctttatgaagggttatctatgctacaggcatttttaaagaacttactgtagaacaacttggtatgtggggcccaaatatccatcatcatggtggtttcacttcaagatggcctcactctggccatgcaacagggtgttttcctacagttgtgaggattacatgaaatga

SEQ ID NO: 168693 - DNA, 601 bp, Human
atagtttataaaaatctggatttatggtttctctttaaaaaaaaaaccagatctggcagttcttgaccttcctgttttccaatttccttatctgtgacatggagatattagtaatacctaactcgtgaggttactgttccatggtgagcaggtctatgcaaacctacctctgaaggctgaggagctgagaggccaaagaaagaggctgacaaatccagtcttgcagaaagaaatttcacagggacataaaaacaggagccatatctcaggtagccacaagaccgtggattcccatacctgmcctccagaaagtattcttaatatatcaagcttttagcataaaacatgtgcagctgatcatgtcttcagactttcttgccaagacttgtgaccactggagaggctggataagcatctttatgaagggttatctatgctacaggcatttttaaagaacttactgtagaacaacttggtatgtggggcccaaatatccatcatcatggtggtttcacttcaagatggcctcactctggccatgcaacagggtgttttcctacagttgtgaggattacatgaaatgatgcgtttaaagtttctc

SEQ ID NO: 168694 - DNA, 601 bp, Human
acctccagaaagtattcttaatatatcaagcttttagcataaaacatgtgcagctgatcatgtcttcagactttcttgccaagacttgtgaccactggagaggctggataagcatctttatgaagggttatctatgctacaggcatttttaaagaacttactgtagaacaacttggtatgtggggcccaaatatccatcatcatggtggtttcacttcaagatggcctcactctggccatgcaacagggtgttttcctacagttgtgaggattacatgaaatgatgcgtttaaagtttctyacactatgcctggcacatagggatcagtcatgaaatggcagttactcttctaataatttgcctgagattatacagtcggtgtgttaacaatacctggagctgtgttgtgactttagatgaggcatgaactctccagtttggcaatccccaccattctttgttgtctcacatgcagcccgtgttcctcattgatcttaactggcagctccctgctatatagcatttcttcttagttttcgttagcactcttacctggacccttgtactagccttccaacctgggtttgctcttgctctttg

SEQ ID NO: 168695 - DNA, 601 bp, Human
ccctagcattgaaacccattctgaggtgtggtgggatggggtggaaatgatgtgggcccagaacaccagggaatgactctgagatgctgagatgctcatggctccaggccctggtcttcagtgggtattgctcatctgggccagagtacacaggctccttcactgtggtccccaaggcacagttcttagggttcagttattttcctattccctatggccaagagtttccttcccaaaggtgcagccaacttgggaggctggggggcagtgctgtgggaaaccccagtggaagaaccccccctatcatggctgtcttccaaccccagtcttagggaatccaagcttctccctgcagcctcagtcttcaagcatttccctttgtgtggagtaaatgagtgagagaggagaaagaaggagagaaacaaggaagggaggaaggaagggagggagggaggaaggaaggaaggaatttattagaattgtgtcatatatcatccccatttcacagatgggaaaatacatccttaccccgtccagccagggagtcaaaagactagaaccagccccactgccttccagcccattgctctccctgctggcg

SEQ ID NO: 168696 - DNA, 601 bp, Human
tttttttttgaaacagggtctcactctgtcgccctgagtgcagggtggagtgcagtggcatgatctcggctcactgcagccttgacctccggggctcaaacaatcctccagcctcagcctcccgagtagctggggctacaggtgtgtgccaccatgcccagctaatttttttattttttatttttagtagagacagggtttcaccatgttgcccaggctggtcttgaactcctgagctcaagtgatcctcccactttggcctcccaaagtgctgagattacaggcatgaaccactgcaccragcccaattcatgaaatttctaaggattttttttttttcaaactgagatttgccaaggccgtgtccatgcagctgtttggccactcagctggatccacgatccctcaggccaggctttcggagcccaagcgtgctccacgggatagtgctctagatgtgggtgaggggcctttcccataaacacaagttgcctttgtctctgtgcttgtggacttgcgtcctggctcatccccgcctttgagacaatcagcgagatttccgctttaaggtacttcactgacagcttattggtcactctgc

SEQ ID NO: 168697 - DNA, 601 bp, Human
gggcattcctcctgtcttccttattgcctgggcactatgagttttttttttttttttttttttttttttttttttgagatggagtctcgctctgttgcccaggctggagtgcagtggcgccatctcggctcactgcaagctccgcctcccgggttcacgccattctcctgcctcagcctctccgagtagctgggactacaggcgcccgccaccacgcccggctaattttttgtatttttagtagagacggggtttcaccgtggtctcgatctcctgacctcgtgatccgcccgcctcggcytcccaaagtgctgagattacaagcgtgagccaccgcgcccggccggcactatgagttttgtccggtcacacacaaactgttttccttgagttgttttgtgtctccctacagtgccttttcatttgactttaagacccagctcatggggatttaaaaatcatttgattatggaatcacaggaggctagaagagtagaatcttaaaaccataaactatcttagagtcacaggaccttggagtagcaaaatatcataactatggcctttaaacattgcacgcaaaacgcttgtgggcttcatg

SEQ ID NO: 168698 - DNA, 601 bp, Human
cccaaagtgctgagattacaagcgtgagccaccgcgcccggccggcactatgagttttgtccggtcacacacaaactgttttccttgagttgttttgtgtctccctacagtgccttttcatttgactttaagacccagctcatggggatttaaaaatcatttgattatggaatcacaggaggctagaagagtagaatcttaaaaccataaactatcttagagtcacaggaccttggagtagcaaaatatcataactatggcctttaaacattgcacgcaaaacgcttgtgggcttcatgcmttcattccgtggctatttattaagtccttactctgtgccagacagtgttcagagccttaggaaacatgctgagattaaggaagacaaagtgcctgtcctcaagagcttccatttgatgggggagggaagccaacaaatgcataaacaagagcgttttagttggtgatgagtaattaggagaaaatgaagcagagcaaaatatgttgagagggccaggttgacacaggaggaacaaagaagaaaggggttgtggctgaagtagagtgggtggtgagggagggaagtcgtctcagaggaggt

SEQ ID NO: 168699 - DNA, 601 bp, Human
gaatcacaggaggctagaagagtagaatcttaaaaccataaactatcttagagtcacaggaccttggagtagcaaaatatcataactatggcctttaaacattgcacgcaaaacgcttgtgggcttcatgcattcattccgtggctatttattaagtccttactctgtgccagacagtgttcagagccttaggaaacatgctgagattaaggaagacaaagtgcctgtcctcaagagcttccatttgatgggggagggaagccaacaaatgcataaacaagagcgttttagttggtgatgrgtaattaggagaaaatgaagcagagcaaaatatgttgagagggccaggttgacacaggaggaacaaagaagaaaggggttgtggctgaagtagagtgggtggtgagggagggaagtcgtctcagaggaggtggaatttaagttagtgagaaggaggcacccacgtaatgatgaggggaggagcattctaagcagaaggaacagcaagtgcaaaggccctgaggtgggcatgtatctggcatgtgcaaggaacaacaaggaagccagtgtgcctggaacagagggaggaagggaagagcgt

SEQ ID NO: 168700 - DNA, 601 bp, Human
tcttagagtcacaggaccttggagtagcaaaatatcataactatggcctttaaacattgcacgcaaaacgcttgtgggcttcatgcattcattccgtggctatttattaagtccttactctgtgccagacagtgttcagagccttaggaaacatgctgagattaaggaagacaaagtgcctgtcctcaagagcttccatttgatgggggagggaagccaacaaatgcataaacaagagcgttttagttggtgatgagtaattaggagaaaatgaagcagagcaaaatatgttgagagggcyaggttgacacaggaggaacaaagaagaaaggggttgtggctgaagtagagtgggtggtgagggagggaagtcgtctcagaggaggtggaatttaagttagtgagaaggaggcacccacgtaatgatgaggggaggagcattctaagcagaaggaacagcaagtgcaaaggccctgaggtgggcatgtatctggcatgtgcaaggaacaacaaggaagccagtgtgcctggaacagagggaggaagggaagagcgtggagggtcagacaggccagatgggtaggatcacatcaggtcttca

SEQ ID NO: 168701 - DNA, 601 bp, Human
ttactctgtgccagacagtgttcagagccttaggaaacatgctgagattaaggaagacaaagtgcctgtcctcaagagcttccatttgatgggggagggaagccaacaaatgcataaacaagagcgttttagttggtgatgagtaattaggagaaaatgaagcagagcaaaatatgttgagagggccaggttgacacaggaggaacaaagaagaaaggggttgtggctgaagtagagtgggtggtgagggagggaagtcgtctcagaggaggtggaatttaagttagtgagaaggaggcasccacgtaatgatgaggggaggagcattctaagcagaaggaacagcaagtgcaaaggccctgaggtgggcatgtatctggcatgtgcaaggaacaacaaggaagccagtgtgcctggaacagagggaggaagggaagagcgtggagggtcagacaggccagatgggtaggatcacatcaggtcttcaggttattgaggggagttcagaatcttagcatcatgagaccttaggctgttcaaataaaagaagagtgaaatgggagcttcagaaggaacttcaaagtgctacagtcctaagcat

SEQ ID NO: 168702 - DNA, 601 bp, Human
tctgtgccagacagtgttcagagccttaggaaacatgctgagattaaggaagacaaagtgcctgtcctcaagagcttccatttgatgggggagggaagccaacaaatgcataaacaagagcgttttagttggtgatgagtaattaggagaaaatgaagcagagcaaaatatgttgagagggccaggttgacacaggaggaacaaagaagaaaggggttgtggctgaagtagagtgggtggtgagggagggaagtcgtctcagaggaggtggaatttaagttagtgagaaggaggcacccaygtaatgatgaggggaggagcattctaagcagaaggaacagcaagtgcaaaggccctgaggtgggcatgtatctggcatgtgcaaggaacaacaaggaagccagtgtgcctggaacagagggaggaagggaagagcgtggagggtcagacaggccagatgggtaggatcacatcaggtcttcaggttattgaggggagttcagaatcttagcatcatgagaccttaggctgttcaaataaaagaagagtgaaatgggagcttcagaaggaacttcaaagtgctacagtcctaagcatcctt

SEQ ID NO: 168703 - DNA, 601 bp, Human
aagtcgtctcagaggaggtggaatttaagttagtgagaaggaggcacccacgtaatgatgaggggaggagcattctaagcagaaggaacagcaagtgcaaaggccctgaggtgggcatgtatctggcatgtgcaaggaacaacaaggaagccagtgtgcctggaacagagggaggaagggaagagcgtggagggtcagacaggccagatgggtaggatcacatcaggtcttcaggttattgaggggagttcagaatcttagcatcatgagaccttaggctgttcaaataaaagaagagtgraatgggagcttcagaaggaacttcaaagtgctacagtcctaagcatccttggcaaatatccccagttacctcttaaaagcaggtgatagtcaccagctcctgactgcccattctgtttctgggaagtcataaaacgttttaaaaaatcattctattattgactagcatccctgcactggctgctaagccccaccccaatctggatcctaatgtaagaacctgtgacccagtcctccccaccccagaatgttctctcctactttgttgagtggaaccttctgcagtttcggcaggcgcctc

SEQ ID NO: 168704 - DNA, 601 bp, Human
agtcaccagctcctgactgcccattctgtttctgggaagtcataaaacgttttaaaaaatcattctattattgactagcatccctgcactggctgctaagccccaccccaatctggatcctaatgtaagaacctgtgacccagtcctccccaccccagaatgttctctcctactttgttgagtggaaccttctgcagtttcggcaggcgcctcagcaacccagctgtattagttaggaaatcgatttggctgcttgaagtcgtccaaatgtcggttgggggtccagggttgggtggatgcwgcatgccatgagctcatgtagggtcccaggctccttctgtcttgttgctctgccacctcttccatatcacctttcctgcatggcctaaggaggtgcacccccacatacctgccagaggatgggggaggggaaggggtgggcacagtcctcaaggtcacttccacccacatgactttccatagaacttggctacacctatatgcaggggaggccaagaaatgtggtcttcaatctgggcagccatgtgcccagctaaaaatcgagggttctgttactagacagctgcctggcatctctgcc

SEQ ID NO: 168705 - DNA, 601 bp, Human
tgactgcccattctgtttctgggaagtcataaaacgttttaaaaaatcattctattattgactagcatccctgcactggctgctaagccccaccccaatctggatcctaatgtaagaacctgtgacccagtcctccccaccccagaatgttctctcctactttgttgagtggaaccttctgcagtttcggcaggcgcctcagcaacccagctgtattagttaggaaatcgatttggctgcttgaagtcgtccaaatgtcggttgggggtccagggttgggtggatgcagcatgccatgagmtcatgtagggtcccaggctccttctgtcttgttgctctgccacctcttccatatcacctttcctgcatggcctaaggaggtgcacccccacatacctgccagaggatgggggaggggaaggggtgggcacagtcctcaaggtcacttccacccacatgactttccatagaacttggctacacctatatgcaggggaggccaagaaatgtggtcttcaatctgggcagccatgtgcccagctaaaaatcgagggttctgttactagacagctgcctggcatctctgccacactggttttct

SEQ ID NO: 168706 - DNA, 601 bp, Human
gggaggggaaggggtgggcacagtcctcaaggtcacttccacccacatgactttccatagaacttggctacacctatatgcaggggaggccaagaaatgtggtcttcaatctgggcagccatgtgcccagctaaaaatcgagggttctgttactagacagctgcctggcatctctgccacactggttttcttgggagaagattccaaatccatcctctgggataaaaagcaacggaggcagaaacgctggtgggagccagctttggggtaaggcaggatgtgactgcagctgcggggtgtsagcctggacctggggttacatggggggagccaaggccagcccttggggactggaggctgggtctgctatgactctggagaagacaggaagttaggggtttttgtggagtccagaggcaggtctgtgttttatcatctctgtccctagagttcagggggctcttgatatcagaggccacagagagagagagaaactcgactttaggaacacagggaccagggcatgtccagggattttgacagcaggaactaatgggatagtcttttcagcagcaactattttcactcctgtgtcctccat

SEQ ID NO: 168707 - DNA, 601 bp, Human
tttttatatcatgaagaaaataaggcaggttaacctaccagggggtgaacagcagatttgggaaatggatagtttctttagctagggtgcaaacagctatgggtgcatttgtgttacaagtgtatcaggaattttcaacaagcacggtgatatttttgtgtatcggtttcactcactgccctgtttccagggcctagaacagtgcctggcactgtcatctttaatcatatctctggctgaatgaatgatgctcaaggaaggctgctctgagctgagactggaattacaagaaaaagtcaayggtttctagagctggaagaaatgttcaagcagaagaaacagtttcaagagctggaagaaatgttctaggtggagggaacagcaagagcaaaggcccggaggtggaaacaagttaggagttttgaagggagagacaggaggcctatgtggccaaggcgtgatgagcaaatgggactggaggggttggtgtgggggagggcagccatggtgagaagatgggatgttaggctgagcatgatgatggtctccttctgagcagatgtattagtccattctcacattgctatgaagaaatactggg

SEQ ID NO: 168708 - DNA, 601 bp, Human
aactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccag

SEQ ID NO: 168709 - DNA, 601 bp, Human
ggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgacygcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaat

SEQ ID NO: 168710 - DNA, 601 bp, Human
tcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttattygtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaa

SEQ ID NO: 168711 - DNA, 601 bp, Human
cagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgkctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaattgtgtgcaacaaacatatcttttatcatagtaaaatttacacacacacacacttttcttccctggagagct

SEQ ID NO: 168712 - DNA, 601 bp, Human
gttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgwgcaacaaacataccctttatctctgtaaaatttatacacacaaaaattaacaaaagattctgtaagaattaattggctatatggaatttaggatagaatatttacaataaagagtatttacaataaagagtttgttattatttgtaaattgtgtgcaacaaacatatcttttatcatagtaaaatttacacacacacacacttttcttccctggagagctgttgttaaacatttaccagcacactactgcttagagctgtgcttgtggccccttcagatctcttctctctccagggaccc

SEQ ID NO: 168713 - DNA, 601 bp, Human
atctcagctcactgcaacctccacctcccgggttcaagcgattctcctgcctcagcttcctgagtagctgggattacaggcgcctgccaccacaccaagctaattttttgtatttttagtagagagggggtttcgccatgttgggcaggcttgtctcgaactcctgacctttcaggtgatccgcctgcctcagcctcccaaagtgccgggattacaggcgtaagccactgtgtctggccaacactttttcttaattcacaatttctattcctgtagaaaatattacagttggacattttasagtatgtttaataccaataatctagtatattagtataaaaccagagtactcatgatttagctctaggacacgatctatctgcaacctaatgagaatacattttatttgctgtacctgcctggttattcatcagttttttctctccattcttccctgtctaactgtaactagcaaaacacattagtaccacatcattccaactgtttagaaagttacgatccaggcaacctcaatgctaaactctacaaagccaagctatacatattgaaaggtgaggggtaggggtggggggcagggaga

SEQ ID NO: 168714 - DNA, 601 bp, Human
ttttcttctcacttaatactgtggcttcacgactcctaacagtcatagacacataataaatcctggtgactaaacagcaatgttctcactgtatacatctcacattgtttacttgcagtagtacaagtggactgtatgtatgttaaccaacttactatgattcgtatttttcaatcttatgatgggttgtgacataaccccacattaagtggaggagagctccttaaaacttaaatggggttacagtttctactgcacgtgtatcactttctcaccatcacaaagttgaaaaatcatacaytgaaccatcatctctgttgccaacattacatacattttcgacttacgatattttcaacttatgatgagtcaaggagcatctgtagtagcttcaaaatgaattcactcagcatcaaagggagactacattccctgagaaatattctcagcaccgctatttcctgcaaactagctgggtcaggctatcctaatactaacgcaaaatcttcacattgctggacagcaacgtcactgcccttacaggaatccaagtggtagggttattatagtttttccacttgtccttaacattgcttccttt

SEQ ID NO: 168715 - DNA, 601 bp, Human
aacagcaatatcaaagctcggcatggtggctcatgcctgtaatcccaaaactttgggaggctgaaggaggatcacttgaggtctagagttcgaggccagcctggccaacatggtgaaaccccgtctctactaaaaatacaaaaatgagaagggcctggtggcaagtgcctgtagtcccagctactcggaggctgaggcacaaaaatcgcttaaacccagaaggcaggggctgcagtgagccaagatcgcaccactgcattccagcctgggcatcagcgcgagactctgtctctagggaagaaaaaaaaaaaagaacagcaatatctataaaatagaaaaaatatggtataaacaggaatgacatgatttcattttttactacttatacatatctcagtgtctgctttgcatacttatgcgttttaactacactttacatttttcttgtatttatttatttatttttggcatagaaacagggtcttgctatgttaaccaggctggtctcagactcctggcctaaactaatcctccgagcttagcttcccaaagtgctgggatcacagacatgagccaccacacccagccattaactatacat

SEQ ID NO: 168716 - DNA, 601 bp, Human
cctaacagttacaagttaaagttcaagataggagggagtgtctacaattaaaagcgtatttcaacatacccactttttgaaatcagctagtctctaagaagtaaaaataacacaagctggctcagaagtctaagtagctcttttataaattatatacaaagggctgaaaacacgaatgattaaaatctattgaatgtattaaatttataccactaacttatgaaatacaatttaaaaatcaaaaaattgaaatgtgtacgtaagatttctatgctgatttgaaattcttttatacaatctwtttttattctttttttctgaacctgtgggttatattgaatcttttatacaatttctaataagacacaagtacagacagtaatagagtatgactttcaacctgcctacatcactttcacactcacacagccaccacctcacttttgatatacatctgtcccactccctgcatttcatcttaaacccattgtcattaactcacccttttcccataagatatcccaaaacatccgccactgcccctagctgagaaccactatgccaaagcttgctctacattaaagaaaaagggctcctccct

SEQ ID NO: 168717 - DNA, 601 bp, Human
aatctctccttgttatagatcttcctgattccctagttccaagctgcctaatcgtttactccgattccttatcacctactctatcctgatccttactacttgctagactctcccagtccaggttctttcatcactattagatatattacctacgcaggacaaaacgaacaacaagtaaggactcaaagaatgccaatcttaattcctaattttatccctcctgataaagaataaaataaaattgtcccttggtatccctggggggttggttcaaggacttcccacagatatccaaatccaytgatgctcaaatccctgacaaaatgacgcggtatttgcatacaacctatgcacatacccatgtatattttaaataatctctagactacttataatacacaatacaatgtaaatcctatataaatagttgttgtactgtgttgtgtagggaataataacaagaaaaaagtctgtacatgttaagtacagactcaatttcattttttgaattttttcattcgtggttggtttaatccatgaatacaaaattcacagacacagagggtcaactggtatttactaatctgccttttaaaaattt

SEQ ID NO: 168718 - DNA, 601 bp, Human
ttgagcattcatggaaccaatccccatagatactgagggagaaactgcataacctctataggggattcatgagcccctaaattttgcaggcaaaattccaaaaatattctttattttctttcttggccttttattggttctgctttgcatatttaaatcttttattcatctatttataattttatctgttttttaacttactacactaactaggagtaccaaaccatgctgaataacaagtgtaggcatgttcactttgtccctgactttaatagaatatctttagtttttcattacattatatatatatatataaaaataatattacactaaggctgttgcttctcattcttgttttagaaatccaatatattcaaattcacattaaaatctggctaacaaacatttttaaatgattttttaagtttcacatttcacatatttaaaggggaaaaattaaaaatcccaaactatatatcctattttatttttaaaagtatcctaatttcttaaatgtaccctgaaatcttaccatgtacagaacaatatcctgattacatcaatttcttgtttaactaaattaaacaataatgcttataaa

SEQ ID NO: 168719 - DNA, 601 bp, Human
ggcctaacctcattaggcattagagttcacactggacagaggccttaagagtgcatggcagatgttgtctcattgttcaaaatagcatgatcataaaagagaagagctgacagtgacctctgaatgtgagctgtcagccagaagttgaactgctccatctatccacaatgtagagattacctacaactaggtgagtgaacaaaacctggtggttcttcatcccctccctcagagtggtttcagtgtggaaatgacccagctcctgcccaaaagacctgggttggggtctgctgtggatttycagaggtcccccttttttgtggacaatggtagctgagatggatttgtctagccagtttccgaatcagccaatcctggaactgcctgcctcattctaccctgatttgtgcagataaaggccttattgtttaaccctttaaaacaaaaataaagtacagggaaggatgtgcacaggttatatgcaaatagtatacctttttatataagggacttgagcattcatggaaccaatccccatagatactgagggagaaactgcataacctctataggggattcatgagcccctaaattttgcagg

SEQ ID NO: 168720 - DNA, 601 bp, Human
taactggtatggagtggaggatgaacatgcaccttccaagcagggtgtttctttaagagtgtcacaggtgagaattcctaaggcaggtcagaaagcccaccccatgacatgtgcggcctggtcttgaaagacgtttttccatctagctggacaaggggaacattctctgaatagcaaccacacacatgtgagtcatggggtggagacttctggttcactgtaacctagaccagattcagaggcagcagacagaaatcttctagaaggaaaagagcctggtgtttgtgaagatctgcagatmctacatgtcaaagaaggttttcactagcaggaagggtggaaaatacttcttgaatagctttgaagttttcaagcaccaggcccctcccaatggggaagaagccacaccaaagtactgagagtagggaggcctttcacactggacaaaggggctgcaagtgcagtgatgtgggaaagccttcaactgcaaagataaacttgttcagcaacagaaaatccatgacggagtaaagccttaggagtgtggtgaatgtggagaaaacctttagtcacaactcctactttacagtacaaagaagaa

SEQ ID NO: 168721 - DNA, 601 bp, Human
gtctcaacaacaacaaaaaaaatacaaaaaactagccaggtgtggtggcacacacttgttgtcccagctgctcaagaggctgaggtgggagaatcacctgagcccacgaagtcgaggctggggttagccgtattcacaccactgcactccagcctgagtgagagagtgagaccctgtctcaaaaaaataaaaaaattaaaattcaagtatgagagggcattttgcagtgaggctcagaaggcaacaagcaccctgaggtgaccccacccaaggtaactggtatggagtggaggatgaacaygcaccttccaagcagggtgtttctttaagagtgtcacaggtgagaattcctaaggcaggtcagaaagcccaccccatgacatgtgcggcctggtcttgaaagacgtttttccatctagctggacaaggggaacattctctgaatagcaaccacacacatgtgagtcatggggtggagacttctggttcactgtaacctagaccagattcagaggcagcagacagaaatcttctagaaggaaaagagcctggtgtttgtgaagatctgcagatcctacatgtcaaagaaggttttcactag

SEQ ID NO: 168722 - DNA, 601 bp, Human
cacaaagttccaaaagacaaaacctgaatttgctgtacactgagtactatgctgaatccacacaaatgaagtgctggcattatattaagtattataagaaatctggagatggtttaaagtatatgggaggggccaggtgcagtggctcacacctgtaatcctaacactttggggggccgaggcgggcagatcgcttaaacccaggaattagagaccagcctgggcaacatagcaaagccccgtctcaacaacaacaaaaaaaatacaaaaaactagccaggtgtggtggcacacacttgtwgtcccagctgctcaagaggctgaggtgggagaatcacctgagcccacgaagtcgaggctggggttagccgtattcacaccactgcactccagcctgagtgagagagtgagaccctgtctcaaaaaaataaaaaaattaaaattcaagtatgagagggcattttgcagtgaggctcagaaggcaacaagcaccctgaggtgaccccacccaaggtaactggtatggagtggaggatgaacatgcaccttccaagcagggtgtttctttaagagtgtcacaggtgagaattcctaaggcagg

SEQ ID NO: 168723 - DNA, 601 bp, Human
ctcactgatagagtcagtcctctgtattcatgggttctgcattagtggaattcaaccaactgtggattcaaaatactgaaggggaaaaaaaatccacaaagttccaaaagacaaaacctgaatttgctgtacactgagtactatgctgaatccacacaaatgaagtgctggcattatattaagtattataagaaatctggagatggtttaaagtatatgggaggggccaggtgcagtggctcacacctgtaatcctaacactttggggggccgaggcgggcagatcgcttaaacccaggarttagagaccagcctgggcaacatagcaaagccccgtctcaacaacaacaaaaaaaatacaaaaaactagccaggtgtggtggcacacacttgttgtcccagctgctcaagaggctgaggtgggagaatcacctgagcccacgaagtcgaggctggggttagccgtattcacaccactgcactccagcctgagtgagagagtgagaccctgtctcaaaaaaataaaaaaattaaaattcaagtatgagagggcattttgcagtgaggctcagaaggcaacaagcaccctgaggtgacccca

SEQ ID NO: 168724 - DNA, 601 bp, Human
tgcttccagtgaagactggcgggtggagtggtgggctgactggggaagatccacctgcactgtgggcaggcaccatccaattggctaaaggccaggaaaaaaacaaaaaggtggaggaaaagaaaattctccctctctttcccctcgggacatcaggactccagcctctgcggccttcagcctcagacagagttaaaatatcagcttccctggttcccagacattaagactaaaatgagccatactaccagcatcctagggtctccagcttgcagactgcctatcatgggacttttcagtmtgtataatcgtgtaagccaattcccctaataaatcctctctcatgtatctatctgtacatatgtatatcctattggttctgtctctctggaaaaccctcactgatagagtcagtcctctgtattcatgggttctgcattagtggaattcaaccaactgtggattcaaaatactgaaggggaaaaaaaatccacaaagttccaaaagacaaaacctgaatttgctgtacactgagtactatgctgaatccacacaaatgaagtgctggcattatattaagtattataagaaatctggagat

SEQ ID NO: 168725 - DNA, 601 bp, Human
tcaggagtttgagacagcctggccaacatggcgaaacaccgtctctagtaaaaatacaaaattagccaggagtggtggcacacccctgtaatcccagctacttggaaggctgaggcagaagaaccgcttgaacccaggaggcggaggctgcggcgagccaagaccgtgccactgtactccagcgtaagcaacagaacgaggctctgtaaaaaaaaacaaaaacaaaaacaaaaacaaaacaaacaaacaaacaaaaaaaaaaactcattgaagcactttagattttcacattaggaaatcrtaagcataatgcaaatattcccaaaatcggaaaatttaaagatccaaaacacttttggttccaagtatttcaaataaggatactcaacctgtatatccttatttctacacacttgctttaatgtaagcatttaacaatacattaatagggataggtacaccatgggtgctaccatttaagcaaaaaatacctcaactgatgtctcaggcaatatactgagtagaaaaagtttccaaataacgtagaagaagggttggcaaactgttacccaaaggccagttccagctggccacctgtttt

SEQ ID NO: 168726 - DNA, 601 bp, Human
atcccagcactttgggaggccaaggcaggcggatcacttgaggtcaggagtttgagacagcctggccaacatggcgaaacaccgtctctagtaaaaatacaaaattagccaggagtggtggcacacccctgtaatcccagctacttggaaggctgaggcagaagaaccgcttgaacccaggaggcggaggctgcggcgagccaagaccgtgccactgtactccagcgtaagcaacagaacgaggctctgtaaaaaaaaacaaaaacaaaaacaaaaacaaaacaaacaaacaaacaaaaacaaaaactcattgaagcactttagattttcacattaggaaatcgtaagcataatgcaaatattcccaaaatcggaaaatttaaagatccaaaacacttttggttccaagtatttcaaataaggatactcaacctgtatatccttatttctacacacttgctttaatgtaagcatttaacaatacattaatagggataggtacaccatgggtgctaccatttaagcaaaaaatacctcaactgatgtctcaggcaatatactgagtagaaaaagtttccaaataacgtagaagaagggttgg

SEQ ID NO: 168727 - DNA, 601 bp, Human
cttgtaatcccagcactttgggaggccaaggcaggcggatcacttgaggtcaggagtttgagacagcctggccaacatggcgaaacaccgtctctagtaaaaatacaaaattagccaggagtggtggcacacccctgtaatcccagctacttggaaggctgaggcagaagaaccgcttgaacccaggaggcggaggctgcggcgagccaagaccgtgccactgtactccagcgtaagcaacagaacgaggctctgtaaaaaaaaacaaaaacaaaaacaaaaacaaaacaaacaaacaaamaaaaaaaaaaactcattgaagcactttagattttcacattaggaaatcgtaagcataatgcaaatattcccaaaatcggaaaatttaaagatccaaaacacttttggttccaagtatttcaaataaggatactcaacctgtatatccttatttctacacacttgctttaatgtaagcatttaacaatacattaatagggataggtacaccatgggtgctaccatttaagcaaaaaatacctcaactgatgtctcaggcaatatactgagtagaaaaagtttccaaataacgtagaagaag

SEQ ID NO: 168728 - DNA, 601 bp, Human
cacgcttgtaatcccagcactttgggaggccaaggcaggcggatcacttgaggtcaggagtttgagacagcctggccaacatggcgaaacaccgtctctagtaaaaatacaaaattagccaggagtggtggcacacccctgtaatcccagctacttggaaggctgaggcagaagaaccgcttgaacccaggaggcggaggctgcggcgagccaagaccgtgccactgtactccagcgtaagcaacagaacgaggctctgtaaaaaaaaacaaaaacaaaaacaaaaacaaaacaaacaaamaaacaaaaaaaaaaactcattgaagcactttagattttcacattaggaaatcgtaagcataatgcaaatattcccaaaatcggaaaatttaaagatccaaaacacttttggttccaagtatttcaaataaggatactcaacctgtatatccttatttctacacacttgctttaatgtaagcatttaacaatacattaatagggataggtacaccatgggtgctaccatttaagcaaaaaatacctcaactgatgtctcaggcaatatactgagtagaaaaagtttccaaataacgtagaa

SEQ ID NO: 168729 - DNA, 601 bp, Human
aaaagctcagccaggcgcaggggctcacgcttgtaatcccagcactttgggaggccaaggcaggcggatcacttgaggtcaggagtttgagacagcctggccaacatggcgaaacaccgtctctagtaaaaatacaaaattagccaggagtggtggcacacccctgtaatcccagctacttggaaggctgaggcagaagaaccgcttgaacccaggaggcggaggctgcggcgagccaagaccgtgccactgtactccagcgtaagcaacagaacgaggctctgtaaaaaaaaacaaaaamaaaaacaaaaacaaaacaaacaaacaaacaaaaaaaaaaactcattgaagcactttagattttcacattaggaaatcgtaagcataatgcaaatattcccaaaatcggaaaatttaaagatccaaaacacttttggttccaagtatttcaaataaggatactcaacctgtatatccttatttctacacacttgctttaatgtaagcatttaacaatacattaatagggataggtacaccatgggtgctaccatttaagcaaaaaatacctcaactgatgtctcaggcaatatactgagta

SEQ ID NO: 168730 - DNA, 601 bp, Human
gaaaagaaaagctcagccaggcgcaggggctcacgcttgtaatcccagcactttgggaggccaaggcaggcggatcacttgaggtcaggagtttgagacagcctggccaacatggcgaaacaccgtctctagtaaaaatacaaaattagccaggagtggtggcacacccctgtaatcccagctacttggaaggctgaggcagaagaaccgcttgaacccaggaggcggaggctgcggcgagccaagaccgtgccactgtactccagcgtaagcaacagaacgaggctctgtaaaaaaaaamaaaaacaaaaacaaaaacaaaacaaacaaacaaacaaaaaaaaaaactcattgaagcactttagattttcacattaggaaatcgtaagcataatgcaaatattcccaaaatcggaaaatttaaagatccaaaacacttttggttccaagtatttcaaataaggatactcaacctgtatatccttatttctacacacttgctttaatgtaagcatttaacaatacattaatagggataggtacaccatgggtgctaccatttaagcaaaaaatacctcaactgatgtctcaggcaatatac

SEQ ID NO: 168731 - DNA, 601 bp, Human
agccatgtgcagtggctcacacatgtaatcccagcactttgggaggctaaggcagaagaactgcttgagcccaggagtttgaaaccagcctgggcaacatagcgagaccctgtctctattttttaaaaaaaagaaagaaaagaaaatatggaggcctactactcactatgtgttcaactaacaagttctttcaactactatcactgagactggaaattgtgtttatggatgtttaagtctttatccaattaaatctttttccgtatctagcattttacaattttctgaacacagaatcttsttaattcaaactgtttttcagcgactaacagcataggtatctccggggaaagtgttagcaatgcagaatcctaggctcccagcagatctactgaccccacaaatgactcaggctctaccccagactaccccagagtgatctgtatgcacattcaagtttgagaagcactgtaacctttcttcattcagaaattccgtgacttctaccagcagctatacaggttgagtatccaaaaatctgaaatccaaaatgttccaaaatctaaaattttttgagctccaacatgatgctgaaaagaaa

SEQ ID NO: 168732 - DNA, 601 bp, Human
ccagccttgttattttttaaaaaaggaaaatgtaaatatatgctaacagacacaaaaataaagatgagttaaagtaaaaaggacgggaaaatatataacatccaaaccctaatccaaagaaagctggagtggctacagtaatagctgaaaaaacaaacttcaaaacaaaacaaaaaaaattatgagggataaagagggacatttcctaattcaagaagaaaacacaacaagcctaagtatttatgtacataaaaaaagcttcaaagtatgtgaagaaaaagttgatagaacagaaaaaagyagactctgtaactagagttggaaatcataccactcctttctgaacaagcagacaaaaaaatcagtaagattattaaaaacttaaacacaaagaacttgactagatagatagaatatatttctttttaagggcacatggaacagtcacaaagatagaccttaatcctaggccacaaagcacgtttccacaaattttaaaagactaaaatctaagagtatgttttctgactacaggagaattaagccaataacagatatgcagaaaatccccaaatattaggaatttacatttctaagtagt

SEQ ID NO: 168733 - DNA, 601 bp, Human
atcatcataaagccaatagcagagataaaattgaatcatttttaaaagtttatattgagaggccaaggcgggtggatcacttgaagcgaggagttcgagaccagcctggccaacatggtgaaaccccatctctactaaaaatacaaaaattaatggggcatggtggcaggtgcatgtaatcccagctactcaggaggctaaggcatgagaatcgcttaaacgcaggaggcagaggttgcagtgagccgagatcgcgccactacactccagcctgggcgacagagcgagacctcagtctccmaaaaaaaaaaaaaaaaaaaaaaaaagtatattactcccgaaaaatgcaagaaaagagggggacaagaactatgaacagatggaaaacaaatagaaagatgacagtttaaaactcagccatatgaataattacattaaaagtaaatgatccagctgagtacattagtgtgcacctgtggtcccagctactcaggagagtgaggtgggaggactgcttgagcccaagtttggggctgcaatgcactatgatcacatttgtgaacggccactgcattccaacctggacaacagagagagatct

SEQ ID NO: 168734 - DNA, 601 bp, Human
attaagaaattcatattggccagacgtgatggctcacacctgtaatcccagcactatgggaggccgaggcaggtggatcacccaaggtcaggagttcaagaccagcctggccaacatggtgaaaccctgtctccactcgggaggctgaggcaggagaattgcttgaacccgggaggcagaagttacagtgagccgaaatcgtgccattgcactccagcctaggcaacagagcaagactccgtctcaaaaaaaaaaaaagaaagaaattcatattaattttccttagtacaacaacattgtkattataaggagaaggttctaaattttgggaggttcattttaaatatttaagggtaaaatgacacgatgtccataactcacactagacagattctagggtgggaggcagggtaaaaaagaaaaaaatatgcaaattattaaatcactagctacttcaggagtaatagagactgaatttagcctaccaccataaacaattagaaaactagataaaagatgtgacaagagaaacaaatgaagtgagatctactacaactggcccagcttactgcctgtaagcagtctccaggccaaatgacag

SEQ ID NO: 168735 - DNA, 601 bp, Human
gagaaaaaaaccatgaaagaaacaataaaaggaaaatagaaaaagaatccaattgagaagaaaacaaacgacatttggaaacaatcctagacaaagcagaatcagtcttagattatattaagaaattcatattggccagacgtgatggctcacacctgtaatcccagcactatgggaggccgaggcaggtggatcacccaaggtcaggagttcaagaccagcctggccaacatggtgaaaccctgtctccactcgggaggctgaggcaggagaattgcttgaacccgggaggcagaagttrcagtgagccgaaatcgtgccattgcactccagcctaggcaacagagcaagactccgtctcaaaaaaaaaaaaagaaagaaattcatattaattttccttagtacaacaacattgtgattataaggagaaggttctaaattttgggaggttcattttaaatatttaagggtaaaatgacacgatgtccataactcacactagacagattctagggtgggaggcagggtaaaaaagaaaaaaatatgcaaattattaaatcactagctacttcaggagtaatagagactgaatttagcctac

SEQ ID NO: 168736 - DNA, 601 bp, Human
ggagacggaggttgcagtgagccaaggtcacgccactgctctccagcctgggcaacaacagtgagcctccacctcaaaaaataaaaaataaaaaataaactcacccactttatatcatagcaaaaagaatatctgggtagagaagagacacacaaccatgaacataacattgtaaaaacacactggagaaaaaaaccatgaaagaaacaataaaaggaaaatagaaaaagaatccaattgagaagaaaacaaacgacatttggaaacaatcctagacaaagcagaatcagtcttagattayattaagaaattcatattggccagacgtgatggctcacacctgtaatcccagcactatgggaggccgaggcaggtggatcacccaaggtcaggagttcaagaccagcctggccaacatggtgaaaccctgtctccactcgggaggctgaggcaggagaattgcttgaacccgggaggcagaagttacagtgagccgaaatcgtgccattgcactccagcctaggcaacagagcaagactccgtctcaaaaaaaaaaaaagaaagaaattcatattaattttccttagtacaacaacattgt

SEQ ID NO: 168737 - DNA, 601 bp, Human
atcacctgaggtcaggagtttgagaccagcctggccaacagagtggtgaaaccatagtgaaacccatagtctctactaaaaatacaaaaaaaaattagcctgccgtggtgactgacgcctgtaatcccagctacttgggagactaaggcaggagaatctcttgaacccgggagacggaggttgcagtgagccaaggtcacgccactgctctccagcctgggcaacaacagtgagcctccacctcaaaaaataaaaaataaaaaataaactcacccactttatatcatagcaaaaagaatawctgggtagagaagagacacacaaccatgaacataacattgtaaaaacacactggagaaaaaaaccatgaaagaaacaataaaaggaaaatagaaaaagaatccaattgagaagaaaacaaacgacatttggaaacaatcctagacaaagcagaatcagtcttagattatattaagaaattcatattggccagacgtgatggctcacacctgtaatcccagcactatgggaggccgaggcaggtggatcacccaaggtcaggagttcaagaccagcctggccaacatggtgaaaccctgtc

SEQ ID NO: 168738 - DNA, 601 bp, Human
aaaaagaaatcacaagccgggtgtggtggctcatgcctgtaatcccaacaatttgggaagctgaggtgggtagatcacctgaggtcaggagtttgagaccagcctggccaacagagtggtgaaaccatagtgaaacccatagtctctactaaaaatacaaaaaaaaattagcctgccgtggtgactgacgcctgtaatcccagctacttgggagactaaggcaggagaatctcttgaacccgggagacggaggttgcagtgagccaaggtcacgccactgctctccagcctgggcaacaasagtgagcctccacctcaaaaaataaaaaataaaaaataaactcacccactttatatcatagcaaaaagaatatctgggtagagaagagacacacaaccatgaacataacattgtaaaaacacactggagaaaaaaaccatgaaagaaacaataaaaggaaaatagaaaaagaatccaattgagaagaaaacaaacgacatttggaaacaatcctagacaaagcagaatcagtcttagattatattaagaaattcatattggccagacgtgatggctcacacctgtaatcccagcactatg

SEQ ID NO: 168739 - DNA, 601 bp, Human
cccaaagtgctgggattacaggtgtgagccaccatacccagccaaatcagaggattttttttttcttttttcaagacagtgtgctaaatacaacactggtcataacctaataatataatctttcaaacaggcagccaaggaatgaaataatattttaatgaaaatgtaggaaagcatggcacactggacttctgatgttgcccctagccctcagatgccacacaattcacttatttaaaaatctcaagagaatgggagtcctggaattctcaaaaaaattatatatgatcacagccccgtkactgcagaaacgtgaataaaacacaaaataatcagcccctcaaactaagattggaaggcggaaaaaaaatacactggtctcagaggcagaaagaaaagaaaaaagaaatcacaagccgggtgtggtggctcatgcctgtaatcccaacaatttgggaagctgaggtgggtagatcacctgaggtcaggagtttgagaccagcctggccaacagagtggtgaaaccatagtgaaacccatagtctctactaaaaatacaaaaaaaaattagcctgccgtggtgactgacgcctgtaatccc

SEQ ID NO: 168740 - DNA, 601 bp, Human
tttctgtctctgctgcttaaatcaggaaaaagtcaagtttttaagtcgcagttcagataaagtattctgtcacttttgataacttaaaacaataactattgctgttctgaagcactcatgacaaaagctcaacgatttacacagctgaaattctactgggagagttattaaacaaagtcatcttttctctgtcccacacacaaattttataaaagcaacatactattcactttcactggcaaaagacctgagtaatgattttctgaatctttgtaattgagatagaacatgattcataggktttaattgggaaagctaaaaacacttccccgggacacacagttaccaagtccatctcattatcatcttctatataagacctatgaatgtttatcttaattatgcctaaatatcagtatttgtgtaatctcagtactgtgggaaaaaaacttatattaagataatgtatgaaattgaattacataatttctattccctaatacttaatgaagagggaaataagggggccatgggtagaggataaagcagcctacctgcccctctgcccccaccccacacacacatagaacaaacttcaaga

SEQ ID NO: 168741 - DNA, 601 bp, Human
atttctttcattttgaaaatttccactggattactgaattggatttaagtggtctgagttgccatagcacaagcttggctttgcagaactgtggattccactcctttttcggcaccaaaggcgtcaagctggtttttatttctgtctctgctgcttaaatcaggaaaaagtcaagtttttaagtcgcagttcagataaagtattctgtcacttttgataacttaaaacaataactattgctgttctgaagcactcatgacaaaagctcaacgatttacacagctgaaattctactgggagwgttattaaacaaagtcatcttttctctgtcccacacacaaattttataaaagcaacatactattcactttcactggcaaaagacctgagtaatgattttctgaatctttgtaattgagatagaacatgattcatagggtttaattgggaaagctaaaaacacttccccgggacacacagttaccaagtccatctcattatcatcttctatataagacctatgaatgtttatcttaattatgcctaaatatcagtatttgtgtaatctcagtactgtgggaaaaaaacttatattaagata

SEQ ID NO: 168742 - DNA, 601 bp, Human
atgcttacgagcacaaagagcggcataaaaggacaattcaacttaaactactattgagttacttccttctcctcttgaacacactcctcccaagagaggtgagaagaatgagtccaaaactatcttcacaagtagcaaagaaatttcagtgaagccaatgtctaagagataataaaacccactagcatgaaacttttattttattttattttattttattttattttattttttttttttttgagacagagtctcgctctgtcacccagactgcagttcaatggcacaatctcggctcacygcaagctccacttcctgagttcacgccattctcccgcctcagcctcccgagtaactggagactacaggcacctgccaccacgcccggctaattttttgtatttttagtagagacggggtttcaccatgttagtcaggatagtctcgatctcctgacctcgtgatccgcccacctcagcctcccaaagtgctgggattacaggcatgagccaccacgcccggcctagcatggaacttttaaaaatcaagactaaataatggaatcaaatataccaatgcatcttctgtatcctttaaacat

SEQ ID NO: 168743 - DNA, 601 bp, Human
ttttaaatctcaggaggtggttttttaatctgtaaaatggagacaacaatgcctaccttaaatgcatgcaaaatgcttacgagcacaaagagcggcataaaaggacaattcaacttaaactactattgagttacttccttctcctcttgaacacactcctcccaagagaggtgagaagaatgagtccaaaactatcttcacaagtagcaaagaaatttcagtgaagccaatgtctaagagataataaaacccactagcatgaaacttttattttattttattttattttattttattttattttttttttttttgagacagagtctcgctctgtcacccagactgcagttcaatggcacaatctcggctcaccgcaagctccacttcctgagttcacgccattctcccgcctcagcctcccgagtaactggagactacaggcacctgccaccacgcccggctaattttttgtatttttagtagagacggggtttcaccatgttagtcaggatagtctcgatctcctgacctcgtgatccgcccacctcagcctcccaaagtgctgggattacaggcatgagccaccacgcccggcctagca

SEQ ID NO: 168744 - DNA, 601 bp, Human
tttttaaatctcaggaggtggttttttaatctgtaaaatggagacaacaatgcctaccttaaatgcatgcaaaatgcttacgagcacaaagagcggcataaaaggacaattcaacttaaactactattgagttacttccttctcctcttgaacacactcctcccaagagaggtgagaagaatgagtccaaaactatcttcacaagtagcaaagaaatttcagtgaagccaatgtctaagagataataaaacccactagcatgaaacttttattttattttattttattttattttattttwttttttttttttttgagacagagtctcgctctgtcacccagactgcagttcaatggcacaatctcggctcaccgcaagctccacttcctgagttcacgccattctcccgcctcagcctcccgagtaactggagactacaggcacctgccaccacgcccggctaattttttgtatttttagtagagacggggtttcaccatgttagtcaggatagtctcgatctcctgacctcgtgatccgcccacctcagcctcccaaagtgctgggattacaggcatgagccaccacgcccggcctagc

SEQ ID NO: 168745 - DNA, 601 bp, Human
cccactactgaggcaagacctatctcagtagtctacccaatgctccatgaactgagtttttccagtctacctggtaagaaaaggcactacttatagccctatctgagcaccaggtaccgttcaatctaatcttttgggatgattctttagcctcaggtagtttccacatatgggctgattagagctctgctgaacactacagtggaagcctctgcagatctcagggatcctctgtgcagctctctcttcaccctgatattctgtctgtgaactccagccactttggtctcccctgaccctyagcttcatctcttcaactgaggaagttccctggactctacctaggttccctctcatagtaccacaacccataaatctctcaaggcagaaagctggcacaatcgaagggccaaccttactgtttcccctctcagggtccttcactacctgatgaccaatgccttaaaaaccattgtttcgctgggcgtggtggctcacgcctgtaatccgagcactttgggaggccgaggcaggtggatcgcctaaggtcaggagttcgagaccagcctgaccaacatggtgaaaccctatctctactaaa

SEQ ID NO: 168746 - DNA, 601 bp, Human
gtcttcatgtgagactgctcttttggcacgctggtgtttttggtgtaatgaatccacattgtaagataatccttcataatgtctgatatatttatttaaaggattcccatactgacctataaaaaaaaaacaacattctgaattagtatcatcttgaagaccccttctagttctaacacgattattcaagtatctatgaatatgtatgaaacaacttctccctaatcccagcactattatgaattctgcattaatattaacacatatattattaaaacttattgtgagggtaattccaacsgcacacacaagtttggatgttagccataggtttgttttagatgtcctttatcaagctgagcaagttctcttctattcacattttgctgataaaaactatcaggaccaggtgcaggggctcactcctgtaatcccagcattttaggaggctgagatggaaggactgcttgaggccaggaattccagaccagcctggtcaacatagcaagacttcatccctaataaaaataaaaaataaaataaaaataaataaaaagtataaaaataaataaaaagttaaaaaactatcgggaacaaatgc

SEQ ID NO: 168747 - DNA, 601 bp, Human
aactaaaatgaccatcatcgacatcaaaaagatgagtaagattcacactctgcacttcaagttcacaaggagtagaggacatatgcatgtaaataaagttataataaaataaatgccataactgacatatatacagcattgctaagtgagcaatccaattcatcagaacttattcagtgatttctgaaactcagaaaactgattcttaatttctcagccaagctaagagatgtattttaccctaatatctattatcaaaacagtttaatcttctagtaagtattactggagttgtttcctyaacgactatggcactgactcaaatggtacttttattttcaaacaactttaagctttatttcaagagcaacagcttttcatagaattcttttcttttttttttttttctgagatgaagtcttgctctgtcgccaggctggactgcagtggcgtgatctcggctcactgcaacctctgtgtccctggttcaagcgattgtcatgcctcagcctcttgagtagctgggactacaggcgcatgcccagctaattgtttgtatttttagtagagacggggttacaccatgttggccatgatggcc

SEQ ID NO: 168748 - DNA, 601 bp, Human
cagactggtctcaaactgctgggctcaagtgatcctttcacctcagcctcccaaagtgctgggattacagacatgagccaccatgtccagcaattcactcactcaatataactaaaatgaccatcatcgacatcaaaaagatgagtaagattcacactctgcacttcaagttcacaaggagtagaggacatatgcatgtaaataaagttataataaaataaatgccataactgacatatatacagcattgctaagtgagcaatccaattcatcagaacttattcagtgatttctgaaactyagaaaactgattcttaatttctcagccaagctaagagatgtattttaccctaatatctattatcaaaacagtttaatcttctagtaagtattactggagttgtttccttaacgactatggcactgactcaaatggtacttttattttcaaacaactttaagctttatttcaagagcaacagcttttcatagaattcttttcttttttttttttttctgagatgaagtcttgctctgtcgccaggctggactgcagtggcgtgatctcggctcactgcaacctctgtgtccctggttcaag

SEQ ID NO: 168749 - DNA, 601 bp, Human
ttgtgttccctagattcttacctctgcttctcaaagtctgctggtttgtctacagatttaaaagtgccctagatttctgctacctgactcatgatataacagagattaagtcacagacatctccagactaacccaactccaggcaagaaccagtgaagggaatatttatgccttttacaggttacctgggccatattcttgaaaccttcatatttcaggagtagggagaactcaaatcccaaaccacaaagaaaacttccaaccaaatgtctaatcatttgttttaaacagtttggaaatktactcttaaggctacaggaagaattaccttgtcaattcagaaaaaaataaagttgtatattctccaaacaattatattgcacttaaggaaagtttttggtttcttctatattatatacaaatcacatattacataaaaatcatttctgatgtatggactgaggtacccaaataaatacacaggcagaaaaatatggtttattactgactagtgttttaatgttttaaacttagtatactaatatattttgtagaattttaaagcataaaggagcttaaatattatcttgtctaaacttca

SEQ ID NO: 168750 - DNA, 601 bp, Human
acacaccaaacaagcatattcaaaccaataaactaaacatattcaacacagttactataaaagattttcaggtataatgaaataggataaacattaaaagaacctttagtcacataaaatccttgctgcacctttaagaaaacgccacaacaaccttataaggagcttaaccacttgaacaacagaaaaatccaaggttgactatgaatctagataaaatctgagctagggtacttatctcacaaaagatccaactgaacatgaaacattttagcatgaaatataacataattaagaaaamcaatatataggcttttctactaggcatatacgtaatttctgacattcactgtctaggtcaccaactctagaaactctggcattaaaaactacaccactggccaggcacggtgactcacgcctgtaatcccagaactttgggaggccaaggtgggcagatcatctgaggtcaggagttcgagaccagcctggccaacatagtgaaacccccatctctactaaaaatacaaaaattagccaggtgtcgtggtgcacacctgtaatgccagctactaggtaggctgaggcaggagaattgcgt

SEQ ID NO: 168751 - DNA, 601 bp, Human
tcgagaccggcccgggcaacacagcaagaagccctatctacaaaaaaaattaaaaattagccgagcataatggcacacatctatggtcccagctactcaggaggctgaagtgggaggactgcttgagctcagaagtttgaggccagcctgagcaacaaagcaagaccctgtcattcattccatcctaaataaataataaaataccaacctggcaattgatactggcatataacacaactatctgtcccacaccatgataactaagattcttgatttgctagaccttgtgtttatatttgayttgttggttcaatatagactattttggaaacttactagtgcaaagtgattataatttcagatttcagagatgcacacaaattaacaactttattcctgcatacaagtatcaaaaatgtatgtcaacctgcagaggtacagaatgactttaagaaattaaacaggttataatacaattaactgaagaataagtattcagaagctatatctaaaaggaactgtatatatgatgaccaaagaatttttaatcagtttaaagctattacactataatacaaggtttccctgatgcttaataaaa

SEQ ID NO: 168752 - DNA, 601 bp, Human
ccaggcgtggtggtgagcacctatgatcccagctactcaggaggctgaggcacaaggatcactggaacccaggaggtggaggttgcaatgagtgaagatcgcgccactgtactccagcctgggcaacagagcgagactcggtctcaaaaaaaaacaaaaacaaaaacaaaacaataaaacaatgacaggatttaagaatagagggagacttccactgttcaggtatctaatgtaaaccaactgtataaaataacaatcacctaaatttactaatttaacaaactgatgaagtggacttgascaagagcacacaaaatcagagtttaaatctgaaacagtctttccgtcacatcaaactataattccttgcttaggatatataagggagcccccaggatggcaaaatgctgaacatcttcctggtgacagataaaaaaaaaataattgaggccacacccggtggctcacaccagtaatcccagcattctgggaggctgaggtaggaggatagcttgagcccaagagttcgagaccggcccgggcaacacagcaagaagccctatctacaaaaaaaattaaaaattagccgagcataatggca

SEQ ID NO: 168753 - DNA, 601 bp, Human
ttacacctattatacatgattacagaataagttgatttatctactgaaaagaaaaaagttttctataaacactttccaacctcgcacaactatgtaattaaataattggcaagtaaactactatgtataaaacattaagggcctggtgcagtggctcacacctgtaatcctagcactttgggagcccgaggcaggtggatcacttgaggtcaggaattcaagaccagcctggccaatatggtgaaatgccatctctactaaaaatatggaaattagccaggcgtggtggtgagcacctatratcccagctactcaggaggctgaggcacaaggatcactggaacccaggaggtggaggttgcaatgagtgaagatcgcgccactgtactccagcctgggcaacagagcgagactcggtctcaaaaaaaaacaaaaacaaaaacaaaacaataaaacaatgacaggatttaagaatagagggagacttccactgttcaggtatctaatgtaaaccaactgtataaaataacaatcacctaaatttactaatttaacaaactgatgaagtggacttgaccaagagcacacaaaatcagagttt

SEQ ID NO: 168754 - DNA, 601 bp, Human
acctgtcatgatggcataattacagaacacatggttacacctattatacatgattacagaataagttgatttatctactgaaaagaaaaaagttttctataaacactttccaacctcgcacaactatgtaattaaataattggcaagtaaactactatgtataaaacattaagggcctggtgcagtggctcacacctgtaatcctagcactttgggagcccgaggcaggtggatcacttgaggtcaggaattcaagaccagcctggccaatatggtgaaatgccatctctactaaaaatayggaaattagccaggcgtggtggtgagcacctatgatcccagctactcaggaggctgaggcacaaggatcactggaacccaggaggtggaggttgcaatgagtgaagatcgcgccactgtactccagcctgggcaacagagcgagactcggtctcaaaaaaaaacaaaaacaaaaacaaaacaataaaacaatgacaggatttaagaatagagggagacttccactgttcaggtatctaatgtaaaccaactgtataaaataacaatcacctaaatttactaatttaacaaactgatgaag

SEQ ID NO: 168755 - DNA, 601 bp, Human
agctgagatcgcgccattgcactccagcctgggtgacagagtgagactccatctcaaaaaaaaaaaaaaaagaaaagaaaagataaaaagaaaaagaaaagaaaagaaattctagggctataaactttgggggggggaaaaaaagctcagccaggcacagtagctcacgcctgtaatcccagcactctgagaggctaaggccagtagatcacctgaggtcaggagttcgagaccagcctggggaacaaggggaaacccccatctctactaaaaatgcaaaaattagccgggcgtggtggcrtgcccctgtaatcccagctgctcaggaggctgaggcaggagaatcacttgaacctgggaggtggaggctgcagtgagctgagatcacgctactgcactccagcttggtcagcagagcgagactccatctaaaaaaaaaaaaacaagaacaagaaaaaggaaaaggaaaacacagttccaggcttaaccgatggccctgaagtaaatgaattacctcaaaataagcaaaaatacataaacacaaatctacaagagttcctaaggaagataaaagtaaaactaaaacttaaaatgagtaact

SEQ ID NO: 168756 - DNA, 601 bp, Human
gaggttgcagtgagctgagatcgcgccattgcactccagcctgggtgacagagtgagactccatctcaaaaaaaaaaaaaaaagaaaagaaaagataaaaagaaaaagaaaagaaaagaaattctagggctataaactttgggggggggaaaaaaagctcagccaggcacagtagctcacgcctgtaatcccagcactctgagaggctaaggccagtagatcacctgaggtcaggagttcgagaccagcctggggaacaaggggaaacccccatctctactaaaaatgcaaaaattagccrggcgtggtggcgtgcccctgtaatcccagctgctcaggaggctgaggcaggagaatcacttgaacctgggaggtggaggctgcagtgagctgagatcacgctactgcactccagcttggtcagcagagcgagactccatctaaaaaaaaaaaaacaagaacaagaaaaaggaaaaggaaaacacagttccaggcttaaccgatggccctgaagtaaatgaattacctcaaaataagcaaaaatacataaacacaaatctacaagagttcctaaggaagataaaagtaaaactaaaactta

SEQ ID NO: 168757 - DNA, 601 bp, Human
atggtggcgtgcatatgtaatcccagctactcaggaggctgaggcaggagaatcgcttgaacccaggacacagaggttgcagtgagctgagatcgcgccattgcactccagcctgggtgacagagtgagactccatctcaaaaaaaaaaaaaaaagaaaagaaaagataaaaagaaaaagaaaagaaaagaaattctagggctataaactttgggggggggaaaaaaagctcagccaggcacagtagctcacgcctgtaatcccagcactctgagaggctaaggccagtagatcacctgargtcaggagttcgagaccagcctggggaacaaggggaaacccccatctctactaaaaatgcaaaaattagccgggcgtggtggcgtgcccctgtaatcccagctgctcaggaggctgaggcaggagaatcacttgaacctgggaggtggaggctgcagtgagctgagatcacgctactgcactccagcttggtcagcagagcgagactccatctaaaaaaaaaaaaacaagaacaagaaaaaggaaaaggaaaacacagttccaggcttaaccgatggccctgaagtaaatgaattacctc

SEQ ID NO: 168758 - DNA, 601 bp, Human
tactaaaaatacataaattagccaggcatggtggcgtgcatatgtaatcccagctactcaggaggctgaggcaggagaatcgcttgaacccaggacacagaggttgcagtgagctgagatcgcgccattgcactccagcctgggtgacagagtgagactccatctcaaaaaaaaaaaaaaaagaaaagaaaagataaaaagaaaaagaaaagaaaagaaattctagggctataaactttgggggggggaaaaaaagctcagccaggcacagtagctcacgcctgtaatcccagcactctgrgaggctaaggccagtagatcacctgaggtcaggagttcgagaccagcctggggaacaaggggaaacccccatctctactaaaaatgcaaaaattagccgggcgtggtggcgtgcccctgtaatcccagctgctcaggaggctgaggcaggagaatcacttgaacctgggaggtggaggctgcagtgagctgagatcacgctactgcactccagcttggtcagcagagcgagactccatctaaaaaaaaaaaaacaagaacaagaaaaaggaaaaggaaaacacagttccaggcttaaccg

SEQ ID NO: 168759 - DNA, 601 bp, Human
cacgaggtcaagagtttgagaccagcctggccaacatggggaaaccccacctctactaaaaatacataaattagccaggcatggtggcgtgcatatgtaatcccagctactcaggaggctgaggcaggagaatcgcttgaacccaggacacagaggttgcagtgagctgagatcgcgccattgcactccagcctgggtgacagagtgagactccatctcaaaaaaaaaaaaaaaagaaaagaaaagataaaaagaaaaagaaaagaaaagaaattctagggctataaactttggggggggraaaaaaagctcagccaggcacagtagctcacgcctgtaatcccagcactctgagaggctaaggccagtagatcacctgaggtcaggagttcgagaccagcctggggaacaaggggaaacccccatctctactaaaaatgcaaaaattagccgggcgtggtggcgtgcccctgtaatcccagctgctcaggaggctgaggcaggagaatcacttgaacctgggaggtggaggctgcagtgagctgagatcacgctactgcactccagcttggtcagcagagcgagactccatctaaaaaaa

SEQ ID NO: 168760 - DNA, 601 bp, Human
aggtggatcacgaggtcaagagtttgagaccagcctggccaacatggggaaaccccacctctactaaaaatacataaattagccaggcatggtggcgtgcatatgtaatcccagctactcaggaggctgaggcaggagaatcgcttgaacccaggacacagaggttgcagtgagctgagatcgcgccattgcactccagcctgggtgacagagtgagactccatctcaaaaaaaaaaaaaaaagaaaagaaaagataaaaagaaaaagaaaagaaaagaaattctagggctataaactttgggggggggaaaaaaagctcagccaggcacagtagctcacgcctgtaatcccagcactctgagaggctaaggccagtagatcacctgaggtcaggagttcgagaccagcctggggaacaaggggaaacccccatctctactaaaaatgcaaaaattagccgggcgtggtggcgtgcccctgtaatcccagctgctcaggaggctgaggcaggagaatcacttgaacctgggaggtggaggctgcagtgagctgagatcacgctactgcactccagcttggtcagcagagcgagactccatc

SEQ ID NO: 168761 - DNA, 601 bp, Human
cttcctaattaagatgcttgagagagtctccattcaaattattttttaagataagttgccaatattaacaacaaatattattttgagccaattatcttccactagtatactttttaaaatagaaaagtcattttttcaagttatcatagggaagggaaaggaaaaggagaggaggaggggaagaggagaggaactggaagggaaaggaacaggtctgcagaggaggaagggggaaagggtagagagtcagccaatgtacaccccaccaggcatcttccacagaaattctagggctcggccrggtacggtggctcatgcctgtaattccagaactttgggaggccaaggcaggtggatcacgaggtcaagagtttgagaccagcctggccaacatggggaaaccccacctctactaaaaatacataaattagccaggcatggtggcgtgcatatgtaatcccagctactcaggaggctgaggcaggagaatcgcttgaacccaggacacagaggttgcagtgagctgagatcgcgccattgcactccagcctgggtgacagagtgagactccatctcaaaaaaaaaaaaaaaagaaaagaaa

SEQ ID NO: 168762 - DNA, 601 bp, Human
atatgatccaacaattccacttgtaggtatatacccaaagaaactgaaagcaggaactcagatagttgcacatcaatgttcatagcaacacagcagacaaaaaatgaaaacaacccaaatgttcacaaacagatgaataggtttttttaaagtatgtatgtatacatacaatagaatattgttcagccctaaaaagcaaccaaactctgatttttgctacaacatggatgaaccctgaaaacatcatgataagttaaataagtcagacataagtcagtgaaataactcagacattatggtragtgacatggtttggctctgtgtccccacccaaatctcatgttgaactgcaattcccagtattgggggaagagttggtgggaagtgattggatcatgggggcagatttcccccttgctgttcttctgatagcgagtgagttctcacgagattgtccctgcttccccttctccttctgctatgactgtacatttcctgaggcctccccagccaagcctcctgtacagcctgcagaaccatgaggcaactaaacttcttttctttataaattacccagtctcaggtagttcttgatagcttg

SEQ ID NO: 168763 - DNA, 601 bp, Human
acagacatttctcaaaagaagacacagaaatgttggtttgtgtcctttgagatgaaaaaataaagaagaaaaagacatagaaatggccaaaaggtataaaaaacaatgctcaacattacttaccatcagggaaatgcaaatcaaaaccacaatatatcatcttaccgcagttagaatggctgttattaaaaagataataaataacaaatgctgacgagaatgtgaagcaacagtaactcttctatactgttgataggaatgtaaattagtacagccactatgcaaaacagcatagagattkctcaagaaaacaaaaatagaattaccacatgatccggcaatcctgctactgggtgtttatccaaaggaaaagaaatcagtatgtcaacaggatacctgcactcccatgtttagtgcaggactatttacaatagccaagatatgtaatcaactaagtgtgaatcaacggataaatgtttaaagaaaatgtagcatatatacacaatggagtacaatttgactattaaaaataataataataaggcccggagcagtgactcacgcctataatcccagcactttgggaggacgaggtgggcgg

SEQ ID NO: 168764 - DNA, 601 bp, Human
catctgacaagggacaaatacccagaatatacaaggaactcaatagtttaaaaaaaaatcccattaaaaagtgggcaaaggacatgaacagacatttctcaaaagaagacacagaaatgttggtttgtgtcctttgagatgaaaaaataaagaagaaaaagacatagaaatggccaaaaggtataaaaaacaatgctcaacattacttaccatcagggaaatgcaaatcaaaaccacaatatatcatcttaccgcagttagaatggctgttattaaaaagataataaataacaaatgctgrcgagaatgtgaagcaacagtaactcttctatactgttgataggaatgtaaattagtacagccactatgcaaaacagcatagagatttctcaagaaaacaaaaatagaattaccacatgatccggcaatcctgctactgggtgtttatccaaaggaaaagaaatcagtatgtcaacaggatacctgcactcccatgtttagtgcaggactatttacaatagccaagatatgtaatcaactaagtgtgaatcaacggataaatgtttaaagaaaatgtagcatatatacacaatggagtaca

SEQ ID NO: 168765 - DNA, 601 bp, Human
ggctgaggtggaaggactgcttgagccctggagttcaagcttgcaatgagctatgatcatgccactgcactccaacctgggagacagaacaaaattccaacttaaaaaaaaacaaaaaaacaaaaaaaaaaaaacagggcagaattcaacaaaacagacactcaaaaaacaataggaaggataaacaaaaccaagtttttttgaaaagataaataaaatcaatgaccacttgctaatcaagaaaaaaaaacagaaatagcctgttgaatagaagaaaatatttgcaaactattcatctgasaagggacaaatacccagaatatacaaggaactcaatagtttaaaaaaaaatcccattaaaaagtgggcaaaggacatgaacagacatttctcaaaagaagacacagaaatgttggtttgtgtcctttgagatgaaaaaataaagaagaaaaagacatagaaatggccaaaaggtataaaaaacaatgctcaacattacttaccatcagggaaatgcaaatcaaaaccacaatatatcatcttaccgcagttagaatggctgttattaaaaagataataaataacaaatgctgacgagaat

SEQ ID NO: 168766 - DNA, 601 bp, Human
ataataatcaaggtgactcagtgactcagtgcctgaaagcccagcaccctgagaggtggaaatgggagtatcacttgaggctaggagttcgagaccagcatgagcaacatagcaagaccccatccctaaaaaaatgtaaaaaaaacagcccagagccctgtagttctagttacttgggaggctgaggtggaaggactgcttgagccctggagttcaagcttgcaatgagctatgatcatgccactgcactccaacctgggagacagaacaaaattccaacttaaaaaaaaacaaaaaaacaaaaaaaaaaaaacagggcagaattcaacaaaacagacactcaaaaaacaataggaaggataaacaaaaccaagtttttttgaaaagataaataaaatcaatgaccacttgctaatcaagaaaaaaaaacagaaatagcctgttgaatagaagaaaatatttgcaaactattcatctgacaagggacaaatacccagaatatacaaggaactcaatagtttaaaaaaaaatcccattaaaaagtgggcaaaggacatgaacagacatttctcaaaagaagacacagaaatgttggtttgtg

SEQ ID NO: 168767 - DNA, 601 bp, Human
actagtaaagcaagaacaaacaaaacccaaaattagtagaagaaaataaattataataatcaaggtgactcagtgactcagtgcctgaaagcccagcaccctgagaggtggaaatgggagtatcacttgaggctaggagttcgagaccagcatgagcaacatagcaagaccccatccctaaaaaaatgtaaaaaaaacagcccagagccctgtagttctagttacttgggaggctgaggtggaaggactgcttgagccctggagttcaagcttgcaatgagctatgatcatgccactgcaytccaacctgggagacagaacaaaattccaacttaaaaaaaaacaaaaaaacaaaaaaaaaaaaacagggcagaattcaacaaaacagacactcaaaaaacaataggaaggataaacaaaaccaagtttttttgaaaagataaataaaatcaatgaccacttgctaatcaagaaaaaaaaacagaaatagcctgttgaatagaagaaaatatttgcaaactattcatctgacaagggacaaatacccagaatatacaaggaactcaatagtttaaaaaaaaatcccattaaaaagtgggca

SEQ ID NO: 168768 - DNA, 601 bp, Human
aatgcaaatattattagatctaaagggagatatcaactgcaataccataatagttggtagacttcaacaccccactctcagcattaaacagatctagacataaaattaacaaagaatcattggatttaaactgcacattggaccaaataggcctaaaagacatttacagatttcatacaacagttagagtacacaacattcttctcatcagcacatgaaatactctcgaggatagaccatatgttaggaaacaaaacgtttcaacaaatttttttaaatagaaatcatatcaagtcagacyacaaaagaataaaactagaaaccacgaacaagaactttggaaactgtacaaatacatgaaaattaaacaaacatcctcctgaaagacaactgatcaagaaagaaattaaggaagaaatcaaaaaacaaatgaaacgaatgaaaatttgaaacacgacataccaaaatccatgggatacaacaaaagcactgcttacagggaaatttacagcaataaatgcctacctcaaaaaatatggaaagatttcaaataaacaatataatgaagcacctcaaggaactagtaaagcaagaacaaaca

SEQ ID NO: 168769 - DNA, 601 bp, Human
acacaactagaccaactgtacaagaaatgctcaaaggaattctgcatctggaagcaaaaagatgatgatcaccatcatgaaaacacacagaaatataaagctaactggtagagcagatacacaaatgagaaaaagaagtcaaatgttaccactaaagaaaaccaccaaaccacaatgataaacaataagagaaaaagaaaggaacaaagaatatacaggctgggcacagtggctcacatctgtaatcctagcactttgggaggccgaaacaggcaggtcacttgaggccaggagtttgagrccaggagtttgagaccagcctgagcaatgtggcaaaaccctatctctacaaaaaattttaaaaattagccaagcatggtggcgtacacctttagtcccaactatgaagggctgaggtgggaggatcacctgagcccaggaggtcaaggctgcagtaagccatgtgtgattgcaccactgcactccagcctgagcaacacagtgagagcccatctcaaaaaagccaaagaaaaccaaaaaatatacaaaacaacaagaaattaataaaatggcaggaataagcgctcacataccagtaata

SEQ ID NO: 168770 - DNA, 601 bp, Human
caagcaaaaacaggtaatttgacacaactagaccaactgtacaagaaatgctcaaaggaattctgcatctggaagcaaaaagatgatgatcaccatcatgaaaacacacagaaatataaagctaactggtagagcagatacacaaatgagaaaaagaagtcaaatgttaccactaaagaaaaccaccaaaccacaatgataaacaataagagaaaaagaaaggaacaaagaatatacaggctgggcacagtggctcacatctgtaatcctagcactttgggaggccgaaacaggcaggtcrcttgaggccaggagtttgagaccaggagtttgagaccagcctgagcaatgtggcaaaaccctatctctacaaaaaattttaaaaattagccaagcatggtggcgtacacctttagtcccaactatgaagggctgaggtgggaggatcacctgagcccaggaggtcaaggctgcagtaagccatgtgtgattgcaccactgcactccagcctgagcaacacagtgagagcccatctcaaaaaagccaaagaaaaccaaaaaatatacaaaacaacaagaaattaataaaatggcaggaata

SEQ ID NO: 168771 - DNA, 601 bp, Human
gcagatttctcagcagaatccttacaggccaggagaaaatgggatgatatattcaaagtgctaaaagaaaaaaatacctggcagccaagattacacccaggaaaactttctttcagaaatgagggagaaataaagtccttactacacaagcaaaaacaggtaatttgacacaactagaccaactgtacaagaaatgctcaaaggaattctgcatctggaagcaaaaagatgatgatcaccatcatgaaaacacacagaaatataaagctaactggtagagcagatacacaaatgagaaaargaagtcaaatgttaccactaaagaaaaccaccaaaccacaatgataaacaataagagaaaaagaaaggaacaaagaatatacaggctgggcacagtggctcacatctgtaatcctagcactttgggaggccgaaacaggcaggtcacttgaggccaggagtttgagaccaggagtttgagaccagcctgagcaatgtggcaaaaccctatctctacaaaaaattttaaaaattagccaagcatggtggcgtacacctttagtcccaactatgaagggctgaggtgggaggatcacctgag

SEQ ID NO: 168772 - DNA, 601 bp, Human
aaagcaaggaaatatgacctaaataattctgcagcaatagattccaatgaaaaagaaatttatgagatcccagaaaaagaattcaaaataatatttaaaaagctaagtgaggtacaatatacagacacaatactaagaaatcataaaatttagaatacgaatgagaaatttaccaaagacagatatcatagggctaggctcacatctgtaatcccagcactgtgggaggctgaggcaggtggatcgtttcaacccaggagtttgagaccagcctgggcaacacggcaaaaccccatctctaaaaaaaaaaaaaaaaaaaattagcccagcatattggcgtgaacctgtagtcccaactactcaggtggttgaggtgggaggatcgcttcagcccagaaggcagaggttgcagtgagccaagatcgcatcaatgtactctagcctgggcaacagagtgagaccttgtctcaaaaaaaaaaaaaaaagatagacagatatcataaaaaagaacgaaatgcaactactggaagtaaagaattcattgaatgaaatacaaaaattatttcaaaagcttcatcaatacactagatcaagcaaaaga

SEQ ID NO: 168773 - DNA, 601 bp, Human
agttaagaacacttgaagtaggccccttacagccttgatactgatttctttttttctttctttctttttttttttttcccaagatgagtctcactctctctcgcccagactagagtgcaatgcagcgatctcggctcaccgcaacctccgcctcccaggttcaagtgattcttccgcctcagcctcctgagcagctgggattacaggcatctgccatcatgaccagctaatttttgtacttttgtacagatgcggtttcaccatgttagccaggctagtctcgaactcctgacctcaggtaatccacccacttcagcctgggaaagtgctgggattacatgtgtgagccaccgcacctggccaatatcgatttcataataagaaaatcatctcatactgacaaagggagctgcctggggaccacacgatgatactgctcatgaacggtcccctccactccttagtcctaagcagctagagcacagcacgttttgagagcccagccccaacaaggctgtaccctgccctggggccaaacagccccggcatctccatatccctggagtccacttacatccccacctacagccactgttgtgat

SEQ ID NO: 168774 - DNA, 601 bp, Human
tcgagaggctaaaatgggagaatcctgagcccgggaggcagaggttgcagtgggccaagatcacgccactgcactccaagtctgggtgacagagtgagaccctgtctcaaaaacaacaacaaaaaaaaacattgtatgctatacaccctacccaaagaaatatttatgtatctattaaggtgtctaagtacaagctagataaacaacttagaaggaaaacagaagttaagaacacttgaagtaggccccttacagccttgatactgatttctttttttctttctttctttttttttttttyccaagatgagtctcactctctctcgcccagactagagtgcaatgcagcgatctcggctcaccgcaacctccgcctcccaggttcaagtgattcttccgcctcagcctcctgagcagctgggattacaggcatctgccatcatgaccagctaatttttgtacttttgtacagatgcggtttcaccatgttagccaggctagtctcgaactcctgacctcaggtgatccacccacttcagcctgggaaagtgctgggattacatgtgtgagccaccgcacctggccaatatcgatttcataa

SEQ ID NO: 168775 - DNA, 601 bp, Human
acttttgttaagacacaaaagaatgcagagtctaattccattgatatgtaattctggaacagtcaaaatctatctagtagtgacaggaagcaaatcagtagttgcctagggtggagactaagagtaaaaagtaatgagggaattttgtgatacgacagaaacattctttatcttgatttcaatggcagttgcctaagtatatacatttgccaaaatgcacctctaactatatacctaacatgaatatattttatgtaagtaggggtcagtagcatacatttactagcttgaaaactgtgtmcatttttaaacattgtctattttctcttttccttcatttcacgtcagtcttggcacccttttagtttgaggctgtactcacattcctcttgccaaataactcccagggcttcccaggtacaagaactccaggctttctacttaaagccttaaggacccaagctactgctgttaagtaatcaacaaagcccaacacatcttctaaatgagaactccacaaacttaaaaatagactctcctgaacaaacaagtatcctgcctcaacttttgctgcctatcatgtattttcataaaattactt

SEQ ID NO: 168776 - DNA, 601 bp, Human
ctttcaaaacaaaaacaaaaacaaacaaggccaggcgagttggctagtgcctgtaatcccagtactttgggaggctgagggaaaccccatctaaaacaaacaaacaaacaaaaaaagcttatgacccagcaattctactcaagaaaaaagaaaacataaagcatatatccacacaaataactgaacacaaatgttagcagcagctttatttataatagccaaaaactgaacataacctaaatgtctatcaacaagtaaagagaaagatgtattcatataatggcaaactactcagaaattaaaaaaaaaaaaaagccaactattgaaaacacgcacttttgttaagacacaaaagaatgcagagtctaattccattgatatgtaattctggaacagtcaaaatctatctagtagtgacaggaagcaaatcagtagttgcctagggtggagactaagagtaaaaagtaatgagggaattttgtgatacgacagaaacattctttatcttgatttcaatggcagttgcctaagtatatacatttgccaaaatgcacctctaactatatacctaacatgaatatattttatgtaagtaggggtc

SEQ ID NO: 168777 - DNA, 601 bp, Human
gacaaacaacaatgtgaaaaaatacttcacaaagaagatacacaggtggcaaacaagcatatggaaacctacataacatcattagtcaacaaagaaatgtaaatcagaactagaataatatattatcacataccctttgctagaataacatctccaaatattagtagggtgttgagtacctggaactcacacactgctgatgggaatggaaaatgacaacatcactttggaaaactgtttagcactttcttacaaagtcaaacatataaaaaccaggccaggcacagtggctcatgcctayaatcccagcactctgggaggccgagacaggcagatcactgaaggtgaggagttcaagaccagcctggccagcatgtttgaaaccccgtctgtactaaacatacaacaattagccaggtgtggtggcaggtgcctgtaatctcagtgatttgggaggctgaggcaagagaattgcttgaacccaggaggaggaggttgcagtgagccgagatcacgacactgcactccagcctgggaaacagaacaacactccctttcaaaacaaaaacaaaaacaaacaaggccaggcgagttggctagt

SEQ ID NO: 168778 - DNA, 601 bp, Human
agaaaactgtcatggccttggtagtcaatgctaccttaagaaacaaaagcaaaaatcataaaagaaaaaaattttttcattaaaagggcttcttaaaaattcaaaacttccgctgagaaatagctttaaaaaaaaaaaaaaaggcaagccacagtctgggagaaaacatttgcaatacatatggtctgacaaagaacttatattcggaatatctttttaaaaacctcttacaaatcaataataagacaaccattgaaagacaaacaacaatgtgaaaaaatacttcacaaagaagatacayaggtggcaaacaagcatatggaaacctacataacatcattagtcaacaaagaaatgtaaatcagaactagaataatatattatcacataccctttgctagaataacatctccaaatattagtagggtgttgagtacctggaactcacacactgctgatgggaatggaaaatgacaacatcactttggaaaactgtttagcactttcttacaaagtcaaacatataaaaaccaggccaggcacagtggctcatgcctataatcccagcactctgggaggccgagacaggcagatcactgaa

SEQ ID NO: 168779 - DNA, 601 bp, Human
tcaaaaagtgatgctaaaaaatttatatccatgtgaaaaatattacccttgacccttacctctatcataaagaaaaattaaattgaattgcaatacagacttacatgtaaaactgtaactggaaacatctagaagaaaactgtcatggccttggtagtcaatgctaccttaagaaacaaaagcaaaaatcataaaagaaaaaaattttttcattaaaagggcttcttaaaaattcaaaacttccgctgagaaatagctttaaaaaaaaaaaaaaaggcaagccacagtctgggagaaaacwtttgcaatacatatggtctgacaaagaacttatattcggaatatctttttaaaaacctcttacaaatcaataataagacaaccattgaaagacaaacaacaatgtgaaaaaatacttcacaaagaagatacacaggtggcaaacaagcatatggaaacctacataacatcattagtcaacaaagaaatgtaaatcagaactagaataatatattatcacataccctttgctagaataacatctccaaatattagtagggtgttgagtacctggaactcacacactgctgatgggaatgga

SEQ ID NO: 168780 - DNA, 601 bp, Human
aaaaatatagacagatcaatgaaatgaaagacctaagaatatataaataggtctcaacatatatagatcatggcaattcaaagaattgataggtttttcaaaaagtgatgctaaaaaatttatatccatgtgaaaaatattacccttgacccttacctctatcataaagaaaaattaaattgaattgcaatacagacttacatgtaaaactgtaactggaaacatctagaagaaaactgtcatggccttggtagtcaatgctaccttaagaaacaaaagcaaaaatcataaaagaaaaaawttttttcattaaaagggcttcttaaaaattcaaaacttccgctgagaaatagctttaaaaaaaaaaaaaaaggcaagccacagtctgggagaaaacatttgcaatacatatggtctgacaaagaacttatattcggaatatctttttaaaaacctcttacaaatcaataataagacaaccattgaaagacaaacaacaatgtgaaaaaatacttcacaaagaagatacacaggtggcaaacaagcatatggaaacctacataacatcattagtcaacaaagaaatgtaaatcagaactag

SEQ ID NO: 168781 - DNA, 601 bp, Human
gtatccctgtcaatgggctcaccatggtcaacatgtaaagtgaaggaactcccagcagaagatacccaggaatactgttcttcgtcattgtgctttgtgatggctactttctctgccaccaggtaggcagaataaaagccaacaccaaattgcccaatcatggagatttctgcacaagactgaaaagcctccataaatgcttcagtaccagacttggcaatggctcccaaattatttatgagatcagccttggtcatgccaatgcctgtgttgaccaaagtcaggatgcattcccgagggktggggatgatgtcaattttcagttctttaccaccgtccaacttggaagggtctgtcaggctctcatagcgaatcttgtctaaggcatcagaagcattagagatcaactcctgaaggaaaatctccttgttggaatagaaggtattgattatgagagacatgagttgggcaatttctgcctaaaaggcaaaagtcgccacctccccttctccatggtacacctctgcaggcatcttgaaaggaaaaggcttacaagtactagagagcaaggtgggctgagtgtccaaaatgcacacggcac

SEQ ID NO: 168782 - DNA, 601 bp, Human
tcaggtgatctgcccgcctcagcctcccaaagtgctaggattacaggcgtgagccaccatgcccagccggcatttcttaacaatgtttttgcaaatgacttccaagattttgctctgctggagcatttcccgggagatgtttggggaaagatccttaagagtcaaccataccacggacaaagccgacatactctggcatcaaatcatcaaagctgtccatgatccacacatgatggacacagagttgttcattttcctcttgttctaaaaaaggtcaaagggagcctgatgagggatgaayagcaatgccctgaattccaaatgaccttctacagggaattgcttgactgccaagtggtcttcccaggcactggtgaggctcttgtagaattctccacactcttcctgggtgatgtcatcagggtttctggtccaaatcggcttggtctggtttagttcttcccgatcagtgtatttctccttgatcttctttgttttcttcttattattcttatcagtgtcatcctcctcatcggaacccacatcttcagtcttgggcttttctttatcatctttatcttcctcttctttctcacctttc

SEQ ID NO: 168783 - DNA, 601 bp, Human
tgaactcctgacctcaggtgatctgcccgcctcagcctcccaaagtgctaggattacaggcgtgagccaccatgcccagccggcatttcttaacaatgtttttgcaaatgacttccaagattttgctctgctggagcatttcccgggagatgtttggggaaagatccttaagagtcaaccataccacggacaaagccgacatactctggcatcaaatcatcaaagctgtccatgatccacacatgatggacacagagttgttcattttcctcttgttctaaaaaaggtcaaagggagcctsatgagggatgaacagcaatgccctgaattccaaatgaccttctacagggaattgcttgactgccaagtggtcttcccaggcactggtgaggctcttgtagaattctccacactcttcctgggtgatgtcatcagggtttctggtccaaatcggcttggtctggtttagttcttcccgatcagtgtatttctccttgatcttctttgttttcttcttattattcttatcagtgtcatcctcctcatcggaacccacatcttcagtcttgggcttttctttatcatctttatcttcctcttc

SEQ ID NO: 168784 - DNA, 601 bp, Human
ttcatattggctatctagctgtaggtgctggtcacaatgcggcagggtgaagacacaagcctactggagattgtcacccgctcaaccttcttatctaagatttctttcatgagcctgcagaggttctcaaactttacgttgctctcctccattatcttcttctcctcctcatcctcaggtagctccagaccctccttggtaactgacagcaggctcttcccatcaaattccttgagctgctgcacacagtactcatcaatgggctcactcatatatattacctcgaagcccttcttccacwcttgctccacaaaagcagagttggctacctgctctttgcactcaccaatgatgtcacagatggacttctgtgcctccttcatgcaagacacatactctgacagagatgtcatctcatctccagactggaaggtgtgagaccacagcagttcagacaggtgtcgccagttaatagagtcctcatggattccaagccacgagattttagagaatacctcatctaatttcttgttattctccttgtcttctgccagcccagagaagctaagctcaagccacttcttcttcttttttttttttt

SEQ ID NO: 168785 - DNA, 601 bp, Human
cagcaccaccgggtcactgacagcctcgttgttcttgtctgcctcagccttctgctgtagtgtctccacaatggggtggttggggttgatctccaggtgctttttagccatcatataacccatcatagagttgtcccaaaatgcctgcgctttcatgatccacttcatattggctatctagctgtaggtgctggtcacaatgcggcagggtgaagacacaagcctactggagattgtcacccgctcaaccttcttatctaagatttctttcatgagcctgcagaggttctcaaactttacsttgctctcctccattatcttcttctcctcctcatcctcaggtagctccagaccctccttggtaactgacagcaggctcttcccatcaaattccttgagctgctgcacacagtactcatcaatgggctcactcatatatattacctcgaagcccttcttccactcttgctccacaaaagcagagttggctacctgctctttgcactcaccaatgatgtcacagatggacttctgtgcctccttcatgcaagacacatactctgacagagatgtcatctcatctccagactggaaggtgtga

SEQ ID NO: 168786 - DNA, 601 bp, Human
ttattttacatactttcagaacaaaataaacaacaacaaaaaaacaggatatacaacatccaattctgctgtcaaagtagagagggaatggggcttgatgcccttgtttcctgccttagacacaaggacagaagagaaaaaatactagatatcagcagagagcgccaggtgggacaggaccactcaaagctgcagtgggagccatggggacactatgcaagggcacaaggtttgcaggtataaactcttaatctacttcttccatgtgaaacacatcctcaggaacacatcacatcaggarcagcagcactgagttcctctgttgccacttcatcttcatcaatagctaacctagcttgatcatgtggtagatgcagctggataggtctgaggatcctcaagggagaagccagaagagagcagtgtggtttcaaacagcagcaccaccgggtcactgacagcctcgttgttcttgtctgcctcagccttctgctgtagtgtctccacaatggggtggttggggttgatctccaggtgctttttagccatcatataacccatcatagagttgtcccaaaatgcctgcgctttcatgatccac

SEQ ID NO: 168787 - DNA, 601 bp, Human
cttttatgcaactctgtaacattaagtatgatgttacagataccacaacaagccaagaaaaataatcctcttttagttgctaatccccagaaatggtaatcttttgtgttgttttactgtataaaaacagcatattctttattttacatactttcagaacaaaataaacaacaacaaaaaaacaggatatacaacatccaattctgctgtcaaagtagagagggaatggggcttgatgcccttgtttcctgccttagacacaaggacagaagagaaaaaatactagatatcagcagagagmgccaggtgggacaggaccactcaaagctgcagtgggagccatggggacactatgcaagggcacaaggtttgcaggtataaactcttaatctacttcttccatgtgaaacacatcctcaggaacacatcacatcaggagcagcagcactgagttcctctgttgccacttcatcttcatcaatagctaacctagcttgatcatgtggtagatgcagctggataggtctgaggatcctcaagggagaagccagaagagagcagtgtggtttcaaacagcagcaccaccgggtcactgacagcc

SEQ ID NO: 168788 - DNA, 601 bp, Human
aaaaactagaaaactgaacaaagcaataaataaaaaggacaatacatcataagcaaatgaagtaataagaggctggcttaacattctaaaatcatcaatgtaattcaccgcattcaaaggggagaaaagccacaaaatcatctcattaggtacagaaaaagcatctaacaaatttcagcacctactcatgataaaattctcagcaaactaggaagagacaggaacttccttaacccgataaaatgcatctacaaactccagttaacatcatacttaaagatgaaagactgaatgcttctcycctaagattgggaagaaggtaaagatattcacacttgccacttttatgcaactctgtaacattaagtatgatgttacagataccacaacaagccaagaaaaataatcctcttttagttgctaatccccagaaatggtaatcttttgtgttgttttactgtataaaaacagcatattctttattttacatactttcagaacaaaataaacaacaacaaaaaaacaggatatacaacatccaattctgctgtcaaagtagagagggaatggggcttgatgcccttgtttcctgccttagaca

SEQ ID NO: 168789 - DNA, 601 bp, Human
aaaaaaaaaaaaagactgatattccttatgaacataaacaaaaaaatccaaccaaaaactagaaaactgaacaaagcaataaataaaaaggacaatacatcataagcaaatgaagtaataagaggctggcttaacattctaaaatcatcaatgtaattcaccgcattcaaaggggagaaaagccacaaaatcatctcattaggtacagaaaaagcatctaacaaatttcagcacctactcatgataaaattctcagcaaactaggaagagacaggaacttccttaacccgataaaatgcawctacaaactccagttaacatcatacttaaagatgaaagactgaatgcttctcccctaagattgggaagaaggtaaagatattcacacttgccacttttatgcaactctgtaacattaagtatgatgttacagataccacaacaagccaagaaaaataatcctcttttagttgctaatccccagaaatggtaatcttttgtgttgttttactgtataaaaacagcatattctttattttacatactttcagaacaaaataaacaacaacaaaaaaacaggatatacaacatccaattctgc

SEQ ID NO: 168790 - DNA, 601 bp, Human
agagtactcaactcattttatgtggctcactctgattccaaaaccaaagacagaccccccccaaaaaaaaaaaaaaaagactgatattccttatgaacataaacaaaaaaatccaaccaaaaactagaaaactgaacaaagcaataaataaaaaggacaatacatcataagcaaatgaagtaataagaggctggcttaacattctaaaatcatcaatgtaattcaccgcattcaaaggggagaaaagccacaaaatcatctcattaggtacagaaaaagcatctaacaaatttcagcaccyactcatgataaaattctcagcaaactaggaagagacaggaacttccttaacccgataaaatgcatctacaaactccagttaacatcatacttaaagatgaaagactgaatgcttctcccctaagattgggaagaaggtaaagatattcacacttgccacttttatgcaactctgtaacattaagtatgatgttacagataccacaacaagccaagaaaaataatcctcttttagttgctaatccccagaaatggtaatcttttgtgttgttttactgtataaaaacagcatattctttat

SEQ ID NO: 168791 - DNA, 601 bp, Human
cattgagtgataaagtaatattatgagcataatgaaaataaattcaattacttagataaaataaactccttaaaaggtacaaattatgaaaactatcacaaaatatagaaaatctgaataagcccctatctactgaagaaaatgaattcatgatttaaggcctttccacaagaaaaataccagggccagatggttcccctgatgtcctataaaactattttaagaaaacaggagggaagagtactcaactcattttatgtggctcactctgattccaaaaccaaagacagaccccccccamaaaaaaaaaaaaaagactgatattccttatgaacataaacaaaaaaatccaaccaaaaactagaaaactgaacaaagcaataaataaaaaggacaatacatcataagcaaatgaagtaataagaggctggcttaacattctaaaatcatcaatgtaattcaccgcattcaaaggggagaaaagccacaaaatcatctcattaggtacagaaaaagcatctaacaaatttcagcacctactcatgataaaattctcagcaaactaggaagagacaggaacttccttaacccgataaaatgc

SEQ ID NO: 168792 - DNA, 601 bp, Human
acattgagtgataaagtaatattatgagcataatgaaaataaattcaattacttagataaaataaactccttaaaaggtacaaattatgaaaactatcacaaaatatagaaaatctgaataagcccctatctactgaagaaaatgaattcatgatttaaggcctttccacaagaaaaataccagggccagatggttcccctgatgtcctataaaactattttaagaaaacaggagggaagagtactcaactcattttatgtggctcactctgattccaaaaccaaagacagaccccccccmaaaaaaaaaaaaaaagactgatattccttatgaacataaacaaaaaaatccaaccaaaaactagaaaactgaacaaagcaataaataaaaaggacaatacatcataagcaaatgaagtaataagaggctggcttaacattctaaaatcatcaatgtaattcaccgcattcaaaggggagaaaagccacaaaatcatctcattaggtacagaaaaagcatctaacaaatttcagcacctactcatgataaaattctcagcaaactaggaagagacaggaacttccttaacccgataaaatg

SEQ ID NO: 168793 - DNA, 601 bp, Human
tactgcagacattgagtgataaagtaatattatgagcataatgaaaataaattcaattacttagataaaataaactccttaaaaggtacaaattatgaaaactatcacaaaatatagaaaatctgaataagcccctatctactgaagaaaatgaattcatgatttaaggcctttccacaagaaaaataccagggccagatggttcccctgatgtcctataaaactattttaagaaaacaggagggaagagtactcaactcattttatgtggctcactctgattccaaaaccaaagacagaccccccccaaaaaaaaaaaaaaaagactgatattccttatgaacataaacaaaaaaatccaaccaaaaactagaaaactgaacaaagcaataaataaaaaggacaatacatcataagcaaatgaagtaataagaggctggcttaacattctaaaatcatcaatgtaattcaccgcattcaaaggggagaaaagccacaaaatcatctcattaggtacagaaaaagcatctaacaaatttcagcacctactcatgataaaattctcagcaaactaggaagagacaggaacttccttaacccg

SEQ ID NO: 168794 - DNA, 601 bp, Human
tgagggagactgggggaaagatgtccaggacttcccagtagaagctcctgtgactctacaattatttttaaattaaaagttttttaaaaatccagacacaggtgggcacagtggctcacacctgtagtcccagtattttgggagggcaaggtgggaagattgcttgagcccaggagttttcaatcagcctgggcaatgtagcaagactccatctctaattttaaaaaaaacaaacaacgacaaaaagacactaaatattaatcaaaatgtgaaatatccaattaaaaaccacaaactattaaaaaaaacaaggggtaaaaaaaccaaaccactaactataaagaaatgtgacaaagaagaagaaaattagtcccccccaaaaaaagtgagaatgaatgataacggaattagcagacaaggatttagtgatttagtgtctatatattgtaaatatgttaaagaattatggggaaaatataagcacaataaggagaaaccaaaaactgtcgaaagaggggagggaaggggagggacagggaagagaggagagagggaaaggaatgagaggggaggaaacttccagaattggaaaatataattt

SEQ ID NO: 168795 - DNA, 601 bp, Human
tatatttaaaaatgtttaaaatgtgacccacagaacattgtaaatgattaaaaactaacataaaaacattacaacctaaaagaattcttaacttcacaagggttttactttgatgatgtgaatctgatttaatttgggacacttttttagaaggatacattatttgtgtttgtaacagtctttgaagagcttggaaataaaatttctgcttaattaatcataaaaaaaaaaaaggctcaaaagggtcaagctgatccacaagttactcaactatctaacaaacaaaactccatactttttaaaaaaaaaatacgaacagttaaactgtggtatatccatacaataggatagaatttagtaataaaaaggaacaaactattgataaacacaacaatttgtacaaacttcaaaaaaattatgctgagtggaaaagtcaatctcaaagatactacttgcataatacgattcatgcgacaatcatgaaataatctaattatggagatggagaaccaattaatggttgtttaggattatagatgggggaggggatgaatgtggccataaagggatagcacaagggagtctggtgatgctaccattg

SEQ ID NO: 168796 - DNA, 601 bp, Human
gtgaacataatagaatttctacttaatttttttgacaattacaacaaagtattacgtctttttttttacatatacatgttttgcagagtactataagaaccttgttttttaaattacttaataaaaatttgtaacataaagttgtatggggaaacatacagtcacttcacacatttgtgacatgaataagttggtacaatctctatggtgggaaaactggtttaaaaaatccaaattacaaatgtacatagcctttgatacaagaattccatttctagaaatgtatcttacatatacttgmatgtaagtgaaattacttccatactacaaagaatgtggcataataagaaatataaagttaagccaggtgcagtggctcatgcctgtaatcccagaactttgggaggctgaggcaggtggatcatctgaggtcaggagttcaagaccagcctggccaacacagcaaaaccgtctctactaaaaatacaaaaactagccaggcatggtggcttgcacctctagtcccagctactggggaggctgaggtaagagaactgcttgaatctgggaggtggaggctacagtgagccaagatcatgcc

SEQ ID NO: 168797 - DNA, 601 bp, Human
cgcccagcctataaacacatttttaaatagaacagtgtcaaatatttcatgggcactttgaacaaaagtataccaacagtacttttaaagatattggacaaagatttgtaatactatcccatcaattacacttctccagtgaaaggaaataataggaaaaaaggtacttttggttcttaatataatcacaacgaaaaggtgagcaccaaaatcaaatgacataaagggtgaaagtagagggagagggctttaaaccttgaatttacccattacgattctctgattaaaataaaaatcaggmcttccacaatttctaagttgtagaataacattaattagttgcctctgaattaatcatagactggaggtaagagcccaagacgctgatatttggagttttttgttttgttttgttttcttaaatagacagggcccctctctgtcccccaggctatagtgcagtggcacaatcataactcactgtagcctcaacctcctgggctcagcaatcctcccacgtcagcctcccatctaactgaaactacaggtgtgccaccacaactaaatttttatgttttttagagacaaggtctcactatac

SEQ ID NO: 168798 - DNA, 601 bp, Human
tgtgtatatatatacacacatgcatacatatatacacatatatatggttaaatcttgaatataaatttactatggaaattttcacataaaatatatcaagcagaatgtgagatgtgaacagcaactagtatttagttaaaatatatacaattactaataacagcaatgaaaaatagagtatctgccttgttaccaaccacattccttgcacctagctgagtgcctagcatgtatgcagtagtcatcaataattgtaaattggcccagcacagtgtggttcacacctataatcccagcactytggggggccgaggtgggcagatcactcgaggccaggagttcgagaccagcctagctaacatagcgaaaccctgtctctactaaaaacacagaaaacattagctgggcctggtggcacatgtctgtaagtccagctactcaggaggctgaggcagaagaatcacttgaaccctggaggcggaggttgctgtgagctgacatggcaccactgaactccagcctgggtgacaagagcaagaccttgtctcaaaacaaaacaaaacaattaattgttaaattaacttaaaagaagcaagcaaac

SEQ ID NO: 168799 - DNA, 601 bp, Human
ttatgaaggaggatgatagcttagagcttgaaaagaaaggtagagtttgaaataccaggagttaaaactggaaaaggaatcaaatagtggtgaatgaaaatacagggaagtagcattaatgagcttatgatttaacaagtagctaaaaatcataaatgcatcctacctagtatacatatgttattttctatagcaatctagcagcagagataacaagcagttggacagatgaagtacaaaaactgtcagagctgatggagcaaaaagtcaaaatggttaatgcttgtcagtgtattactaggggtaagaataaaatcattgacaataaatttctgtctatacaaaggaaaacgtatgtaggaagaagctgccaagttaggaaagcaggcaaaaattgagagactagtctaattacagtcaaaaaataataaatgggtattcaagagctatataaattagagaaatttatttctgtggtacttcaaagaagcattcccaataactggataactgtggatatacggacaatagaattaaaaggtaaagtctaaatacattttctattcttagaaaaatatcatcatataaagatggtagagaa

SEQ ID NO: 168800 - DNA, 601 bp, Human
ggcaacagggcaaggctctgtctccaaaaaaatagataaataaataataatttctttaaaaaaagcacccatgcttatttatttatgtgtttctttggctgttctcgtgctacaatggcagagctgagtagctgcaataaaacatacagctctcaaagccaaaaatatttactctctgtccctctgcagagaatttgcgaaccacggtctagaatataaatatagcaactatttagaataaaagactaatacatgaatgttttcttgtcttaaaccatggttcacttgacagatttttagrtagtttttcacaagtaattgtctaaatttgcaaacattaaaaactctgtttaagggaactccttccgtactcccatcctcatatcctacaatttcaattacctgagaagctacaaataaaatcaccttaaagattgctgcttttaaattctaaccccactactgatatgtaataataaaaagaatgttaaaaagttctccttaccacaaacatatatttacttaaacaagtataaaataaaagctgatatcaatgataaagcatttaaatgccaaaaagaacaaaaaatcaagtaacatc

SEQ ID NO: 168801 - DNA, 601 bp, Human
aaacacaatatggaactaattgacattttaaaagttttagatgcaacatcctgacatttccacaaatgaggaagcttctacatgaatgaagaggcctccatcttgaaatggtaaaataaagtttaacaatcttaatttttcagaacaagaaataggaggtcttcccattgaagcacaagagaaagaagaaataagtataggtatggctaacacacattctaaagtaggggtgccctactactataaggtatagacaaattcaggccgggcacagtggctcacgcctgtaatcccaacactytgggaggccgaggcgggcggatcacgaggtcaagagatcaagagatcgagaccatcctggccaacatggtgaaaccccgtctctactaaaaatacaaaaattagctgggcgtgatggcacatgcctgtagtcccagctattcacaggaggctgaggcaggagaatcacctgaacccagaaggcggaggttgcagtgagctgagatggcaccactgcactccagcctgggcgacggaggtataggcaaattcaacctctctgggcttttctataccccacaaaggaaaataaataataaat

SEQ ID NO: 168802 - DNA, 601 bp, Human
ccatgtcatactgcacaagttttataactctagacttcagtttccgtcatctttagagtgttgaatctagtgccttttacaatactaaaattataaaattccttactcaatttatttgtaaaacaaaatcatgagaagatagttctcaaaagaaaaaacaaaaatttcaaatataattttacttgttagggtgactttcaaagttgctttacaacatgaaagctttttttattttcatataatcatgtatttctgatagccattacagtacattgacctccatggagacagtgctggggcraatggcagccagatgtgcactaggtgactctgtgcttctctgaggaaaaataactaaacttggtaaaagaagatcctaagaagccaagaggcaaaaggtcatcatatgcattctttgtgcaaacttccaggaggagaacaagaagcagcactcatgcttcagttaacttctcggaattttctaaaaaatgctcagagaggtggaaagccgtatctgctaaagagaaaggaaaatctgaagacatggcaaagggggacaaggatggctattaaagagaaacttacatccctcctaaagaag

SEQ ID NO: 168803 - DNA, 601 bp, Human
ggcactcttataaggtcactggtacaaacataaatctatgaattatgctatcagagatgtgaaaggctgaggtttagctccgagtatctctaggacatacacgcacacatactcctaaatgctatttcttctagtttttctgtaactcatcacttataagagttgagccttggccaggcatggtggctcacacctgtcatcttagcactttaggagtccgcggcaggaggatgacttgagctcaagagctcgagaccagcctggcaacacagtgagacctcgtctctattaataaatatayatattttttaaagtgagcctaaaatataaatttgctttttcagtagtaaatatggctcaccttcaaaatcaatgataccaaaaataactttttttttttaatccttactgtcattgtctctattgtcattaagttcttggccttttagcagcctttaaactctcctaactcagaatgtaacagaaataaagcactggagtggcagccaaaagacatggatccatgtcatactgcacaagttttataactctagacttcagtttccgtcatctttagagtgttgaatctagtgccttttac

SEQ ID NO: 168804 - DNA, 601 bp, Human
gtctttaataaaccagatctcacaatgcctctttagaagcagctttttagagggccagagtcctggaccaatgtcctcaggcactcttataaggtcactggtacaaacataaatctatgaattatgctatcagagatgtgaaaggctgaggtttagctccgagtatctctaggacatacacgcacacatactcctaaatgctatttcttctagtttttctgtaactcatcacttataagagttgagccttggccaggcatggtggctcacacctgtcatcttagcactttaggagtccgcrgcaggaggatgacttgagctcaagagctcgagaccagcctggcaacacagtgagacctcgtctctattaataaatatatatattttttaaagtgagcctaaaatataaatttgctttttcagtagtaaatatggctcaccttcaaaatcaatgataccaaaaataactttttttttttaatccttactgtcattgtctctattgtcattaagttcttggccttttagcagcctttaaactctcctaactcagaatgtaacagaaataaagcactggagtggcagccaaaagacatggatc

SEQ ID NO: 168805 - DNA, 601 bp, Human
tatacatccattagttggcaggctggtaaataatacatttatcaaggaaacagcagaattttatgtagccatttaaaggaaaaatgtagagctatgtttattgacacagaaagagatctaagatataactgtacatgaaatttaaaatggtatatgagatctgaagggctattcataaaaatgttaatggtggtggacacatttcatcttaatatacttaatttacatacaagaatacttaatttacttaagaaaaatacttaatttacatacaagaatagccattttatatagtcatttsccaatcagcacaaaaatatttttatttttactttttatttgtcagccatgatcaatcaagatatttccaactttaaaggaaaagtagtttagaaccattaacttttagaagagataagagatattagcaccatgatctaacaccctcattttatacctgaagaaaatgagaccaagaaaaagtacattacctgtataaggttataaagctattctaacatatcaccttgatttcatttctaactcttttcatatatatgccatgcctcagttctttgacatattacctcttgtgccttct

SEQ ID NO: 168806 - DNA, 601 bp, Human
catccattaaccaaagacctataaactgctggctcccataacctccttttagccttcattccacctacaataaagaggaattgtctaacactttaaattgtttctacggcaaagtgtgttctaaattcctaactgctttacagattgactataacatacagaacattcaaaattaacagctgtgtacacataaatctcctaatcatatgtcaatgttatttttaactgcattaatttattaagcaaacaattaagaaaaattattatataccaaacaaagggatacaaaaataaatgacayagaacatgcactctcaagagctgtcagtctagctgaggtgtctgacatgtaaacaagcaggcatttaagtaccaacttcccaagtgttaaggtctcccggcaatcatccacagtttattaaacactggttgaatttaatttactcatccagtcaacagctggtttccttccatgcctctcaaaggtcagtcatatgatcaatgaccagtaaaccactggattcaaaagatagggaagacttatcaacacataaacagcagtaaagagaggatacccagaactgtgaggtcaggaaaaaat

SEQ ID NO: 168807 - DNA, 601 bp, Human
taatcttcaggggaaattttaaaattctctttcctgtatattcacaaaccaataaatacttgttgaatttaatttttcagccagtatgtggtttctatgcctcttttcaaaggtcatccattaaccaaagacctataaactgctggctcccataacctccttttagccttcattccacctacaataaagaggaattgtctaacactttaaattgtttctacggcaaagtgtgttctaaattcctaactgctttacagattgactataacatacagaacattcaaaattaacagctgtgtayacataaatctcctaatcatatgtcaatgttatttttaactgcattaatttattaagcaaacaattaagaaaaattattatataccaaacaaagggatacaaaaataaatgacatagaacatgcactctcaagagctgtcagtctagctgaggtgtctgacatgtaaacaagcaggcatttaagtaccaacttcccaagtgttaaggtctcccggcaatcatccacagtttattaaacactggttgaatttaatttactcatccagtcaacagctggtttccttccatgcctctcaaaggt

SEQ ID NO: 168808 - DNA, 601 bp, Human
aaaaatataaattccttttgaaagcttgaaacttagggtaaaaaaaatttccaaatatttccaaagcaacaaaacagtatttatatatgcttcaaattctgtcagcacaaaactctcccaatagaaagggtcaagcatgcaatttttcccatatactttcaaaatttctaaaagatgctgttttccttggacaccacattaactataaaaatggacaatgacattttccctctaaaattactaacaatataatcctcatttctagaaaaagcctttgttcaactaatgaataagccctcaytgagatgctaaatcataggatgcactgtagttcccctgaaaaggccaaacagcatattctttcacaaacaatgagtcatgggtgtagaatattcggcctatttaaaacaaagatcagctttagatctattgcctttcttccagttcctctgccagcctcttgcttttgttttgttgttcaagacacaaatataaatagtacatatattgtgactctaactcaagcaggaaatagctctagttaactctcaatcatccactctttcaaggaggaatatttacagttcagattctctgtcaa

SEQ ID NO: 168809 - DNA, 601 bp, Human
tcagtttctcatttccatagttactcttctgaacttgtcactattgataactgaaagcacttcataatctcaacttctagtattctactttctttccaccacttatcttttcagcacattccctctaggttccatcaaccctttaacatcagtgagaccctttaatccaccaatgctaccaccttattgtctatcaccagatattctttctcttccttattcagtttaaatcccacagtcaattattattataattacaccactgcattcaccatcaactcccttgtgctccaccccaacrcccctgaagggagttgatggtgaatgcagtggtgtcttacttacttcagaagtgtaactatgaaagagagaagctcctcctgaagctgaatgaggctaaagaaaaactagtaattccagtctcattcaaaagtcatgatctataacctcaagcagttccttaatgccagctagcaactgaatttccagagtctattctcaatttcattcacctagttaacaccaggcagtccttgctttgccacaccagtaagtgccagtcataaaactgaccatgcaagctgaaactatgcaaaatgat

SEQ ID NO: 168810 - DNA, 601 bp, Human
aggttggtcttgaactcttggcctcaagcaatcttcacacctcagcagtccatttatatttaatgcagtcatcaatatggttagatttaaacttaccaccttgctatttattttctatttatcccatcagttttttgttcctttttctcttcttcctaacttctcttaactgtttttaaatacatttgatttattttattaacatgttaaattatttcctcttcttttttcaatggttgctccaagggcagaggaaattcctgcaaactttttctgaaaaggcctaatagtaaacatttasacttttgaacaacatgtagttgttctctatcacaactcttcaattctgccactataatgtaaaagcagccatagacaacctatcaatgaataggtgtggctgtgttctaataaaactttacttacaaaagcaaacatctggcccacaggccgtagtttgctgaccccggctctacggtttacaatatccatctttatcacggcacagtttacctgtcaaaattacatcacttcacaaattgtttaagaaacatacttctattcttctttctcttgtcctttgcactactgtcataaattt

SEQ ID NO: 168811 - DNA, 601 bp, Human
ttcagcatcctgacaagctgggcctacaagagtgaaccatctcacctagctctttaaatgttaaaactgtgtcttttcatttaaattgcatttcttttacgctcatttggtcttttttttttaatcactctaaccatctcagtttcttaattaacgtgcttagtccatttatatttttttaattaaaaaaaattgagacagggtctcgctgtgttggccaggttggtcttgaactcttggcctcaagcaatcttcacacctcagcagtccatttatatttaatgcagtcatcaatatggtyagatttaaacttaccaccttgctatttattttctatttatcccatcagttttttgttcctttttctcttcttcctaacttctcttaactgtttttaaatacatttgatttattttattaacatgttaaattatttcctcttcttttttcaatggttgctccaagggcagaggaaattcctgcaaactttttctgaaaaggcctaatagtaaacatttacacttttgaacaacatgtagttgttctctatcacaactcttcaattctgccactataatgtaaaagcagccatagacaacct

SEQ ID NO: 168812 - DNA, 601 bp, Human
actctatgtcttttgattagagactttggtccactgacattcaatgttattactgataagtaaggacttactcctgccactttgtttttttgttttctggttgttttgcggccttctcttccttctttccttcctgacttccctctagtgaagctgattttctccggtggtatgatttaatttcttgctttttattttttgtgtatctatcatatgttttttgatttgaagttaccatgaggcttgcaaatactaccttacaatccttattttaaactgatgacaacagtgattgcataawtatagaagcaaaaagaagactaataaaaactttacactttaactttgtccccctgctttttaactttgtttctattcatgccttattgtagtgtctatatcctgaagagttattttttatcagttcatcatttagtctttctactcaagatatgagtaatttatataccataatcacagatacacaatattctgtgtacttattattaccaatgagttttgtaccatcatataatttcttattgctcattcacatccttttctttctgactgaagaactctatttagcacttcttgtagg

SEQ ID NO: 168813 - DNA, 601 bp, Human
tgcctcagcctcccaaggacctgggactacaggcatgcaccaccacacctggctaatttttaaactgtttgcaaagaaaaggtcttactatagaccccaggctggtctcaaactcctgggctcaaatgatcattccacatcagcttcctaaagtgctggaattacagacatgagccaccactcctagccagtaagttgtgtttccattatcgtttgtttcaagaaattttccaattttctttttaattttttcactcacctatcggtcattcaggagcatattgtttactttccatgtgaytgtatagtttcaaagactccttttgttattgatttctagttttattcaagtgtagtcagagaagatacctgatattatttcaattttttgaatgtttgaagacttgttttacaaccaaacatatggtctattcttgagaatgatccaggtgctgaggagaaaaaaatgtgtattctgcagccattggaagaaatggtctataaatacctgttaggtccatttgttctatactgcagattaagtctgatgtttctttgttgattttctgtctggaaggtctatccattgctgaaagtgggg

SEQ ID NO: 168814 - DNA, 601 bp, Human
tgcctttatctgcttttggtatcagagtaatactggcctcctagaatgagtttgaagttttccctcctcctctattttttggaatagtttcagtacaattggtattagttatattgtaaatatttggtagaattcaacagtgaagccactgggtcccagacttttctttactggaagactttttattacagcttcaatttcattacttgttattggtctgttcaggttttgaacatcatggttcaatcttggtaggttgtatgtgtctaagaatgtatccattttctctacattttgcaayttattggcatatagttgctcaaagtacccactaatgatcctttgaatttcatctataccacttgtgatgtctcctttttcatctctgattttatttatttaggtcttttttttttcttagtctggctaaaggtttgtcaattttgtttacgatttcaaaaaacaactttttgtttctttgatcttttatactgtcttcatttctatttcatttacttctgctcttatctttattattatttcttttcttctactaatttcgggtttggtttgctcttgcaaaatgcattgttagtgcatt

SEQ ID NO: 168815 - DNA, 601 bp, Human
acgcaattttttgagcatttttatcaggaaaggattttgaattttatcaactgctttttcagcatcaattgaaattatcgtataagttttgtccttcattccattatgatgtatcacactgactgatttgcatacgttgaaccattcttgcatccctgggataaataccacttagtcatgatgaatgatctttttaatgaattgctaaattcagtttgctagtattttgttgataatttttctaccaatatgcatgagacataatggcctgtcattttctttttttgctgcctttatctgsttttggtatcagagtaatactggcctcctagaatgagtttgaagttttccctcctcctctattttttggaatagtttcagtacaattggtattagttatattgtaaatatttggtagaattcaacagtgaagccactgggtcccagacttttctttactggaagactttttattacagcttcaatttcattacttgttattggtctgttcaggttttgaacatcatggttcaatcttggtaggttgtatgtgtctaagaatgtatccattttctctacattttgcaatttattggcatat

SEQ ID NO: 168816 - DNA, 601 bp, Human
tttgacttctttgtttccaatttgggtgcactttatttctctcacttctctgattgctctagctaggacctccagtactatgttgagtaacagtgctgaaagaaggcatccttcttgtgttcccaatcttagaaaaaaggctttcaggttttgcccattcagtatgatactagctatggattcactgtacattacttttattatgttgagatacgtaccttctatacgcaattttttgagcatttttatcaggaaaggattttgaattttatcaactgctttttcagcatcaattgaaatkatcgtataagttttgtccttcattccattatgatgtatcacactgactgatttgcatacgttgaaccattcttgcatccctgggataaataccacttagtcatgatgaatgatctttttaatgaattgctaaattcagtttgctagtattttgttgataatttttctaccaatatgcatgagacataatggcctgtcattttctttttttgctgcctttatctgcttttggtatcagagtaatactggcctcctagaatgagtttgaagttttccctcctcctctattttttggaatagt

SEQ ID NO: 168817 - DNA, 601 bp, Human
tatggacattttaacaacactgattcttccgatatacgaacatagaatatctttccatttttttctgtcttcttcgatttctttcacagtgttttatacttttcattgtagagatcttttacttctttggttaattcctaggtatgtaattttatttgtggctactgcaaatgggattgcttctctttttcagactgtttgttgctggaaacaacagtagaaatgctactgatttttgtacgttgattttgtatcctgcaactttactgtatttgtttatcagttctaatagttttttggwggagtctatgggtttttccaaatataagattatatcatctgcaaacaaggatattttgacttctttgtttccaatttgggtgcactttatttctctcacttctctgattgctctagctaggacctccagtactatgttgagtaacagtgctgaaagaaggcatccttcttgtgttcccaatcttagaaaaaaggctttcaggttttgcccattcagtatgatactagctatggattcactgtacattacttttattatgttgagatacgtaccttctatacgcaattttttgagcatttt

SEQ ID NO: 168818 - DNA, 601 bp, Human
caattgcattgccttttgtaatatggacattttaacaacactgattcttccgatatacgaacatagaatatctttccatttttttctgtcttcttcgatttctttcacagtgttttatacttttcattgtagagatcttttacttctttggttaattcctaggtatgtaattttatttgtggctactgcaaatgggattgcttctctttttcagactgtttgttgctggaaacaacagtagaaatgctactgatttttgtacgttgattttgtatcctgcaactttactgtatttgtttaycagttctaatagttttttggtggagtctatgggtttttccaaatataagattatatcatctgcaaacaaggatattttgacttctttgtttccaatttgggtgcactttatttctctcacttctctgattgctctagctaggacctccagtactatgttgagtaacagtgctgaaagaaggcatccttcttgtgttcccaatcttagaaaaaaggctttcaggttttgcccattcagtatgatactagctatggattcactgtacattacttttattatgttgagatacgtaccttctat

SEQ ID NO: 168819 - DNA, 601 bp, Human
gtttttggcaccattgtaaaaaatgcactgtaggtgtatcaatttgtttctgaggtctctattctgttccatgggtctacgtgtctgttttcatgccagtaccatgttgtttggttactatagcgctacagtataatctgaagtcaggtaatatgattcctccaattttgttctttttcctcaggatagcattggttattctgagtttcttctggttccataaaacatttcaaatggctttttctatttctgtgaagaatgacaatggcattttggtagcaattgcattgccttttgtaatatggacattttaacaacactgattcttccgatatacgaacatagaatatctttccatttttttctgtcttcttcgatttctttcacagtgttttatacttttcattgtagagatcttttacttctttggttaattcctaggtatgtaattttatttgtggctactgcaaatgggattgcttctctttttcagactgtttgttgctggaaacaacagtagaaatgctactgatttttgtacgttgattttgtatcctgcaactttactgtatttgtttatcagttctaatagttttttggt

SEQ ID NO: 168820 - DNA, 601 bp, Human
aaatattttctcccattctatgggttgtctccccactttgttaatcgtatcctttgctgagccgcagcttttaacttgatgtgatcccatttgtccatttttgctttggttgcctgtgcttatggggttttactcaagaaatttttgtccacatgaaagtggggagtttcttcaacgttttcttgcagcagtctcacagtggagcacttaaatttaagtcttaattcattttgatttgatttttgtatacggtgagaaatagaggtctagtttcattcctctgcatacggatatccagttktcccagcaccatttattgaagagattgtctttaccccaatggatgtttttggcaccattgtaaaaaatgcactgtaggtgtatcaatttgtttctgaggtctctattctgttccatgggtctacgtgtctgttttcatgccagtaccatgttgtttggttactatagcgctacagtataatctgaagtcaggtaatatgattcctccaattttgttctttttcctcaggatagcattggttattctgagtttcttctggttccataaaacatttcaaatggctttttctatttctgtgaa

SEQ ID NO: 168821 - DNA, 601 bp, Human
ggggaactgtccccaaagcctaccttgaatactgttccactcaggattttgatttagatggtctccaggtctcagtttacacagtttgtaaatgactcaaacattgagaagtatttcaaatccatgttatttgtgaaatgcagtttatatttacaatcatgttattccacacaaaaaggaatttatcttagctaatggtgaagttttatgtgtgaaagattttctactccagaccaaaggaaaaaaaactggatgctttaatgtgaaaattctatttaaagaaaggttttaaataagaaawcagtctgaaatatgaaaaagtgttccaagcagaaaaaaataacataaaggtgttcaagtttattatatcaagtagttcagctctcccatatcttcactgggttttattttttgtacaactgttctcttatttatcatatgatttttctattattccttccggttttgtcaacttttgccttacatattctgaagttataatattacggacatacaaattaaaggctgctataacataatggagaactaaactttttatcattatgacatatctattttagtaatgctttttttttgcctt

SEQ ID NO: 168822 - DNA, 601 bp, Human
ccaagatggtctcgatctcctgacctcgtgatccgcccgcctcggcctcccaaagtgctaggattacagagccaccacccccgccaagtatttcttttgagagtctcactctgttacccaggctggagtgcagtggcatgatcacagctcaatgcagccttaaactcctgggctcaaacaatcctcccgcctaagcttcccaagtagctgggggactacaagcatgtatcaccatgcctggctaattttttaatttttttgtagagacggaggtcttcctatgttgcccaggctggtcatragctcctggtctcaagtaatcctcctgtctcagcttcccgaagtactgggattacaggcaggagccactgtgcctggcctcaattaagtatttcttcaaagaattaccactgctattgaatccagtcaaacatttgtgaacacctaaaaggatcatcttaagtatttttgatggcacagtaatatagaacccaaattgaattttaagtcacaatttcttcttccttgacatttccttctcccttaataattccatgtgaacatacacaaaatgaaaaatttgtattatatgccaaacaca

SEQ ID NO: 168823 - DNA, 601 bp, Human
taaaagattaagcccaatattctttatatgctcccctaaatatcaacattacacagcctctacttaactatccagcttttctcattccacattacttcacaaagagaccctacattagccaactctagctgtctgtggtacagctatataagctttctttccaatcctccacacacagtctatctcctgccagtctttgcacatgctgacactacctcttctgatcttgttaatggcttccttctttccttagacttcgagaaggtcaattcatccattataccactccatagaatcatayaccaatgtctcttacatagtgcaaccttacatttatttgtgggattatttaatttctgtccacatcccacttcacccactagaatgtaagttctggaaagaagaaattatctctgtttgatcctcactgtaatgctatcacctaacacaggcttggcagcaaagagtagacactaagtattttttttttttttttttttttttttttttgagacagagtctcactctgttgcccaggatggagtgcagtggcacgatcttggctcccagcaagctccgcctcccgggttcacgccattct

SEQ ID NO: 168824 - DNA, 601 bp, Human
aatatgtattcatttaaatctaaagcaagttgtataatagcttatactactttgatatcttctctacctcacatctaatacccatctaccatccagttctgtcaaatttatctcctaaatacctaaggtatctacccattatctctggctccaccactctagcccaagctaccattacttgttacctagagtactgcagtaagatcagtttaatcaaccaatagccactaatggccttacatctcttctccatattgcaatgttttcaaaacgcaaatttgaatatgtcatccacctcaakaatgtatttcaatgacttcctattgctctaaaagattaagcccaatattctttatatgctcccctaaatatcaacattacacagcctctacttaactatccagcttttctcattccacattacttcacaaagagaccctacattagccaactctagctgtctgtggtacagctatataagctttctttccaatcctccacacacagtctatctcctgccagtctttgcacatgctgacactacctcttctgatcttgttaatggcttccttctttccttagacttcgagaaggtcaattc

SEQ ID NO: 168825 - DNA, 601 bp, Human
aactgaaaacacatactttttcccaaaaagagaatacactaacttaaatttttaaaggaaagaataggcattataaaacaatatgggaactactaaaatagcgcataatcataaatacctgggcaatcacagcttctcgtgttccgtaatatttaaagaacaaatgatcagtctgaatataaagctgacaagtatttttttcagctgaagttgtacgttttttcctcagaagttctggaccattagcagcatgttcttcttgaggtatctatacatcaaaaagtcatttctgacaattagyatgcttcaatactatcattttatctaattaagaatacatactataaacaatttcatattctgctttatataacaccataggtatttctgctgccattaaaagttcataaaatcactttgtctcataatcttctccatatagattatttactatctattcaaggaactccttcacttttaaacattttcaaaacatgtattttaatatgtattcatttaaatctaaagcaagttgtataatagcttatactactttgatatcttctctacctcacatctaatacccatctaccatccagtt

SEQ ID NO: 168826 - DNA, 601 bp, Human
agaggtttcagagtatgaaagtttcgaacatgaaaaatcataggaaagagtgagctgtacaatctgctgactaatccaagtaacaaaaaagtacagattatcataaaagacaaatatccaaaagtactgcactattaatatgcagcccatgacataaacttatactttaaaatgacatcatgaaattgagtacattttaaaacatagaagaaaaacaaaagaagctatggaaattgtaaaagtattgacttaagatactgacttttaaaaaaggagaaagaaatacaaaggaaaatacagyactacttaagatcttaaaatatacaaaacaaatcaaagaataaactaataagaataggaatacaaaagcttctcttactctggataaagcagaagttttttttaaaaaaaaaaacatagaaatgaagtatcagaaggagaatctgttgtatatagctcagaagataatatactattgattaaactctacttggcacaatttatattcaaagagcctggggtcctttccactcatctttcaattaataaatttggatttctaaactaggcaactgaacttatacagtaaatcacagctcct

SEQ ID NO: 168827 - DNA, 601 bp, Human
ttttgctcatgaagtacacaggaagtatcttgtttcacctttaagaagaccctaataatgaaaatagaggcgggcggatcacgaggtcaggagattgagaccatcctggctaacacggtgaaaccccatctccactaaaaatataaaaaattagccacgcatggtggcgggcgcctgtagacccagctactcgggaggctgaggcaggagaatggcgtgaacccgggaggtggaggttgcagtgagcggagatcgcgccactgcactccagcctgggtgacagagcaacactctgtctcaaaaaaaaaaaaaaaaaaaaagaaaatacaagtaacatgccccaccattttcaatccagaactctccccacctcaggaaaatgagcagcatcacaaatggtgatccaaatatcacaaacaatgagacataaacactgagtgtcccaaaaacccataactacagtttaatcataaggaaaacatcagacagattccaaataggggagcattctaaaatatacctcatcagtactcctcaaaactgtcaggggagggaggaaggagatttgagaatacctaatctgttcaattttttgtaaatc

SEQ ID NO: 168828 - DNA, 601 bp, Human
tgaatctggagtcaaaaggtccagattccagatcctgttccacctctagctgtgtggtattaggttggtcacaaagtttctgaacacaagtttcctcatctgtagaagggagacaataatacctacacctcataagggtattgaaataatcaagaataaatatataacattccttgttttaaaaaaaaaaatgtcaaatatgaaactcagttcagctagtagtaagtgcaaagacaagtgaagaagctggcagtgttatttcaaggcaggtaacctacactcgaaaaagttggaccaaagraacaaagatcccttttctttcccactatggcctctattcttctgtgcctgcctagcccctccccagcagctcttagaagatggcttccaagagctgaagttgggggtttaacatagagtaatggaagcggacatctaatgtctgaaagaaagagagataataatataaaaggaaaaaaagcagagggggggaaaatggggatacaaagttgacaacgggagtcttcgttttctattctggttgccaatcaccatatttttgctcatgaagtacacaggaagtatcttgtttcacctttaa

SEQ ID NO: 168829 - DNA, 601 bp, Human
agagcactactcacatgcaatgggtagggatcaaagatgttaaatatccaagggatccagacaagcattaaatgccaatagcaagtgtcctattgcaatatttcaatgatgtaattttcccagcatttgaagttatacttttaaactatgggttaagaattcaataagctgtgggttatcccgagaaccctgtgttaagttctgtacgctctcaaattttaatatgtaatatcaaactaaaacatctaatctaaagaaaacagaagagactatttctaccaaatgaaatgcctcaaaagawgttcttcacaaatagaggagtactgaaggtttcaggactaactgtagagatgaattccaaagccagcctcattcaacgaccaagccgaactgagactatgttcattcagttaactgataagacctataggtagaaacatgaagactcaaaagaagggcaaagacagaactacaatgaaaaaacagccagaagcaaaatgattttcctgaatttacagacagaaaacacacaagaatcctgtctcccagctctcagtccattgctcttcccattatgccatgacaattacccaaaattata

SEQ ID NO: 168830 - DNA, 601 bp, Human
aaaaattaatagtagcatgctgatcatacaatattaatgtaagcaataattctggaccagaccatagtaatactcccacaagtgataccaggaaatgtgagagcacaggcatttggctttcaagtctggagagcactactcacatgcaatgggtagggatcaaagatgttaaatatccaagggatccagacaagcattaaatgccaatagcaagtgtcctattgcaatatttcaatgatgtaattttcccagcatttgaagttatacttttaaactatgggttaagaattcaataagctgygggttatcccgagaaccctgtgttaagttctgtacgctctcaaattttaatatgtaatatcaaactaaaacatctaatctaaagaaaacagaagagactatttctaccaaatgaaatgcctcaaaagatgttcttcacaaatagaggagtactgaaggtttcaggactaactgtagagatgaattccaaagccagcctcattcaacgaccaagccgaactgagactatgttcattcagttaactgataagacctataggtagaaacatgaagactcaaaagaagggcaaagacagaacta

SEQ ID NO: 168831 - DNA, 601 bp, Human
catagttttaaacaaatagtaaattaatatcctgccttagtgaagatttgtcatgtgcaaattggtccaatgcagtactgtcaaacttgaattaagcatagaagactccacacttcaaatctttatcagttaaaaaaaaaaaaagtaaataggcatatttttaaatctctgataatatacatttttctgcacttttagggtctggctaatttaagagaagagtatacataaattagaatatactattctgaaatatagtaatttatatattgcctaacttcttaaacaactgcttttggtytttatgattatcgcttatatgaaagtttaaaatggccgggcgcagtggctcacgtctgtaatcccaacactttgggtggcggcggcaggcggatcacctgagatcaggagttggagaccagcataaccaacatgttgaaacctcatctttactaaaattacaaaaattagccaggcgaggtggtgcatgcatgtaatcccagctactcaggaggctgaggcaggggaatcatttgaacccaggaggcgggggttgccatgagcagagatcatgccactgcactccagcctgagcaacaga

SEQ ID NO: 168832 - DNA, 601 bp, Human
actgacaactgagtagagagaaaataccaaataatttgtgagaatttaatatattttcttcaagctagttctacttttggagctcagtcctgagaagcacatcattatttctggaaaccagaaaatatataaataagtattctgtatataataattattgtacacacagcatagttttaaacaaatagtaaattaatatcctgccttagtgaagatttgtcatgtgcaaattggtccaatgcagtactgtcaaacttgaattaagcatagaagactccacacttcaaatctttatcagttaaaaaaaaaaaaagtaaataggcatatttttaaatctctgataatatacatttttctgcacttttagggtctggctaatttaagagaagagtatacataaattagaatatactattctgaaatatagtaatttatatattgcctaacttcttaaacaactgcttttggtctttatgattatcgcttatatgaaagtttaaaatggccgggcgcagtggctcacgtctgtaatcccaacactttgggtggcggcggcaggcggatcacctgagatcaggagttggagaccagcataaccaac

SEQ ID NO: 168833 - DNA, 601 bp, Human
ctgtacaacagaaaccaaacactgcccctgaagcctaaaatgtttactagtaggccctttacagaaaatgtttgctgatccctgttctgaatcatgggcgtataacgctttgttgcactatttgttctacttttgtgtatgttagaattttttcctaataaaagattttaaaatatcaatctcattccacggtagagaaaatactttaaattatcaatctcattccacagtagagaaaagattttaaaatatcaatctcattccctaaaaatgctttaacagaaacaaaacaaaaaaagartttctcacaatttgctgaacattcaaaatgtacttttaaacaatgaataatgattctcattcaaaagatatttgagtacattatgtactaggcattgttctagggccaggagatatagatattttgtctgaataagccagatgaaatcccttgccttcacagaattctagcactgttatgcttacttttcttactttaaccacaaacattctatcttcctccctttcagtatggtcaaatacattactgtgctctgacataaaaactaaacactcgtaagtacatttgttttcacggtga

SEQ ID NO: 168834 - DNA, 601 bp, Human
ataggtgcacaataaatatttcagataggataaatacatttaagaaataatgtgaaccactcagaaaaagtaacattgacattactacaaacgtataagagagaaagagatttcagataaagatgttaagggagacaggttcaggtgtttatgattctggctgatcttactattaaattactcaacaaatatttattaagcattgtataatttggatgtctgtccccccaaatttgatcccaaagttgttagtgggcctaacaagagaggtctgggtcatgggggcagatccctcatcaayagattaatgctcttcctgaagggttggaggtgggtgggtgagtgcattctcactctcttagttcctgcaagagctggctgttaagagcctagtactctcctctctccttgaccccacgctcccaccacctccactcccaccatgtgatctctgcacatgccagcacctgttgccctccatcataagtggaagcagcctgaggcccttaccagaagctgagtagatgccagcaccatgctttttgtacagcctacagaatcatgagccaaataaacctcttttctttataaattacccacc

SEQ ID NO: 168835 - DNA, 601 bp, Human
aactcctgggctcaagcaatctgcccacctcggcctcccaaagtgctgggattacaggtgtgagtcaccacagctaccctccatgtgtacagttatacacacctttctttcagcttaacagtataaaatgagcactgcaaaacttggtatttaaatgactgcagagcattccgtggtattttcatactgtagggccatctacgctgcttaaaactttttggtattataaataaaactatgatggtcatattttcttaatttttattaagggccatattcatttacatcatataacaacacrgatcaagatttcaacaggcagacatgggaaggaactgacttcctagcggaggaaagttttaaaggtctgtgaattaatttgacagatgaggagagataacactagaaatatacttaaaccccaaattatcaaacaccccaaacattaagataaggaaattgtatcagcaatattagaaagtagtagaagtgagttagtaagcagaagtggcattattagaactgtatttacatgaaggtgaatctggtgagagtaggtacatattagaattttcaccctgagagacaggaactttgtctc

SEQ ID NO: 168836 - DNA, 601 bp, Human
agctgggactacaggtgcagtccagcacacccagctaattgtttttgtgtgtatttttggtagagacggggtttcgccatgttgcccaggctggtctcgaactcctgggctcaagcaatctgcccacctcggcctcccaaagtgctgggattacaggtgtgagtcaccacagctaccctccatgtgtacagttatacacacctttctttcagcttaacagtataaaatgagcactgcaaaacttggtatttaaatgactgcagagcattccgtggtattttcatactgtagggccatctasgctgcttaaaactttttggtattataaataaaactatgatggtcatattttcttaatttttattaagggccatattcatttacatcatataacaacacggatcaagatttcaacaggcagacatgggaaggaactgacttcctagcggaggaaagttttaaaggtctgtgaattaatttgacagatgaggagagataacactagaaatatacttaaaccccaaattatcaaacaccccaaacattaagataaggaaattgtatcagcaatattagaaagtagtagaagtgagttagtaag

SEQ ID NO: 168837 - DNA, 601 bp, Human
acaattcagaacacatcagaaggggcaaaaaacactggacactagagtaattgtgctatttaattaaaatcttgttttaaatacccaacaaccccactctcaagaaagaaaaagactgcccaaggacgttctgttttttcctagagcccaactaagttactttcattttctattccctcttctgaggcaactgttaaattaaaaaatgtgtcctctactatcacctttattcttcctgatacctcttgcctttcttctgaatctagatgcagcatttagcaactctatactattcaccaayattatcttgctttatgttttcaacctataaaattcaactcagtttctgaaaaaggtgtagcactagaattattctcagcattagagttttagaaaggaaagaaaaaaatcccaattctgtataactcttgatgtcatcacagaatatcttgccacttttcaattcagtaaatattaatgaatgtccagtgctataaaaggaggcactaaaatataaaaatataaagatgagaaaagtattatccctagccttcaaggcacttaccttctatttttaaatgatagcaaatcttgacataac

SEQ ID NO: 168838 - DNA, 601 bp, Human
cactctgttccagaatcatgctgtcaaaaagaatataaagttacataaacaggaagtaaaataaggttttcaggtcaactgattaaacgtaatgttctcatcaggaaaacaatggaagcttgtggactctcctttaaaaaggatcttacaattgttttacaccttgagtaggaaaagaatttgctcttttaggggtcactgtcttagaaaagaaggaaaatcagtggaggtctagccataacaatttatagctttgtaagcagggactagaattgaggacagactgtcataaaagtctatyaaaaataagctcacatacttttaaaactagtaacagtaaaataaactactttaaaactactaaatagtctctaacacatatgttaaattacatgttatgaatagttcagagaagacagaggtggggaaagacaaaagaatcaagagactgacatggggctaaatacacacagaacaggaatctaagacagctaacttaatagccaatatataggaaaggtaagtaaaaatgctgactaggaacagaaacacaatgatatatttttaaatgaaaaatggtaaaagcctagagataaaacca

SEQ ID NO: 168839 - DNA, 601 bp, Human
gttaagtttgtccccagatgttgctcttgcatacatgatgtaattgccattttctttttgacccaaattcttagattctcctggtgtgcactctgttccagaatcatgctgtcaaaaagaatataaagttacataaacaggaagtaaaataaggttttcaggtcaactgattaaacgtaatgttctcatcaggaaaacaatggaagcttgtggactctcctttaaaaaggatcttacaattgttttacaccttgagtaggaaaagaatttgctcttttaggggtcactgtcttagaaaagraggaaaatcagtggaggtctagccataacaatttatagctttgtaagcagggactagaattgaggacagactgtcataaaagtctatcaaaaataagctcacatacttttaaaactagtaacagtaaaataaactactttaaaactactaaatagtctctaacacatatgttaaattacatgttatgaatagttcagagaagacagaggtggggaaagacaaaagaatcaagagactgacatggggctaaatacacacagaacaggaatctaagacagctaacttaatagccaatatata

SEQ ID NO: 168840 - DNA, 601 bp, Human
caaattctttagatcatcataacaaagggataaaggaaaactttgatgaataagtagaacaaactaggaatctggaaattacgagacctaattctaacagggggtctgctactaactagcaatgcaatcttggggtcttcagtttctcaatctgtacagtgagaggatttgacagagggtcccttctagaagctgtaacttgcaacttaggccatgctacattgagctttattgactgttctattcatatcacacaaatacaaaccaagttagtgcttcactaaccaggaaaaaaaaaaaytaagcctttttttgcaacagaaaatttcaaacacacctaaaagtaataaaagaatatgtacaatgaattcccatgtaccaatcactcatctttaacaactatcaacaacaatatgctgttcttgtctcacttactcccacaatttttttctggagtattttaaaacaaccccacctaacatattattgtccctgtaaatacttcagaatgtatcactatgacataaagtttttttcttatttaaacctaaccataataaccatgatcatatctaacaaaattaatagcatgcttaataac

SEQ ID NO: 168841 - DNA, 601 bp, Human
gaagaaattaaaaatgaagtttaaaagctctctgaaacaactgaaaatagaaaaacacaacataccaaatactatgggatacagctaaagcaatattaagacggaagtttatagcaataaatgtctacatagaaaaagtagaaagataaacaacctaacaatgcacctcaacgaatcaggaaaaagcaagaacgaaccaaaccccaaattagtagaagaaaagaaataatgaagatcagagcagaaataaacaaaattgagactaaaaaaatacaaagaatcaggccaggcacggtggctyatgtctataatcccagcactttgggaggccgaggcggacagatcacaaggtcaagagattgagaccatcctggctaacacggtgaaaccccgtctctactaaaaacacaaaaaaattagccaggcgtggtggcaggtacctgtagtcccagctattccggaggctgaggcaggagaatggcgtgaatccaggagacggagcttgcagtgagccgagattgcaccactgcactccagcctggggaaaaaagtgagactccgtctcaaaaaataaaaaaataaaaaaataaaataaaaatat

SEQ ID NO: 168842 - DNA, 601 bp, Human
tttagaaactgtacaaacacataaaaattaaacaacttgcttctgaacaaccaatgagtcaatgaagaaattaaaaatgaagtttaaaagctctctgaaacaactgaaaatagaaaaacacaacataccaaatactatgggatacagctaaagcaatattaagacggaagtttatagcaataaatgtctacatagaaaaagtagaaagataaacaacctaacaatgcacctcaacgaatcaggaaaaagcaagaacgaaccaaaccccaaattagtagaagaaaagaaataatgaagatcrgagcagaaataaacaaaattgagactaaaaaaatacaaagaatcaggccaggcacggtggcttatgtctataatcccagcactttgggaggccgaggcggacagatcacaaggtcaagagattgagaccatcctggctaacacggtgaaaccccgtctctactaaaaacacaaaaaaattagccaggcgtggtggcaggtacctgtagtcccagctattccggaggctgaggcaggagaatggcgtgaatccaggagacggagcttgcagtgagccgagattgcaccactgcactccagc

SEQ ID NO: 168843 - DNA, 601 bp, Human
tccccctacttaaaaagacacaacctggctgaatgggcctattttaatctcttctccctctgtagcttttaaattacttatgtattcatttatttgtagaaatgggatctcactatgttgcctaggttggtcttgcactcctgctcaagcaaaactcccggctcggcctcccaaaacacatgacacatccacctatatgctgcttacaagaaaatcattttacctctaaagacatatatagactaaaagtaaaggaacagaagaagatatttcactcaaccagaaacaaagtaagcaagastagctatacctgtatcagataaaacagattttaagtcaaaaactgtgaaaagagggccaggcacagtggctcattttgtaatgccagcactttgggaggccgaggcgggcagatcacctgaggtcaggagttcaagaccagcctgaccaacatggcaaaaccccgtctctattaaaaatacaaaaattagttgggcatggtggtacatgcctgtagtcccagctactagggaggctgaggcaggagaatcgcttgaacccgggaggcgcaggttgcagtgagccgagatcatgccactgc

SEQ ID NO: 168844 - DNA, 601 bp, Human
tgaaacatgaaaaaacaaatatatatgacaccaccaaaggaacataattaactctctagcaacaggtcccaaagaaaaggaaatcaataaattgcctaaaaaggaattcaaaataatgatttgagggaaaagacacaagaaaatatagataaaaaattcaatgaaactaggaaaacaattcatatgaatgagaaattcaaaaaagtaataaatatcattaaagagaaacaaaaatcctgtggcttaagaattcagtgaataaaataaaaatatataatagacagcttcaacagcagacttsatcaagcaaaagaaaatctctgaacttcaagatagaatgtttgaaattactcatttaggggaaggaaaaaaaaaggaagaaagtctataagacttatgggacaccaccaagtgaataaattttcatattataagagctgcagaaggttgggtgcagtaactcatgcctgtaatgccagaactttgggaggctgaggtgggaggatcacttgagcccaggagttcaagatcaacctaggcaatgtagtgaaagcccatctctgcaaccaatcaatcaatcacttaaaagctacagaaggag

SEQ ID NO: 168845 - DNA, 601 bp, Human
agaagcaccacacccttcccgaccagcacactaagacctagctacaggtgagagtatatctccatgaaagtcactctagaaaatttagatgagacgactgttccaccagacaggcacacagacatgaacacagggactcatgaaacatgaaaaaacaaatatatatgacaccaccaaaggaacataattaactctctagcaacaggtcccaaagaaaaggaaatcaataaattgcctaaaaaggaattcaaaataatgatttgagggaaaagacacaagaaaatatagataaaaaattcartgaaactaggaaaacaattcatatgaatgagaaattcaaaaaagtaataaatatcattaaagagaaacaaaaatcctgtggcttaagaattcagtgaataaaataaaaatatataatagacagcttcaacagcagacttgatcaagcaaaagaaaatctctgaacttcaagatagaatgtttgaaattactcatttaggggaaggaaaaaaaaaggaagaaagtctataagacttatgggacaccaccaagtgaataaattttcatattataagagctgcagaaggttgggtgcagtaac

SEQ ID NO: 168846 - DNA, 601 bp, Human
agttgtgcaaatacaaagagggaaaaaaaactgaaatcattaccataacatgttatacagaccttctctagttaggctgggtaacgccatcagtaattcatattaaatgttacaatgtaaacaagcaaccagcaagtcttgactcagtgtccacgatgacttaaagtctaacagtgtttatgtaaattactgctgtaaagctggcaacgttttgtctagtttatcatttttaaaacattgtagagaccataataatagagacacaatgctacgttacatttataatctcctcaagaggacrgatttagctggaaattatctggccaaactgtaggtcaaagttttacacttaaaatttaggagaaaataatagtttgaggcaaattttatactcttgtgtttttaaaagccttacttttcttcatacagcatacatggcataattctttatcatctttgccatcagaactggcacacgtacactcctctaagccatatttctcacagatagaacctgcacattgctagaagaaaaataaaagacaaattgtttaatccctatacagtcaaacctattttttatagtaacagacaggcaagt

SEQ ID NO: 168847 - DNA, 601 bp, Human
ttctttgtaaataaaaaacatacttaccacaatccattcagcaatgttttcatagagctctggactaaaaattgcttttttaagcctagctagaggaccatcagcatctactaatctgcaccgcatgaaaacatcacagtaacctctaaaatcgttgcaaggggatccaggttgcagggtgatggttcgaccactgaagtgcctactccactgcacagaccctgtactggcacaagttgatgggtccactggaaaagaaatgccaaatataagctgaaggtcagattcaaatataagttgmagatcagatttccagttgtgcaaatacaaagagggaaaaaaaactgaaatcattaccataacatgttatacagaccttctctagttaggctgggtaacgccatcagtaattcatattaaatgttacaatgtaaacaagcaaccagcaagtcttgactcagtgtccacgatgacttaaagtctaacagtgtttatgtaaattactgctgtaaagctggcaacgttttgtctagtttatcatttttaaaacattgtagagaccataataatagagacacaatgctacgttacatttataatc

SEQ ID NO: 168848 - DNA, 601 bp, Human
caatatatactcagtagaatgtaattctgagatctcctttcgttttctgtatacactgtcttctacagcagacaagtataccaaatttcaacttttcttattagagacaatcagaaaaaaaaatagctgagttgaaaataaagaagggccaagaaaggtaagctgcttgaagtcacagaattgataaacaccagaaagattatttgaatccttacgtgattctcaaacatgtgctctttccactgcaccatggtaccagaagacaacttcagtttgacaggtatttactagaacttaccaygcaacaagcacaggaatttaaaaaaagagtaacatgttttaaggaaacctaagttaagtcaactgctcaagtatttggtttgaaacctaggtagatctcctaaatccaatttcaacaatccttctactccatgatcattacatatctaaaaaccacatatcctaatgtgtcctaggaacggtaaacatcattttaaatgctggggttaactataaaatttttactctagaatgttattagaagagtacaaaaaaggctgacatcccacacaaacaacatcttttgtgctttaaggcatcc

SEQ ID NO: 168849 - DNA, 601 bp, Human
caggattgagaactactgctattaatcaatatttttccaaatgacatctaaggatatttaggacttagtcttttcatcataaaagtttctagggttaggtaagtttggaaaatgaagtttaaacgatttatttattgcaggtcttctcacaaatctccaagaaaggtctatagtatggagtagttttccagattcatttgaccattgaaggcccagaacatctaatggaactagtgttctgttaagcatttgggaaacagtgctctaaatctttcattcataaagaataccagatacttamtacttagatgcataaaattatagcaaaatatgacagcagaaactaattttaaaatgagaatgtgtttgactcttgataaattagcaatacaaaaatacaaactcctgataaatctgaacaagttaaaaagaaaaaagccacaaaatcatcaggcaatgatttttaaaaggaggggaaacacaacaatacatttgaacaataaaagtcaaggtaagaggtagttttctacaatgtcaaacctaacatgaaagatacagaaaatcagaacacatcaactatagaagaaactggaaatgaatt

SEQ ID NO: 168850 - DNA, 601 bp, Human
ccctataggggcagaaagtttcctttcaatttttcagaagacataatactatagtctgggctttgaatatatactcctcctatccttcaaactcccaccaccactagcagcagcagcaacagcgatctgccaagcagaaagcaacttgctactaaacttttggttactttaagctcaacctgggcaagtaagataaaataccactaacaggaacctgaaaacattccagtttcaaagttaatatgcacaagttttactcttttccatataaattattacatttgagaaatctgcttcattyatctagcaaatgtatactgtgtcctcactatatgctgaaaaccttacaatatcattatatctttgttgttaaagtttcattaagtgctatgctatgtggtctgttccacaaagcaatgaaaccaccttctattttcaacatatcaagatgataaaatggaaaatttctgttacaagtctttttaaaaaggagtcacatatcacagagactgaaaaaaatggcagacaaactattagcacgcaccatcacctactgactcagtgggtctggaatggaacgtaagaatttgcatttctatga

SEQ ID NO: 168851 - DNA, 601 bp, Human
ccatgatactgattatgtcatccctataggggcagaaagtttcctttcaatttttcagaagacataatactatagtctgggctttgaatatatactcctcctatccttcaaactcccaccaccactagcagcagcagcaacagcgatctgccaagcagaaagcaacttgctactaaacttttggttactttaagctcaacctgggcaagtaagataaaataccactaacaggaacctgaaaacattccagtttcaaagttaatatgcacaagttttactcttttccatataaattattacwtttgagaaatctgcttcattcatctagcaaatgtatactgtgtcctcactatatgctgaaaaccttacaatatcattatatctttgttgttaaagtttcattaagtgctatgctatgtggtctgttccacaaagcaatgaaaccaccttctattttcaacatatcaagatgataaaatggaaaatttctgttacaagtctttttaaaaaggagtcacatatcacagagactgaaaaaaatggcagacaaactattagcacgcaccatcacctactgactcagtgggtctggaatggaacg

SEQ ID NO: 168852 - DNA, 601 bp, Human
tcgcagtttagatcaacagatgtataataaaatatggcactcaagcccttcagaacttccagttccttctagcacagtgttcctggctttcttctaaattttttcaggtaactatgtatctcacaagcccaatgcttgagatgttttagtgccaatgatagtagcttttgtgaatttagcgtgtggggaaatggaacatggcaatagacaaaagacagtaagaaaaactaaacaaaataaatagtgcatctgaaaatattagtaagtacggccacctttatagttttcctttttaaaaaaagaatgagttaaatgctaaattacatgctatcccctttaaatatactataaaatcagggaaaggaatactaactagggtagtaaatgtaaaatatgcatttctctcaaaagaaaagatcacaaattgcccacctgttagtctgaaagaaaggggagctgtcattcattcaatgaacatttactgagcgtaaactgagtgccagggtcttataccccagagacaagggtgttaagcaaaactttagggacaaagagaagacatccaaccatttttcaaaaactcaagaagtttctcaactca

SEQ ID NO: 168853 - DNA, 601 bp, Human
atggccatcagtgttatggctacctaaaatatggaactgaccatgttactccttcatgtcaaacccttcttcgaatgcttcccaccaaagatttccaagatagaccactatgtaggagagaggaaaaaaagcaaaagcaaaaacttgagcacacgataaagtacagcaaagtgtatatgattccacctttttaaaaagtaaatatccttacagtggtatagacagtttcgaagaatacacaagaaatccatcctagaaagattgggggtccagggttaaaaaaaaaaaaaaaaaaaaaaaaggcctactttagaatgtattactttgtcaactaaaaaaagaataatcaaacttttcaaaagaaaaaaagtagaaaaaaatgttttgcaaaattcatacttctgtgactttttcacatgctctgtccccataaaatatttctgtactctctacttctactaattcttaagaacttagcttggccgggcacggtggctcatgtctgtaatcctagcactgtgggaagccggggcgggtggatcacctgaggtcaggtgttcaagaccagcctggccaacatggtgaaaccccatctgtgcta

SEQ ID NO: 168854 - DNA, 601 bp, Human
ctaatgtgagccaatccatgagtacaaaggcttaagagttttcctactagctttctcacgatgatgggcaagttgggtacaggagacacacttctcttcctaaagtcattatcatcttcaatatatttccttccttcatctttactttcatttttatgaaaatatggccatcagtgttatggctacctaaaatatggaactgaccatgttactccttcatgtcaaacccttcttcgaatgcttcccaccaaagatttccaagatagaccactatgtaggagagaggaaaaaaagcaaaagsaaaaacttgagcacacgataaagtacagcaaagtgtatatgattccacctttttaaaaagtaaatatccttacagtggtatagacagtttcgaagaatacacaagaaatccatcctagaaagattgggggtccagggttaaaaaaaaaaaaaaaaaaaaaaaaggcctactttagaatgtattactttgtcaactaaaaaaagaataatcaaacttttcaaaagaaaaaaagtagaaaaaaatgttttgcaaaattcatacttctgtgactttttcacatgctctgtccccataaaatat

SEQ ID NO: 168855 - DNA, 601 bp, Human
cacaaaacatgctgacagggctgaatctggcttggaatttaaaactttacaatctactttctaaaagccacttcttgagactgccagatttttttttaagttttattttgttttctataaaaattgtgttcagagctctgctctccttgttagtctttaggatgatgttcccattcctttattatataggtattccatagactcctattgttttttgtttttattcatcctcaaataacagacctgctacttatcgcaagacagggtagaaggccaccctcagtctgtcaaagcagtacaygaccattttgagtaatgcagaaagtttagcatccctggcccccaaccatcaaatgccagtagagccccttcagttactctgacaacaaccgtacatttccaaacacctgctggggaagtggtaacacctctaatgtgagccaatccatgagtacaaaggcttaagagttttcctactagctttctcacgatgatgggcaagttgggtacaggagacacacttctcttcctaaagtcattatcatcttcaatatatttccttccttcatctttactttcatttttatgaaaatatggccat

SEQ ID NO: 168856 - DNA, 601 bp, Human
tacacaaaacatgctgacagggctgaatctggcttggaatttaaaactttacaatctactttctaaaagccacttcttgagactgccagatttttttttaagttttattttgttttctataaaaattgtgttcagagctctgctctccttgttagtctttaggatgatgttcccattcctttattatataggtattccatagactcctattgttttttgtttttattcatcctcaaataacagacctgctacttatcgcaagacagggtagaaggccaccctcagtctgtcaaagcagtayacgaccattttgagtaatgcagaaagtttagcatccctggcccccaaccatcaaatgccagtagagccccttcagttactctgacaacaaccgtacatttccaaacacctgctggggaagtggtaacacctctaatgtgagccaatccatgagtacaaaggcttaagagttttcctactagctttctcacgatgatgggcaagttgggtacaggagacacacttctcttcctaaagtcattatcatcttcaatatatttccttccttcatctttactttcatttttatgaaaatatggcc

SEQ ID NO: 168857 - DNA, 601 bp, Human
ctggtgtttctttgtgatcaaattcaggtcacacatctttggtaagaatatcacagatgctgtgttctcgctgcatcctatcaagtaacacgtgatttttatttcattactgctgatgttaacttgatcactggattaaggtgttatctgccaaattttaccatgattcttgtttctcttttgtagacaatgaaaattttgtagggacctaatttggaagtatgtaaatatcctgttcttcatcaaactttcaatgtattcatttatttattccctcatggtttcctattttttataaatmtataatcaattactgacattattgtgttttttggacatgtcctcatcattctttgagcactttcttactttctggcccaacaagaagttccagatttatcctgttctttccctaccccagccttggaacctgccaaagagccctggtttcttttagtcctacccttcctatgtagacaccttcctcatcctacttgcactcttgacatcccatgccagtcactcctccacaggggtgcaattctcaccctgcttgggctctgaaaccccatactggtagtgttccccatcccacaccttc

SEQ ID NO: 168858 - DNA, 601 bp, Human
acagggcagttattttgcatgggaatgtccttcaatttgggttcctctggtgtttctttgtgatcaaattcaggtcacacatctttggtaagaatatcacagatgctgtgttctcgctgcatcctatcaagtaacacgtgatttttatttcattactgctgatgttaacttgatcactggattaaggtgttatctgccaaattttaccatgattcttgtttctcttttgtagacaatgaaaattttgtagggacctaatttggaagtatgtaaatatcctgttcttcatcaaactttcaaygtattcatttatttattccctcatggtttcctattttttataaatatataatcaattactgacattattgtgttttttggacatgtcctcatcattctttgagcactttcttactttctggcccaacaagaagttccagatttatcctgttctttccctaccccagccttggaacctgccaaagagccctggtttcttttagtcctacccttcctatgtagacaccttcctcatcctacttgcactcttgacatcccatgccagtcactcctccacaggggtgcaattctcaccctgctt

SEQ ID NO: 168859 - DNA, 601 bp, Human
cctgtagagaatagctacgaataccttggagaaggggagggataaacagagggaactaaacaatacgaagggtttatttcctgtccttttctccttccaatgcccacagctcatctaaagagggttcttcctcatgctatgtctccctgagaggtaaaaggtggagaccagaactaaagagttgttttcaggaatggagaatacttgactgtgcttatttgatgaatgaatcctctactctaagactttcccacagactgggatctgtatgtccccacaagcatcaccctgggggaaaatwagcttatgtgccagaaaatatttcaagagcacaaacactaaaaacgataagagagctgggtgcagtgcacgcgcctatagtcccagctacttaggaggctaaagtggggaggattgcttgagctcaggagtaagtccagcctgggcaacacagtgagagaaagaaaaaagaaaaagaaggaagggagggcgggagggagggaagatggaagggaaggaaggaggaatgaaggacaacaatatgagaagcacaactattagaatagaaagatcaacaattttaaagtagttcaccataatc

SEQ ID NO: 168860 - DNA, 601 bp, Human
gcaggagagggaactgctgtcatttagttctggctctcccctgctgctgccctgagacaatgtctgtcctcacacctgtagagaatagctacgaataccttggagaaggggagggataaacagagggaactaaacaatacgaagggtttatttcctgtccttttctccttccaatgcccacagctcatctaaagagggttcttcctcatgctatgtctccctgagaggtaaaaggtggagaccagaactaaagagttgttttcaggaatggagaatacttgactgtgcttatttgatgaawgaatcctctactctaagactttcccacagactgggatctgtatgtccccacaagcatcaccctgggggaaaataagcttatgtgccagaaaatatttcaagagcacaaacactaaaaacgataagagagctgggtgcagtgcacgcgcctatagtcccagctacttaggaggctaaagtggggaggattgcttgagctcaggagtaagtccagcctgggcaacacagtgagagaaagaaaaaagaaaaagaaggaagggagggcgggagggagggaagatggaagggaaggaaggaggaa

SEQ ID NO: 168861 - DNA, 601 bp, Human
gactactgggccatcttgccccagacaggtaaatgcaggtgaacaactgagggaaaacagagaaaaagtgtaagaaacctagttttgaactactttgtataaggtagtggatttgcctgaggcaagacatcttatgagaagtctgagagcggcaggagagggaactgctgtcatttagttctggctctcccctgctgctgccctgagacaatgtctgtcctcacacctgtagagaatagctacgaataccttggagaaggggagggataaacagagggaactaaacaatacgaagggtttmtttcctgtccttttctccttccaatgcccacagctcatctaaagagggttcttcctcatgctatgtctccctgagaggtaaaaggtggagaccagaactaaagagttgttttcaggaatggagaatacttgactgtgcttatttgatgaatgaatcctctactctaagactttcccacagactgggatctgtatgtccccacaagcatcaccctgggggaaaataagcttatgtgccagaaaatatttcaagagcacaaacactaaaaacgataagagagctgggtgcagtgcacgcgcc

SEQ ID NO: 168862 - DNA, 601 bp, Human; identical to SEQ ID NO: 39679

SEQ ID NO: 168863 - DNA, 601 bp, Human; identical to SEQ ID NO: 123838

SEQ ID NO: 168864 - DNA, 601 bp, Human; identical to SEQ ID NO: 123837

SEQ ID NO: 168865 - DNA, 601 bp, Human; identical to SEQ ID NO: 123836

SEQ ID NO: 168866 - DNA, 601 bp, Human; identical to SEQ ID NO: 123835

SEQ ID NO: 168867 - DNA, 601 bp, Human; identical to SEQ ID NO: 123834

SEQ ID NO: 168868 - DNA, 601 bp, Human; identical to SEQ ID NO: 123833

SEQ ID NO: 168869 - DNA, 601 bp, Human; identical to SEQ ID NO: 123832

SEQ ID NO: 168870 - DNA, 601 bp, Human
cacttcgcctaaaactcacagccctaggtgtgaccaccttaggcctcttactagcaatagaactaaattttataactaataaccttaagctaaagtatcaattacagacttttaaattctccaatatactaggtttttactcagccaccatccactgtacagctcccccaactcaagtctatttacaagccaaaatctggcctcacttctactagacataatttgattaggaaagtccataccaaaaaccatttcacaaactcatataatcagcctccattaccatacctgccccaaaagscctaatgaaactctatttcctctccttttttattttacctcttctaactctaatcttaattacctaatcatcaccctgagtaacttcaagtgcaacataaatactgacaaataacgttcaaccagcaactgccaccaatacccgtaactgtataaagaagctgcaccgacagaatcctcacgcaaccacctcgccccctcaccctcaaatattatgcaactccatatgctattaaaattaattataatgaccatcccatcatactcattcaccaaattaacaccaactctgttaataatc

SEQ ID NO: 168871 - DNA, 601 bp, Human
tttgcttcccaggaaaagtctttgaaagaacaataatgaatacataccatctgggtgagacttggaggtattggggcattttagaatgtccacctggcttacttttttgactttagctaaataaaatgtaataaagggggcaggtgggagttgggggaactgttcaactccctggttagtgcccccaaatgctgaccagtgccacagaaacccatgtggctgttgggtgtggctcatccgtgtggaaaaggccccttctaggcccatactcacttccagtgttaggcatgtttaatcagcrttagcggggagtgtgcattgataaccacaaaattggaagacactatgaggagaggagtgtgtgagagagaacaagagaggaaagggtttaactctacctttcactctagttttctaccggtgggtgcttgatcatctaacggaagttgtctgtgcaaggggagctagaaatcaagtgagcagaaaatcgattttgcataaattgaaaaagctggagataatcaccaaaatatctcagtcatctctgagaaaggaagggaaattggagctgaaaaggattttcatttctaggtccctgaga

SEQ ID NO: 168872 - DNA, 601 bp, Human
aaggggagctagaaatcaagtgagcagaaaatcgattttgcataaattgaaaaagctggagataatcaccaaaatatctcagtcatctctgagaaaggaagggaaattggagctgaaaaggattttcatttctaggtccctgagaagctttgatgacaaggcacaagtgttgtatattttctgaactagggtgaccatacttattgttaccagaaaagcacttgtcctggtaaagaccaggaactataaggagacaaatagcttcatcctcagccctttctctttggactgacacatctgrtttacaaatgaggccatttatactggatagattgggaacagatggctgctacctggggtcttcaagtcctcaccttcccagacagccctttgcttttcaacatgcagatagaaaaaccgatgcccctattccacatcctatggaaaacctagtatcctccctgaagatttccatggattcttgggggcattggttgcatctgatgacctcttgttccatccagtgtgtgacggctaaaagttcgggcctctgactaaaacagacctgtgatcaaatcctggttctctctccttacagtga

SEQ ID NO: 168873 - DNA, 601 bp, Human
tgagtttatactaaaaacaataatatcctacccttattatttctctttgttgtttaaatattgccttcattaatgttatctcatttgattctttatcaaaaagccatatgattcaaatctggcacatatcattattcccctttaatatatgagcaagctgagaatgagaaataatatgttcatttacattgccaacaagtgtcatccctggaaataatgtctaggatctgttattcaattacacccaatatactagaagctgttacagagaaaaaaaaagttcaacatattatcttgaaawtcttcttataaaattgagaaaatcaggcataaatatgtaaacagttaaataacattccatggctaagtgtcccaccagatggcaatagaagccatgagtcagaaggtacagggttaattaccgtgtcataatgtgatacacaaatatgggaagactgtgttcatttctgggctctgtgttttaagagggacactgacaacgtagagcttacccaggtgagactcactgggagtccgaggagacgcagagatcaaagatgaagggacaagtgtccaaacgaagagagaaccccgggagggc

SEQ ID NO: 168874 - DNA, 601 bp, Human
cctggttgtctaagtcaagtcatttcagctgtcagtattgttttattcctcattttaggagatactactaaaatgtcagttcacctggaagttgtgcccagagcatttaattggatttacattaaaatgaaagaaatatgccaatgtggttttaattccaacagttattataatagataaggattctagaaaaaataatgtcaagtctaggtgaaattgttaggctataaaatggactcaggggatttttttgaaaagagaaaggggacatgttcctgctgtaactgtatttaacattcarcgtagggtacaaagctctccaccttttctctgcttgctaagacaagtggatgtatcttagaactggggactagaagggacatgaaagcatcatctacgtaatttctctgctgtcagagaaatcattctatgtgtattaaatatctcttgtttgtaacttattctcctctaaaggacctcacaaatgagccctgagggagctgtttagaattaattcatcacaataaaaaaattgtctttgtgcaacctttcatattttagttttagactcttccattttcagctctatatgaaaagactc

SEQ ID NO: 168875 - DNA, 601 bp, Human
agcgtagggtacaaagctctccaccttttctctgcttgctaagacaagtggatgtatcttagaactggggactagaagggacatgaaagcatcatctacgtaatttctctgctgtcagagaaatcattctatgtgtattaaatatctcttgtttgtaacttattctcctctaaaggacctcacaaatgagccctgagggagctgtttagaattaattcatcacaataaaaaaattgtctttgtgcaacctttcatattttagttttagactcttccattttcagctctatatgaaaagacwcaatagtaggttattatcttcctgataaaaagccttcacattgttaatctctttttccaaaaatatatttgtttctgaaatatttcctcatatgctctcttttcctgcccctaaatagtatgtattgctcaatgccaagccctccctcaagttaattgctcttttttagttataaaaccccaactggagtccatctaatcatctaataattcctatacttatgcctccagggccacactagctttttaaactacagcatggtgaaagctggtggtcatttgctgtctcattttcctacca

SEQ ID NO: 168876 - DNA, 601 bp, Human
atgtattgctcaatgccaagccctccctcaagttaattgctcttttttagttataaaaccccaactggagtccatctaatcatctaataattcctatacttatgcctccagggccacactagctttttaaactacagcatggtgaaagctggtggtcatttgctgtctcattttcctaccaaacttgtatgaaattgttctgtctttcccaagaaccgtccttcaccaagtatttcttcaatggactgtgattaaatggttttaactgattattcaatgaatatgtggggcccattttttwaaaaaaattagaaaacagatgggttttaaaaaagagaggatatactatgaaaagttctcttccaatctctgtcccagtcatgtgctcccccaacccattagggtctaaccccatttctgctgcttgtgtattcatggagagagatcatgtacataaaaagaaatgcatgtaatgtatttaatacaattggcagcacgttttagcactgctctgcatcttcttttattttaataatataccttgggggtctttccactttggtatacatggatctcctttattctatttttttgtttgttt

SEQ ID NO: 168877 - DNA, 601 bp, Human
ttagttataaaaccccaactggagtccatctaatcatctaataattcctatacttatgcctccagggccacactagctttttaaactacagcatggtgaaagctggtggtcatttgctgtctcattttcctaccaaacttgtatgaaattgttctgtctttcccaagaaccgtccttcaccaagtatttcttcaatggactgtgattaaatggttttaactgattattcaatgaatatgtggggcccatttttttaaaaaaattagaaaacagatgggttttaaaaaagagaggatatacwatgaaaagttctcttccaatctctgtcccagtcatgtgctcccccaacccattagggtctaaccccatttctgctgcttgtgtattcatggagagagatcatgtacataaaaagaaatgcatgtaatgtatttaatacaattggcagcacgttttagcactgctctgcatcttcttttattttaataatataccttgggggtctttccactttggtatacatggatctcctttattctatttttttgtttgtttgtttctatttttttcagtagactagcagtctactgactggatgtac

SEQ ID NO: 168878 - DNA, 601 bp, Human; identical to SEQ ID NO: 39680

SEQ ID NO: 168879 - DNA, 601 bp, Human; identical to SEQ ID NO: 39681

SEQ ID NO: 168880 - DNA, 601 bp, Human; identical to SEQ ID NO: 39682

SEQ ID NO: 168881 - DNA, 601 bp, Human; identical to SEQ ID NO: 39683

SEQ ID NO: 168882 - DNA, 601 bp, Human; identical to SEQ ID NO: 39684

SEQ ID NO: 168883 - DNA, 601 bp, Human; identical to SEQ ID NO: 39685

SEQ ID NO: 168884 - DNA, 601 bp, Human; identical to SEQ ID NO: 39686

SEQ ID NO: 168885 - DNA, 601 bp, Human
gaggggacactgtctggagagctcctacccccatctaaaaggaaccccctccatttcattaccagccagttgcccgttgagctctgtgttgccagatcttgagttttgaaatgctgggaaatgctggaaacacagattttaatataaattctgatttttaaatgttggcaactaaattcaattttttaaaaaatactctgtatttggccgacaggctgtccatttgtggtcaagagcaggactttggagacatcacacagacccgggtttgaatcctgataagtaatttacaactttattyggacaaggcagtttaatttctgggcctcaatttgctcgtctgtaaaatggggctaataatacctatcccataatattgtttggaggattaagtgagatgcatgtgaagaaattaacacagtgcctggcatatataatagtaatcatcaatatatatgtacagaggaccattttatattgcacatatacaaagggctgcttcccaaattagtaatttgttagctggtttctttcattagatacacacatagtatgacctaattaattagcctaaggccttagttaacccactctttttttt

SEQ ID NO: 168886 - DNA, 601 bp, Human
agaagaccgtgtgatatgattttatgaagtctgtatacatctaaacccactgaggatttagtgttgaaattaaaactttaaaatttttaatttgacaaacatttaatgatctgcataatcatcgtcctatatagtaattaggcatcaacagtaagtaggattgtaattcctaggctattaattgctggggtcagttgccaggagatagtacaagggcaggactaatggtgtaaaagtttctctagcctcactcccatgatcttttaagctgtcatcagatgagactcagagtttgtgctcyccccgatttctgtcagtgggggttaatggctcagcattccaaaggcagtccaaatcctgacgtgttttgtgtagcttagaaagacacaggttctagggtatttgttttaaggtggggttgtactctccccattgcaatatttgcttccgttattgagaaattagggttaaaccagtgaaaccgatgcttcaaatgggaagatgatggggaaggagaattcagagcagtagcagagtttcttccattaacaacaggcagaatttaggagccgcaacctggcttttcttctcttacagttat

SEQ ID NO: 168887 - DNA, 601 bp, Human
ctaagtccttgctaattgattcagcaatatggttagcctcattattttgtgcttatactttatgtacattgcagaaggctcaacataaaatggtaggcaaaagtcatgatggctttgaagtccttcctccaaagatacagcactagggccgggcatggtggctcacccctataatcccagcactttgggaggctgaggtgggcggatcacaaggtccggagttcgagaccagcctggccaacacggtgaaaccctgtctctactaaaaatacaaaaattatccaggcgtggtggcagacayctgtaatcccagctactcgggaggctaaggcaggagaattgcttgaacccaggaggcagagattgtgccactgcactctaacctgggtgacagagcaagagcaagactccttctcgaagaaaaaaaaaggatacagcactaggttcttctagtttagggaaaacctttactttcatgaaaattgggaacattttttaaaggctatatttggtgagatgggaagctagtgccacatgcttaacaattgcctcaactaacaagtttcttttaacacatttgttttgtagacttaatggtgct

SEQ ID NO: 168888 - DNA, 601 bp, Human
caagagcaagactccttctcgaagaaaaaaaaaggatacagcactaggttcttctagtttagggaaaacctttactttcatgaaaattgggaacattttttaaaggctatatttggtgagatgggaagctagtgccacatgcttaacaattgcctcaactaacaagtttcttttaacacatttgttttgtagacttaatggtgctctgtgtgcatgttcttccaaaaactgattcattaatttagtcaatctccaaattaaaatttaataatgtctcctgacttttttttcctctttcctsttttgtcttaatttttcatcagcgttccaaaacagggagacattccaaacaagtgcaacattccaaacaaggtcaacaaaaaaacagtcataatacttgtgtcagtactataagacagtttgagaaatattgattggaagaatctagttatgaatttcaatcatctgtaaactctaccatcaaagaatctgttttttatgtgtttcattaatggaaagtgggattttaaatcaaatgaagtgccataaaaatgcacctgaaagtataaacttcttaacatgaacaaatatagatctgcta

SEQ ID NO: 168889 - DNA, 601 bp, Human
cactataattgctcttttctactatcctttggaaggttcaaagtctatgaacaggtaagaaaaattattgttaataattatgttcaaaattctacttttgaaaaatcttaaatatcaacatattgtaatgtctagtagaccccctaattttcatgagtcatgagaaccacaaattttcagttgatatattatagcagaaaacagataatactcaaacaggataattaaggagagtttaacaaaaggaatatttgcaaaggtttagacaatatttagaaaagccaataaggaaacaccatartacccccagcatggttatagtaggaagtctgtattatctctaggccccaaggagcaaggagaagaaatggttactggaatctataaaaagctgtaattgtaagagagtgccccagcagggacaggcacagccagcctttagcaataatgaggagacagccagggaactaaataatcctgacccaactcttctgcctctcaacccaaaacagtcagaagccagaaagcaaggtagccactgatgctgtccattcaggtcagctttcctgcgtgcagactggataaaggctgaaggagaaga

SEQ ID NO: 168890 - DNA, 601 bp, Human
aggagagtttaacaaaaggaatatttgcaaaggtttagacaatatttagaaaagccaataaggaaacaccatagtacccccagcatggttatagtaggaagtctgtattatctctaggccccaaggagcaaggagaagaaatggttactggaatctataaaaagctgtaattgtaagagagtgccccagcagggacaggcacagccagcctttagcaataatgaggagacagccagggaactaaataatcctgacccaactcttctgcctctcaacccaaaacagtcagaagccagaaagsaaggtagccactgatgctgtccattcaggtcagctttcctgcgtgcagactggataaaggctgaaggagaagagttttggaagggcaaataggaaatacttggactttatttggcttcctttaaactggggaaacaaataccacgcaatgggaacatgagtgaaggcacagaactgtaaatgggctccatttacagttacagttacagtatattcaaggcagattgtccagagtagttatagagtgttgtaggatgcatggaagaagataagaagaagggatgaggctggaatgagactt

SEQ ID NO: 168891 - DNA, 601 bp, Human
aacaccatagtacccccagcatggttatagtaggaagtctgtattatctctaggccccaaggagcaaggagaagaaatggttactggaatctataaaaagctgtaattgtaagagagtgccccagcagggacaggcacagccagcctttagcaataatgaggagacagccagggaactaaataatcctgacccaactcttctgcctctcaacccaaaacagtcagaagccagaaagcaaggtagccactgatgctgtccattcaggtcagctttcctgcgtgcagactggataaaggctgraggagaagagttttggaagggcaaataggaaatacttggactttatttggcttcctttaaactggggaaacaaataccacgcaatgggaacatgagtgaaggcacagaactgtaaatgggctccatttacagttacagttacagtatattcaaggcagattgtccagagtagttatagagtgttgtaggatgcatggaagaagataagaagaagggatgaggctggaatgagactttgaatttggattttattctgtaggtaatagggaaccatttgaggcgtttgagtagcatgacata

SEQ ID NO: 168892 - DNA, 601 bp, Human
attgtaagagagtgccccagcagggacaggcacagccagcctttagcaataatgaggagacagccagggaactaaataatcctgacccaactcttctgcctctcaacccaaaacagtcagaagccagaaagcaaggtagccactgatgctgtccattcaggtcagctttcctgcgtgcagactggataaaggctgaaggagaagagttttggaagggcaaataggaaatacttggactttatttggcttcctttaaactggggaaacaaataccacgcaatgggaacatgagtgaaggcayagaactgtaaatgggctccatttacagttacagttacagtatattcaaggcagattgtccagagtagttatagagtgttgtaggatgcatggaagaagataagaagaagggatgaggctggaatgagactttgaatttggattttattctgtaggtaatagggaaccatttgaggcgtttgagtagcatgacataatcaaatctgattttgaaaaacttcttttgtaatagcagtatttaggatatactgaaaggagaaaagccagaatttgggatctagttaaaattctagtatccatt

SEQ ID NO: 168893 - DNA, 601 bp, Human
cattcactcaagttacgtatatgatgaggactttattttaaggctaaaagggaaaatgggcatctcaagccttgtggctaggactggaagaaaactgtagaatatctgagccacacaaatgaattgaaatgttatgcagaatccaaggcagttttggggaatggactgttttgttgtgcctttatatcccaaatagcctatgaatcctgccttagtcttccatcatttaggggcttagctagtctctccacttctgtttttgctagcaattacccagatttctccatatctcacgttcagyttgagagaatcgaattaggtccattaaatctcattgtctctatctggacataactttatttcacactggccagccttagattggctacctgggcccaggtgcccttccctaattcagtcaggaagcgcaagggtcacatggtacaaaaggactgctatataagcatttttccttgtataagcatgacagatactattccagacctgacaataaaatgacattttgcacactcctttaaaaaatgcaactattggccgggtgtggtggttcacgcctgtaatctccacactttgggaggcc

SEQ ID NO: 168894 - DNA, 601 bp, Human
agctgggactacaggcgcgcaccaccacgcccagctaatttttgtatttttagtagagatggggtttcaccatgttggccaggctggtcttgaactcctgacctagtgatccagctgcctcggcctcccaaagtgctgggattacaggcgtgagtcactgcacccagccccatttctcatttttatagtttactgggtctctgtaagcatttgaatgtgttatccttgagcttacatcctcatcaacattacagaattcattcttttttttttttcttttttttgagatggagtttcattsttgttgcccaggctagagtgcaatggcatgatctcagctcattgcaacctccacttcccaggttcaagtgattctcctgcctcagcctcccaagtagctgggattacaggcacctgccaccacacccagctaatttttttctatctttagtagagacagggtttcaccattttggccagactggtcttgaactcctgacttcaggtgatccacccacctcggcctcccaaagtgctgggattgcaggcctgagccaccacacctggcctacagatttctttatagttatttttattagtt

SEQ ID NO: 168895 - DNA, 601 bp, Human
accatgttggccaggctggtcttgaactcctgacctagtgatccagctgcctcggcctcccaaagtgctgggattacaggcgtgagtcactgcacccagccccatttctcatttttatagtttactgggtctctgtaagcatttgaatgtgttatccttgagcttacatcctcatcaacattacagaattcattcttttttttttttcttttttttgagatggagtttcattgttgttgcccaggctagagtgcaatggcatgatctcagctcattgcaacctccacttcccaggttcaartgattctcctgcctcagcctcccaagtagctgggattacaggcacctgccaccacacccagctaatttttttctatctttagtagagacagggtttcaccattttggccagactggtcttgaactcctgacttcaggtgatccacccacctcggcctcccaaagtgctgggattgcaggcctgagccaccacacctggcctacagatttctttatagttatttttattagttaataggtatataatggtaatataggttgtcttattttgctttcttttaattttttacaggactaagta

SEQ ID NO: 168896 - DNA, 601 bp, Human
tcataatgtgttttcacatattacctcataattttcataatacttcagtctaggcaatatatgtttttattttgtagtagagaaaacaggaggctcgcagaaatttaaaatgtattagtcaaagtcattgggctggttgctatactggtattgaaacccacatcttctaactacactatgagctcctaggatgagttgtatcccaagtatctagtagactaccccgaataattatttactgaagggatgactgcattctgactcttacaacagtaatctttttaatatacaatcatgcacygcataatgacattttggttagcactggactgcatttatgacagtggtcccataagattatattaccgtattttagtgtactttagtttctctgtttggctatatatatttttttatttgagacggagtctcactctgtcacctaggctggagtgcagtggtgcattctcacttcactgcagcctccgcctcccaggttcaagtgattctcctgcctcagcctcccaaacagctgggattacaggcgcctgccaccacgcctggctaatttttttatttttagtcgagttggggtttcacc

SEQ ID NO: 168897 - DNA, 601 bp, Human
agttagatacacagatacatagcattgtgttgcaattgcttacaatattcagcatactatcatgctgtataggtttgtagcctaggagcagtaggctataccatatagcctagatgtctgtaagctgtaccatctaggcttgtgtaagtgcactctatgatgtttgcacaatgatgaaactgcctaatgatgcagttctcagaatgtatccccattgttaagcaatgcatgactgtactagtattcactagtcacaagtatttttcgggtagcaatctgaaaaggactaaattatcttgcrtctcagttgctactgttgtcatttctcagatgtattaataacattgcattaaatgtattcattcattcaggaattatttaatcctactatgtgccaggcagtgttccagatgtaggagatgcatcagtttaaccaaaaaaagtacctgccttcatgaagtttacattctagtagggagagacagacagctaaaaagataagagtaaatatatatttgtcaagtgatggtaatacagggaaaaataattgtgggataagaaggatagaatgccagtgcttggggtaatgggggagctgtta

SEQ ID NO: 168898 - DNA, 601 bp, Human
ctgttgtcatttctcagatgtattaataacattgcattaaatgtattcattcattcaggaattatttaatcctactatgtgccaggcagtgttccagatgtaggagatgcatcagtttaaccaaaaaaagtacctgccttcatgaagtttacattctagtagggagagacagacagctaaaaagataagagtaaatatatatttgtcaagtgatggtaatacagggaaaaataattgtgggataagaaggatagaatgccagtgcttggggtaatgggggagctgttatttttaaataggrtagttgggaaagatcaccatgataaggtgacactggagccaaaacttaaaggagttgagagagtgaaccatgtagttacttgatgagagagtattccaggcaaaggggccagccaagtactaagtatgctgggcatgttcaaggaacagcaaggagactgatgtggctaaaagagagtgagtttgggagaatgtaataatgaggtcagagagatagcaggggctcagttcctatcggctttaccactgagggagatagaaagcctttttaatctcatcagcagcatgataataacttatt

SEQ ID NO: 168899 - DNA, 601 bp, Human
tgcacttacaacttagggcaggggtcaccagtcccaaggctgtggactggccccagtccatggcctcttaggaactgggctgcacagcaggaggtgagcaagcaagcaagcattactgcctgagctccacctcctgtcacattcttacagaagtgtgaaccctactgtgaactgcacatgcaagggatctaggttgtgctccgtatgagcatctaatgtccagtgatctgaggtggaacagtttcatccagaaaccatgccccactcccacccccgcaacctgtttgtgggaaaactgtcwttcaagaaaccagaccctggtgccaaaaaggttagggaccgctaccttagggcccaccaattccaatcctaggtatatgtctaacagaaatgcacatatatggataccaaaagatgtgtaaaagaatgttcattgcagcactattcacaatagctggaaatggaagcacagtgtccatcaatagaaggaatacatacagtgtggtatacatagttacaatacacagtattgtaaaggaatgaactacagcacgcaaaaaaacttggttcaatctcacaagcacaatgactaaaggaattt

SEQ ID NO: 168900 - DNA, 601 bp, Human
gagcaagcaagcaagcattactgcctgagctccacctcctgtcacattcttacagaagtgtgaaccctactgtgaactgcacatgcaagggatctaggttgtgctccgtatgagcatctaatgtccagtgatctgaggtggaacagtttcatccagaaaccatgccccactcccacccccgcaacctgtttgtgggaaaactgtctttcaagaaaccagaccctggtgccaaaaaggttagggaccgctaccttagggcccaccaattccaatcctaggtatatgtctaacagaaatgcayatatatggataccaaaagatgtgtaaaagaatgttcattgcagcactattcacaatagctggaaatggaagcacagtgtccatcaatagaaggaatacatacagtgtggtatacatagttacaatacacagtattgtaaaggaatgaactacagcacgcaaaaaaacttggttcaatctcacaagcacaatgactaaaggaatttagacatgagtacatatggtatgatcctattcttataaaattcaaaaaaagataaaactcatctatgttatcagaaattaggatagtggttacctt

SEQ ID NO: 168901 - DNA, 601 bp, Human
cccccgcaacctgtttgtgggaaaactgtctttcaagaaaccagaccctggtgccaaaaaggttagggaccgctaccttagggcccaccaattccaatcctaggtatatgtctaacagaaatgcacatatatggataccaaaagatgtgtaaaagaatgttcattgcagcactattcacaatagctggaaatggaagcacagtgtccatcaatagaaggaatacatacagtgtggtatacatagttacaatacacagtattgtaaaggaatgaactacagcacgcaaaaaaacttggttcratctcacaagcacaatgactaaaggaatttagacatgagtacatatggtatgatcctattcttataaaattcaaaaaaagataaaactcatctatgttatcagaaattaggatagtggttacctttgggaagaggaagggttacctttgggttacttttggggaggaggtagggactgactgattggagggacaaggtggtgctgctaatactctttatcctgctctgtatggcaggtacacagttgtgttcatgtagtgatgattcatagagctttaccttcatagcgtatttttctgt

SEQ ID NO: 168902 - DNA, 601 bp, Human
tttcagcaagctccaaatgtgaatcactatgctatttttgtttttcagctttgttactttgagtttgtctctgatgattgatcgtattttttttggccaagtaagtaaaagtatattaagctaacagctatttttatttttaatccattaatactttagaacagaggcaaatgattttttaaatgatatgggatacattacaaaagacttctaggcatatcctaataagcctttggttcaatttgttgtgctttctacataaaagaattagtactcctagctaatattcaggagagtacaytttaaggcagggaattattaagtgagcactgaatgttacctgttgctgtttctgtcattattgtcagctttacgctgtaattcaaattgtaatgttttcaaagctttatcttcacaggtaatatgtcacattgtaaagtaccacacagtccgaaaaatatgtctactatcctctttatctcttaactggatataaaacttggatggagctggaggccattattctaagtgaaataactcaggaatggaaagccaaatatcatatgttcttacttataagtgggagctaagctatgggatg

SEQ ID NO: 168903 - DNA, 601 bp, Human
actttagaacagaggcaaatgattttttaaatgatatgggatacattacaaaagacttctaggcatatcctaataagcctttggttcaatttgttgtgctttctacataaaagaattagtactcctagctaatattcaggagagtacattttaaggcagggaattattaagtgagcactgaatgttacctgttgctgtttctgtcattattgtcagctttacgctgtaattcaaattgtaatgttttcaaagctttatcttcacaggtaatatgtcacattgtaaagtaccacacagtccraaaaatatgtctactatcctctttatctcttaactggatataaaacttggatggagctggaggccattattctaagtgaaataactcaggaatggaaagccaaatatcatatgttcttacttataagtgggagctaagctatgggatgcaaagacataagaatgatataatggactctggtgactcagggtggggaagggtgagagaggggtgagaaattcttatttcgagtacatattgggtacagtgtacattgcttgggtgatgggtggaccaaaatcctagaaatcacctctaaag

SEQ ID NO: 168904 - DNA, 601 bp, Human
ctgctgttgaaactagtttttaatgcttttacacacaaaacatttacacttttaaaactcactctaaggcatatgcaattattattattatctttttagacagagtctcactctgctgcccaggctggagtgcagtggcacgatcttggctcactgcaacctccacctccctgtgttcaagcaattctcctgcctcagcctcccgagtagctgggattacaggcatccgccaccatacccggctaatttttgtattttaagtagagacagggtttcaccgtgttggccaggctggtctcgmactcctgacctcaggtgatccacccgcctcagcctcccaaaagtgctgggattgcaggcgtgagccaccgcgcccagcctggcatatgccattttttaagtaattaactcctgattttattcaggccttttctccatttttccacagtcttaacatgtatttttttgtcacttacaaaaatccttacatgactcaattcaggaaaatctgggtttttacattggttggtttggaaaaattacgaattgaaactttattaacttcaagtttaattcggaataaatgactgttgacttcctt

SEQ ID NO: 168905 - DNA, 601 bp, Human
ttttacacacaaaacatttacacttttaaaactcactctaaggcatatgcaattattattattatctttttagacagagtctcactctgctgcccaggctggagtgcagtggcacgatcttggctcactgcaacctccacctccctgtgttcaagcaattctcctgcctcagcctcccgagtagctgggattacaggcatccgccaccatacccggctaatttttgtattttaagtagagacagggtttcaccgtgttggccaggctggtctcgaactcctgacctcaggtgatccacccrcctcagcctcccaaaagtgctgggattgcaggcgtgagccaccgcgcccagcctggcatatgccattttttaagtaattaactcctgattttattcaggccttttctccatttttccacagtcttaacatgtatttttttgtcacttacaaaaatccttacatgactcaattcaggaaaatctgggtttttacattggttggtttggaaaaattacgaattgaaactttattaacttcaagtttaattcggaataaatgactgttgacttccttcaaatattaagaccttaaaaaaaatc

SEQ ID NO: 168906 - DNA, 601 bp, Human
cagtctaaaagattgaatctttaagtggcaagatccctgtaaccagggcctattcacagtttattgagataaaatgctgatgaggggtaaagagagccccttctaataggtaagaatcaccccttcttccatcctctgtctacttagaaggatccctaaaagacagcaacctagaaaaccccttgatctcctcacaggatgcattcttttcctccacaccctacctaaggttctagagtgggtcaaaaaactctaattcctaggagatttgtacttccactaacagtcagggctgtttaawgccaagaggttccaacagtaggatcagttctgtctagtgatgtcacctagacagaaatctctggacatttagaacagttctctttggagctcttgatgttttagtgacccagtttgaatctttcctaactacttgaaatcttgagttataccacaaatttcagccttattctgctttgtgtgacttgttttaacctatttttatgtaaacatgacaactctgtcagccattgctgtgtaaaaggccacctcaaaactgtagtggcttaaaactccatttattataatttacaggtctaca

SEQ ID NO: 168907 - DNA, 601 bp, Human
tcagcctccagagtagctggaattacaggcccatgccaccacagccagctaatttttgtatttttagttggggcttgaccatgttgaccaggctggtgtcgaactcctgacctcagatgatccacctgccttggcctcccaaagtgctgggattacggcatgaggcaccacagctggccccatattctaatctttttatcaaaattgcatatgtacattatttcagaagacattccacaaggaattaaaaaaaaaaattgttcccctgctctccctatttcctctccccaaaaacaatcasttaagcattctttcagctggttattttggtatttatctcgatatctctaaaacatttataatgccacttaaaggtctttgttttaggcattaactgttgaattctatcgaagatggaaagatggctttacttccttaacaaaatagcaacataaaattcttcctggccagctgccagtggctgacgcctgtaatcctagcactttgggaggctgaggtgggtggatcacctgaggtcaggagttcaagaccagcctggccaacagggtgaaaccctgtctctactaaaaatacaaaaatt

SEQ ID NO: 168908 - DNA, 601 bp, Human
tgacctccagtgatccacatgccttggcctcccaaagttctgggattacaggcataagccactgcacccggcctactctagtctttctatgccacaataaaaccattacttatttggatgttaatcagtggacatatgttgctctctacttctcaatcatcttaaataaaaaaaaaaaacacttcaaacttgccatgtggctgggcgtggtggctcacacctgtaatcccagcactttggaaggctgaggcgggtggatcacctgaggttaggagttcaggaccagcctggccaacatggkgaaaccccatctctactaaaaaaatacaaaaatcagccaggcgtggttggcgggcgcctgtaatcccagctacttgggaggctgagacaggagaattgctgggaggtggaggttgcagtgagctgagattgcgccattgcactccagcctgggtgacgagagcgaaactcttgtcttcaaaaaaaaaaaacttgccatataagtatgtgatccatcccctatcagagcagaaagggaagagagaaagaatcctttctgattatgatcacagtttcctactttatcaaatacacctatgga

SEQ ID NO: 168909 - DNA, 601 bp, Human
ttttggggggtggatcagggcgtggaccatctcggtggggtgcatgccgcgcctgcgatggacgttggaggaggagagggccgggaaccgggttcgtattgcctagcccggcccgtgtggagcgatgagtcgggaactgagtacctctcttccacccgggaactgcctctccttctctgcgtgaccttgggctgggagccacccaggaaatgttctcgagaaatgaggacttcaattccgaggtggggagtgtcatctcctctctcatgcctcagtttcccaatttatagacaaggtgggmggagccttcttgaggcccccttgggctctgacatttcatgaaccggtaacacccctcccactcagcatgcacctggatgcccaaggcgggtgtctgggagaaaggtctgctcccacagtgaagaggccagggtggcctccagcctagctggggggcagggtcctcagtgcagagggctgagtgggctcttgttcagacgggtggtcagggagaggatgggtcagagacagtgagcacagagggaggggttcaggtgccttgagtggcacctcatggaaagaagccctgctggggtctgga

SEQ ID NO: 168910 - DNA, 601 bp, Human
gagtgtcatctcctctctcatgcctcagtttcccaatttatagacaaggtgggcggagccttcttgaggcccccttgggctctgacatttcatgaaccggtaacacccctcccactcagcatgcacctggatgcccaaggcgggtgtctgggagaaaggtctgctcccacagtgaagaggccagggtggcctccagcctagctggggggcagggtcctcagtgcagagggctgagtgggctcttgttcagacgggtggtcagggagaggatgggtcagagacagtgagcacagagggaggrgttcaggtgccttgagtggcacctcatggaaagaagccctgctggggtctggagagggggtttctggggctccctgggtttggctggctgtatcccagaaactcccactcgaggttctggcctctgcaggcctggggcccgttccttgtgggcttagactaggaatgggctagactgtcagggaccccaggggctaccccaaggccagctgtgacctcagggtgcccaagcttcctcctttccttggttttcagggtctggttggtaggatggcttgggtatgtatccctggtctgcgaa

SEQ ID NO: 168911 - DNA, 601 bp, Human
ttttcttctcaaatgccgtcagatgggagctgtttgagggcaggaaagcccagttcctttaacccttgtgtcggtgcctgcacagagccgggcaccccagcacatctgtgtttgtggctctgaattcatttatctgtgccagtctcctgctccccagatgccccaacagacccttgccaaaggtgggagccctggggggcacctgccggatcaggcgggtgggctgcgttcactgctttagtctgcccacccctgggcctctggcctggaagggcgaagccactggctttgtgagggggcwtgtctgcttgggtcatttctgcctctgatgccttcatttagcaaagctttattgaatctgctgggccccaagggaaggcagcgtgactcagaagcagcccttgttctcgggaagccacagtcccactggggagtgagccaggtgcccccaggcagaggccgcaagagccaggagaggggtctccctgctgtggaatcaaatttcatggtgaaggtgatgtcagattgggcctggtgggatgagggtttatacatatgcacatccaggggagaggacgtggaaagcaggaggaaggatcag

SEQ ID NO: 168912 - DNA, 601 bp, Human
gtttgtggctctgaattcatttatctgtgccagtctcctgctccccagatgccccaacagacccttgccaaaggtgggagccctggggggcacctgccggatcaggcgggtgggctgcgttcactgctttagtctgcccacccctgggcctctggcctggaagggcgaagccactggctttgtgagggggcttgtctgcttgggtcatttctgcctctgatgccttcatttagcaaagctttattgaatctgctgggccccaagggaaggcagcgtgactcagaagcagcccttgttctcrggaagccacagtcccactggggagtgagccaggtgcccccaggcagaggccgcaagagccaggagaggggtctccctgctgtggaatcaaatttcatggtgaaggtgatgtcagattgggcctggtgggatgagggtttatacatatgcacatccaggggagaggacgtggaaagcaggaggaaggatcagcccctctgagcacccatggggtgcaagaccacacacagctacctagctggttccccaacactagaggaagctgcggctcagcgagcgaggccaagtgcctggcccaaag

SEQ ID NO: 168913 - DNA, 601 bp, Human
tggcccaaagtcactaagcatgtaagtggcagacgagcatttgagcctaggtcttcctgtctccaaagagtagttctccccctggggcagggaagaatccagaatcctggaatgtcaggattggaaaggacacaaaggtcacctggaccaaccaatgctcaaacgaccccacagcctcccagtcctgctcacacacgtggatacaaggcgctcactacctttgtcgaaccaagaggtgtctgatacaggctgattgacacctttaaaagtagctttttttcctgatcagagtaatacctgycaattattggaaagtataaaaatcacatgtgatggttgcacggtaggaatgtacttaacaccactgaaatggtgaagatggtaaattgtatgttacgtgtgttttaccacaacagaaaaagtttggtggggggtggtaatcatgtgataccaccacttagggagggctgcagtgaatagggtgctgtctccttctggtcttttcgaaactgtgtggcgtgctgagccatttaaacacatcaggagctgcgggggatgcagctggcgcctgctcttggccctcacaccacagggcagagca

SEQ ID NO: 168914 - DNA, 601 bp, Human
gtgctggcagatgagttttttgtttgtttgttttttgtttttgagatggagtctcgctctgtctccaggctagagtgcagtggcgcgatcttggctcactgcaacctctgcctcctggtttcaagtgattctcctgcctcagcctcccaaatagctgggattacaggcacccaccaccatgcccagctactttttaaatttttagtagagacggggtttcaccatcttggccaggctggtctcaaactcctgacctagtgatccacccgcctcagcctcccaaagtgctgggattacaggygtgagccaccgtgcccagtcaatgtttctttaattctctactttgacaaaatgaaaatgataaaatgtttgaaatgttgccattttcagggttcattttttaagggctttggccataataccacatggttctgtaagtggggtgggtatcttccccccgttttacaaatgacagaattaaggctcagcctggagaagtgacttgtgctagctcaaggcctgggcttgtcagagacttggtttgaacccggactgctgggctccacattctgtgtactccctgtgggttctctgcctggat

SEQ ID NO: 168915 - DNA, 601 bp, Human
gagttttttgtttgtttgttttttgtttttgagatggagtctcgctctgtctccaggctagagtgcagtggcgcgatcttggctcactgcaacctctgcctcctggtttcaagtgattctcctgcctcagcctcccaaatagctgggattacaggcacccaccaccatgcccagctactttttaaatttttagtagagacggggtttcaccatcttggccaggctggtctcaaactcctgacctagtgatccacccgcctcagcctcccaaagtgctgggattacaggtgtgagccaccgygcccagtcaatgtttctttaattctctactttgacaaaatgaaaatgataaaatgtttgaaatgttgccattttcagggttcattttttaagggctttggccataataccacatggttctgtaagtggggtgggtatcttccccccgttttacaaatgacagaattaaggctcagcctggagaagtgacttgtgctagctcaaggcctgggcttgtcagagacttggtttgaacccggactgctgggctccacattctgtgtactccctgtgggttctctgcctggatatccatggcacc

SEQ ID NO: 168916 - DNA, 601 bp, Human
tcactgcaacctctgcctcctggtttcaagtgattctcctgcctcagcctcccaaatagctgggattacaggcacccaccaccatgcccagctactttttaaatttttagtagagacggggtttcaccatcttggccaggctggtctcaaactcctgacctagtgatccacccgcctcagcctcccaaagtgctgggattacaggtgtgagccaccgtgcccagtcaatgtttctttaattctctactttgacaaaatgaaaatgataaaatgtttgaaatgttgccattttcagggttcrttttttaagggctttggccataataccacatggttctgtaagtggggtgggtatcttccccccgttttacaaatgacagaattaaggctcagcctggagaagtgacttgtgctagctcaaggcctgggcttgtcagagacttggtttgaacccggactgctgggctccacattctgtgtactccctgtgggttctctgcctggatatccatggcaccaaggggtggcctgaggggggcagcttcatacccctggttttattcaccccctccactccaccccccatcatcccaagtgaaca

SEQ ID NO: 168917 - DNA, 601 bp, Human
aggaaaattctgggaccagcggttgttggggaagagggtccagggtagagacagaacctctggccagttctgatgttcatttgttcattccacaagtcccctgctcagtgccagctgagtgctcagtgccaccccaaggcactctcgctccaataacgagaacaggattgagtgggaagcactgtcccagaggctcgggtcactacaagaaggaattcccaaggggtggcccaggagaggcttggatgacagactcacaagctggacttcctctgagggcagtgggaagctggagagaggstcaagggtatttcggaagctcctgtggaagcttggtttggagagggctctgtggctggaaatgcgtggtcacgtccagcctgtcctctcccagtaccgggcacagccctgtcacctagacaggaaggtgggcccacggccctcgtttggcatttattgctgaccaccctggagtctttctcacctcttcacctcctgtggccggccgctccgccgcttcttctctctcaggtctaggacagggtcagctgcaaggagaccgctgggaggtgatagatttctgctgtgttttgggcacttc

SEQ ID NO: 168918 - DNA, 601 bp, Human
tctctcaggtctaggacagggtcagctgcaaggagaccgctgggaggtgatagatttctgctgtgttttgggcacttcctcatgtccagggacagcccaggggcggcctcaagagcctgagaaagcctagggcatcaggagcagggccatcagagcgggaccttggaaaacccctacctctttcagccttggttgcctcatctgtaacatgggattggagggcctgggtttggggaggcctcgagagtttataaaaatgcaaattttggccaggtgtggaggctcatgcctgtaagcccarcactttgggaggcagaggcaggtggatcacctgaggtcaggagttcgagaccagcctggccaacatagcgaaaccctatctctactaaaattacaaaaaattagccaggcgtggtggcacgcgtctgtagtcccagctacttgggaggctgaggcatgagtatcgcttaagcccgagaggtggaggttgcagtgagccgagattgcgccatcgcactccagcctgggctaaaagagtgaaactccatttcaaaaaaagaaaagaaaaagaaagaaaggaaaagaaaatgcaagttatttt

SEQ ID NO: 168919 - DNA, 601 bp, Human
accctgtgtttagctcaaggtttgtgagtgcaccaatcgacactctgtatctagctgctctggtggggccttggagaacctgtgtgtccaaactctgtatctaactaatctgatggggacgtggagaacctttgtatctagctcagggattgtaaacgcaccaatcagcgccctgtcaaaacaggccactcggctctaccaatcagcaggatgtgggtggggccagataagagaataaaagcaggctgcccgagcttgcattggcaacctgctcagttccaaagctttgttcgtctgctckttgcgataaattttgctactgctcactctttgggtccacactacttttatgagctgtaacactcaccgcgaaggtctgcagcttcattcctgaagccagcgagaccacgagcccaccgggaggaacgaacaactccagacgcgcggcattaagagctgtaacactcaccgcgaaggtctgtagcttcactcctgagccagcaagaccacgaacccaccagaaggatgaaactccggacacatccgaacatcagaaggaacgaactccagacgcaccaccttaagagctgtaacactcacc

SEQ ID NO: 168920 - DNA, 601 bp, Human
gatagagttttgctcatctccccgctgctggtggagcaggggccaggtgaaggggacctggagagaggggcggctgcgtagctgggacagccccaagctgtcaaacccaagctgcaatcatgcaggagctttaacaagttggggctcctccagtacctcacagtgcagggggcaagagtccctgagccttcagcccctcccagaatgtccctgacaccttttgtaaattgcactgtaacctggcctgccccagaccttgcttcctgcagcctgttcagtgggggctgctttatccctcagrccctccctctgctgggtgtagaggtcgacagggtccttctggttcctgaggccacttacaggacattgtcccccagctttgaatctcacaccagcactgggtcgcccactccccttcatgatgagccagctcgaggccactttgcccgttcttcaaagatgcccccccaggccgggcacggtggctcacgcctgtaatcctagcattttgggaggccaaggcaggcggatcacaaggtcaggagatcaagaccatcctggctgagacagtgaaaccccgtctctactaaaaaaaaaaaaa

SEQ ID NO: 168921 - DNA, 601 bp, Human
atctccccgctgctggtggagcaggggccaggtgaaggggacctggagagaggggcggctgcgtagctgggacagccccaagctgtcaaacccaagctgcaatcatgcaggagctttaacaagttggggctcctccagtacctcacagtgcagggggcaagagtccctgagccttcagcccctcccagaatgtccctgacaccttttgtaaattgcactgtaacctggcctgccccagaccttgcttcctgcagcctgttcagtgggggctgctttatccctcagaccctccctctgctgkgtgtagaggtcgacagggtccttctggttcctgaggccacttacaggacattgtcccccagctttgaatctcacaccagcactgggtcgcccactccccttcatgatgagccagctcgaggccactttgcccgttcttcaaagatgcccccccaggccgggcacggtggctcacgcctgtaatcctagcattttgggaggccaaggcaggcggatcacaaggtcaggagatcaagaccatcctggctgagacagtgaaaccccgtctctactaaaaaaaaaaaaaatacaaaaaaattag

SEQ ID NO: 168922 - DNA, 601 bp, Human
cctgagccttcagcccctcccagaatgtccctgacaccttttgtaaattgcactgtaacctggcctgccccagaccttgcttcctgcagcctgttcagtgggggctgctttatccctcagaccctccctctgctgggtgtagaggtcgacagggtccttctggttcctgaggccacttacaggacattgtcccccagctttgaatctcacaccagcactgggtcgcccactccccttcatgatgagccagctcgaggccactttgcccgttcttcaaagatgcccccccaggccgggcacrgtggctcacgcctgtaatcctagcattttgggaggccaaggcaggcggatcacaaggtcaggagatcaagaccatcctggctgagacagtgaaaccccgtctctactaaaaaaaaaaaaaatacaaaaaaattagccgggtgtggtggcgggggcctgtagtcccagctacccgggaggctgaggcaggagaatggcgtgaacctgggaggcggagcttgcagtaagccaagatcgcgccaccgcactccagcctgggcaacaaagtgagactctgtctcaaaaaaaaaaaaaaaaaaaa

SEQ ID NO: 168923 - DNA, 601 bp, Human
ccctccctctgctgggtgtagaggtcgacagggtccttctggttcctgaggccacttacaggacattgtcccccagctttgaatctcacaccagcactgggtcgcccactccccttcatgatgagccagctcgaggccactttgcccgttcttcaaagatgcccccccaggccgggcacggtggctcacgcctgtaatcctagcattttgggaggccaaggcaggcggatcacaaggtcaggagatcaagaccatcctggctgagacagtgaaaccccgtctctactaaaaaaaaaaaaaatacaaaaaaattagccgggtgtggtggcgggggcctgtagtcccagctacccgggaggctgaggcaggagaatggcgtgaacctgggaggcggagcttgcagtaagccaagatcgcgccaccgcactccagcctgggcaacaaagtgagactctgtctcaaaaaaaaaaaaaaaaaaaaaagatgcccaccctagcttggtgtcagccctctccagcactgctcctgctccagtcctggtcattggagtgtctatttctgtgaccctttccacacctggcctcctcttcccgcatggtct

SEQ ID NO: 168924 - DNA, 601 bp, Human
aaaaaaaaaaagatgcccaccctagcttggtgtcagccctctccagcactgctcctgctccagtcctggtcattggagtgtctatttctgtgaccctttccacacctggcctcctcttcccgcatggtcttgtccgccagcctcagccaactgtcaccagctggaccctagctaggcctggccctgccttcccagtagcctctcgcactccctgatcctccatccaggcgtctcctccaaccctcctacctttccatctccctctccctcccctgatcctagatccttgggcctggggccyctgaaccactgatcttcccctgtgcactggccctcaccaccccttggtccctcctgtctccctccgcacctcccagtggccacgtgttgcagctccagcccttctgcgcatcacactcgcctggcacagctctggttaaattccgtcctaggcatcttcacacctgcccccctcatcctagactatctcccctgttctggtggcccaggccagcctggctgcagcctcgtgagcctgttcctctcacctactcaaggacacacgtccatcagttctctctccctctctctcctccaccct

SEQ ID NO: 168925 - DNA, 601 bp, Human
agccaactgtcaccagctggaccctagctaggcctggccctgccttcccagtagcctctcgcactccctgatcctccatccaggcgtctcctccaaccctcctacctttccatctccctctccctcccctgatcctagatccttgggcctggggcccctgaaccactgatcttcccctgtgcactggccctcaccaccccttggtccctcctgtctccctccgcacctcccagtggccacgtgttgcagctccagcccttctgcgcatcacactcgcctggcacagctctggttaaattcmgtcctaggcatcttcacacctgcccccctcatcctagactatctcccctgttctggtggcccaggccagcctggctgcagcctcgtgagcctgttcctctcacctactcaaggacacacgtccatcagttctctctccctctctctcctccaccctcagtttcgccctctctgctcttggctcttctgcgtcagcttgcaaatgtgcgtgattccccatctcaggaagacactccctcatccatttctctggtccttcagaagagttgtcaccgtctccagggtttcttctgcggtctcc

SEQ ID NO: 168926 - DNA, 601 bp, Human
cccctgtgcactggccctcaccaccccttggtccctcctgtctccctccgcacctcccagtggccacgtgttgcagctccagcccttctgcgcatcacactcgcctggcacagctctggttaaattccgtcctaggcatcttcacacctgcccccctcatcctagactatctcccctgttctggtggcccaggccagcctggctgcagcctcgtgagcctgttcctctcacctactcaaggacacacgtccatcagttctctctccctctctctcctccaccctcagtttcgccctctctrctcttggctcttctgcgtcagcttgcaaatgtgcgtgattccccatctcaggaagacactccctcatccatttctctggtccttcagaagagttgtcaccgtctccagggtttcttctgcggtctcccacacgcactccccacgggctctctcgcccctcctcgccatcttctcaggctcattcctgaccttcacattgccaatctcatggccaactgtcattgatggatctctcagcagcgtctggcagccgtgaggggtttatgcatcctcccttgaatccaaacggctgcagaatgt

SEQ ID NO: 168927 - DNA, 601 bp, Human
aaacggctgcagaatgtggacgccctcaccccgctcgccgcagaatgtggacaccctcaccccgctcgtcctctctttaatatacatgctgagcacgggccggatgaggtgcctggtctgtagggagggctgacagtctagtggagggaaatgtggtggaaaccagttaaaatatggaggtgagcacagacccctagagagggacaggcaggtgacaccagcgttgagtcagcgttgagagggcaggagccagccaggcagagaagggggaaggaggaacagcgagggcaaatgctgaaasgcctggcagagcagagacgaggctgtcgcccctgctggggtgtacgcttggagggcgagaactgcatctgtcatagccccaggactagattgcttccaggcatctccttagggccccaactatggatggacgtggcgggaactgcactgatcggtcgtccttctagccacggttcttcaggtgtcccatctggcctttagggccctgctcaaatatcacctccctgtgaagccttcctggattctcccaagcttgcgctcccctccctgcttcccttgggctctgtggggatgactgaca

SEQ ID NO: 168928 - DNA, 601 bp, Human
gacagtctagtggagggaaatgtggtggaaaccagttaaaatatggaggtgagcacagacccctagagagggacaggcaggtgacaccagcgttgagtcagcgttgagagggcaggagccagccaggcagagaagggggaaggaggaacagcgagggcaaatgctgaaacgcctggcagagcagagacgaggctgtcgcccctgctggggtgtacgcttggagggcgagaactgcatctgtcatagccccaggactagattgcttccaggcatctccttagggccccaactatggatggaygtggcgggaactgcactgatcggtcgtccttctagccacggttcttcaggtgtcccatctggcctttagggccctgctcaaatatcacctccctgtgaagccttcctggattctcccaagcttgcgctcccctccctgcttcccttgggctctgtggggatgactgacagagttctcaaaacagggagctttccccttctgtgcctttcttctctagaaggtgaggcagggcctgggaccagattatttccctgatgacctggaatttgcacagcaggagagaaaccaaacaacctcagg

SEQ ID NO: 168929 - DNA, 601 bp, Human
gaagccttcctggattctcccaagcttgcgctcccctccctgcttcccttgggctctgtggggatgactgacagagttctcaaaacagggagctttccccttctgtgcctttcttctctagaaggtgaggcagggcctgggaccagattatttccctgatgacctggaatttgcacagcaggagagaaaccaaacaacctcaggcatgcagggactggcagggcgggggcaggcactggggtgaggaaaagcagacagaactggatggttaaccctgccctttttttttttttttttttttgagacaaagtcttactctgtcacctaggttggagtacagtagcacgatcccaactcactgcaacctccacaatcggggtcaaccgattctcctgcctcagcctcccaagtagctgagattacaggcatccaccaccatgcctggctaattttttttgtatttttagtagagatgggtctcaccatgttggccaggctggtctcaaactcctgacctcaagtcatccacccgcctctgcctcccaaagtgccgggattacagccatgagccatcacgcccggccaatcctgcccttcttat

SEQ ID NO: 168930 - DNA, 601 bp, Human
cggcttcagccgttttcctcacttgaccctgggggaagacaaggccctgttcctgtgaaggggggcccttggcagcctgactcatttctcaaagtgtgaccgctcccttcttccctcagcctttccccaggaggcaggatggatgcctgcaccaggacaagggcaggaaggctgggttcagcttgtggggagagggctcggcagcccccttttcagggagtgagctccctgtgcacaggggtgtgcaagcggaggtgccagccaaggacgctcaggaggggatgattctcctttctacccsccgtgctgcctgggcctctctgactatcagacttgctgtctactcccctcgaagcctttcctgaccctctccctgggtctgggggagagacgtgcacccaacaactgaaccaacaaataggaaagaagttatattgtgatgttaccaagaaaattaattgaggcactggagaataccttagatctggagtctggtctggagggcttctctggggaggtgtcttttgtgttgagatgtgcgtgttgaggagccagctgaaggaagatctggagaaatacaggcatcccaggcagaggaaag

SEQ ID NO: 168931 - DNA, 601 bp, Human
ttcctcacttgaccctgggggaagacaaggccctgttcctgtgaaggggggcccttggcagcctgactcatttctcaaagtgtgaccgctcccttcttccctcagcctttccccaggaggcaggatggatgcctgcaccaggacaagggcaggaaggctgggttcagcttgtggggagagggctcggcagcccccttttcagggagtgagctccctgtgcacaggggtgtgcaagcggaggtgccagccaaggacgctcaggaggggatgattctcctttctaccccccgtgctgcctggscctctctgactatcagacttgctgtctactcccctcgaagcctttcctgaccctctccctgggtctgggggagagacgtgcacccaacaactgaaccaacaaataggaaagaagttatattgtgatgttaccaagaaaattaattgaggcactggagaataccttagatctggagtctggtctggagggcttctctggggaggtgtcttttgtgttgagatgtgcgtgttgaggagccagctgaaggaagatctggagaaatacaggcatcccaggcagaggaaagagccgagtgtgaat

SEQ ID NO: 168932 - DNA, 601 bp, Human
cctgtgaaggggggcccttggcagcctgactcatttctcaaagtgtgaccgctcccttcttccctcagcctttccccaggaggcaggatggatgcctgcaccaggacaagggcaggaaggctgggttcagcttgtggggagagggctcggcagcccccttttcagggagtgagctccctgtgcacaggggtgtgcaagcggaggtgccagccaaggacgctcaggaggggatgattctcctttctaccccccgtgctgcctgggcctctctgactatcagacttgctgtctactcccctcraagcctttcctgaccctctccctgggtctgggggagagacgtgcacccaacaactgaaccaacaaataggaaagaagttatattgtgatgttaccaagaaaattaattgaggcactggagaataccttagatctggagtctggtctggagggcttctctggggaggtgtcttttgtgttgagatgtgcgtgttgaggagccagctgaaggaagatctggagaaatacaggcatcccaggcagaggaaagagccgagtgtgaatgccctgaggcagggatgaactcaggagggcttgggag

SEQ ID NO: 168933 - DNA, 601 bp, Human
gtccctgaaggtgtctgggagtcactatatcccagcagcgttcagagggcaaagaggagttcgctcccattgaagatgaagaaggtaggaaggcaggtgcagagttgtcagacagcctgaggacaccacccactctcagccctctgtggtggctgcatagggtggggagggggacagatgagatcagggtaggccacaaagggcttggtgcttctggggtctctgtttctatgtgtctctgaatccagtagccaaggatcctgaaatccaagattctgagattccttctgatttgtttttmtgagtttgacatagatctccaccaagcgccatctggaatccgtttttaaaaaagactcgggattggattttaaagagggcggaaaaaaaccaaagaggcttggcaggtttaccttgatgcctttttttagcgtttgctttagctcgagggaagcttgttttccctctgcttgctggtgacctgggtcctcccttggccatcaccctccatcctcccctgtttctgggcctctggctctgcctctgaagacctgtctcccttccccacagcagatccgcttgttggatgaattttccccag

SEQ ID NO: 168934 - DNA, 601 bp, Human
aaaagactcgggattggattttaaagagggcggaaaaaaaccaaagaggcttggcaggtttaccttgatgcctttttttagcgtttgctttagctcgagggaagcttgttttccctctgcttgctggtgacctgggtcctcccttggccatcaccctccatcctcccctgtttctgggcctctggctctgcctctgaagacctgtctcccttccccacagcagatccgcttgttggatgaattttccccagtgtctcggctgctgtggccagtgtggaatttcattctggtttcatttccrgttctccagtgtctccttgtggctgctctgtgtgccccttgctgtccctgcagatctggccttagcaagtgactcagggatgctgcctggcacagggcaccagctttggatccagagagactcaggttcaagcctcaactccactcctgcccagctgcgagacctgtgcaggtccctagaagcggctctgaaatgggaataagaatattgagctggtggagtgaagagcatacatttctgggcacacagcaggccctgggcaagtctctgctcctcctcccatgtactgtgagtggctga

SEQ ID NO: 168935 - DNA, 601 bp, Human
attggattttaaagagggcggaaaaaaaccaaagaggcttggcaggtttaccttgatgcctttttttagcgtttgctttagctcgagggaagcttgttttccctctgcttgctggtgacctgggtcctcccttggccatcaccctccatcctcccctgtttctgggcctctggctctgcctctgaagacctgtctcccttccccacagcagatccgcttgttggatgaattttccccagtgtctcggctgctgtggccagtgtggaatttcattctggtttcatttccggttctccagtgkctccttgtggctgctctgtgtgccccttgctgtccctgcagatctggccttagcaagtgactcagggatgctgcctggcacagggcaccagctttggatccagagagactcaggttcaagcctcaactccactcctgcccagctgcgagacctgtgcaggtccctagaagcggctctgaaatgggaataagaatattgagctggtggagtgaagagcatacatttctgggcacacagcaggccctgggcaagtctctgctcctcctcccatgtactgtgagtggctgaggggcagaaacc

SEQ ID NO: 168936 - DNA, 601 bp, Human
atccgcttgttggatgaattttccccagtgtctcggctgctgtggccagtgtggaatttcattctggtttcatttccggttctccagtgtctccttgtggctgctctgtgtgccccttgctgtccctgcagatctggccttagcaagtgactcagggatgctgcctggcacagggcaccagctttggatccagagagactcaggttcaagcctcaactccactcctgcccagctgcgagacctgtgcaggtccctagaagcggctctgaaatgggaataagaatattgagctggtggagtsaagagcatacatttctgggcacacagcaggccctgggcaagtctctgctcctcctcccatgtactgtgagtggctgaggggcagaaacctgaggcttgtgtcgtgctttgggggagctcccactcagggtggggtacagctgctaaatggagaagttaaacccttgacacagagggcagctgacagccctgcagggggttcaggagactgtaagggactgcttctgtatcctcagtgatgttccttcccttccctgagcctcagtttccccacttgtggaccagcaggctgcaagggatg

SEQ ID NO: 168937 - DNA, 601 bp, Human
ggccttagcaagtgactcagggatgctgcctggcacagggcaccagctttggatccagagagactcaggttcaagcctcaactccactcctgcccagctgcgagacctgtgcaggtccctagaagcggctctgaaatgggaataagaatattgagctggtggagtgaagagcatacatttctgggcacacagcaggccctgggcaagtctctgctcctcctcccatgtactgtgagtggctgaggggcagaaacctgaggcttgtgtcgtgctttgggggagctcccactcagggtggggkacagctgctaaatggagaagttaaacccttgacacagagggcagctgacagccctgcagggggttcaggagactgtaagggactgcttctgtatcctcagtgatgttccttcccttccctgagcctcagtttccccacttgtggaccagcaggctgcaagggatgtggcatttgcaggcgacggctctgctccccattatcatcattgagcctaaaccccacgacttcctcccccatctgctctttttcttttttttttctttttcacacctggctaatttttgtatttttaatagagac

SEQ ID NO: 168938 - DNA, 601 bp, Human
gcaccagctttggatccagagagactcaggttcaagcctcaactccactcctgcccagctgcgagacctgtgcaggtccctagaagcggctctgaaatgggaataagaatattgagctggtggagtgaagagcatacatttctgggcacacagcaggccctgggcaagtctctgctcctcctcccatgtactgtgagtggctgaggggcagaaacctgaggcttgtgtcgtgctttgggggagctcccactcagggtggggtacagctgctaaatggagaagttaaacccttgacacagasggcagctgacagccctgcagggggttcaggagactgtaagggactgcttctgtatcctcagtgatgttccttcccttccctgagcctcagtttccccacttgtggaccagcaggctgcaagggatgtggcatttgcaggcgacggctctgctccccattatcatcattgagcctaaaccccacgacttcctcccccatctgctctttttcttttttttttctttttcacacctggctaatttttgtatttttaatagagacaggatttcatcatgttggtcaggctggtctcaagcaatc

SEQ ID NO: 168939 - DNA, 601 bp, Human
ccagctgcgagacctgtgcaggtccctagaagcggctctgaaatgggaataagaatattgagctggtggagtgaagagcatacatttctgggcacacagcaggccctgggcaagtctctgctcctcctcccatgtactgtgagtggctgaggggcagaaacctgaggcttgtgtcgtgctttgggggagctcccactcagggtggggtacagctgctaaatggagaagttaaacccttgacacagagggcagctgacagccctgcagggggttcaggagactgtaagggactgcttctgtrtcctcagtgatgttccttcccttccctgagcctcagtttccccacttgtggaccagcaggctgcaagggatgtggcatttgcaggcgacggctctgctccccattatcatcattgagcctaaaccccacgacttcctcccccatctgctctttttcttttttttttctttttcacacctggctaatttttgtatttttaatagagacaggatttcatcatgttggtcaggctggtctcaagcaatctgcccaccttagcctcccaaagtgttgggattacaggcgtgagccaccgcgctc

SEQ ID NO: 168940 - DNA, 601 bp, Human
acggccccgcccagtccctccgaagctattctgttcttgctctgcaccctcttggggacacatcctctccagcactttcctcctggcttctctgaggactgcctgcctctgtctcccaagagagcccagtcttaatggttcctcctctgctgtccccagggcccaggcttctgcctgcctgtttcccctcccacctcctctctgtcttcagggagcctgatattgttctgtttttggaaggagatccacacttattttcagcgctggcagcagtggggtctcctccagcccccggaagcaygtgtctgttagtaagtgttcgagaggggccttcctggtgttattcctcttttctggggccttgagagaggaaatgaacgttatgcagcccctatggggcttccaaagctctgctctgggtacttgctctaattctcccatctgccccagaggggatgttaatttttacagaggaccaatctgaggctcggagaggttaagtcacttgcctgaggctacccagcataagcagcaggccttggatttgaattggcgggtctgtatgattcctcagtgtctgaagtctctttctgatcaggag

SEQ ID NO: 168941 - DNA, 601 bp, Human
cacatctcccagtgttcagagtctgccttgcttgtcttggtttgtcagtagctcaggagcccctttgacaatggctctgtcctgacttcacaggcgctccccactgtgcctctgagcaccagacttgagactgaatcgagtcgcctgatccccagtcacactgaagctaccctcccggccttcctccctgctggtcctctgcctgatcccttgggtctctgggagtaaattccatcccttcttcagggcccacctccagaggctgagagtcagcttggccaggtggaaaagaacacaggtstgggaatcaggagacctgggttcaacttcagcctgtgctgctgacaacagtgccaccttctctttctgagccttagtttttctactctgccaattgggaacactacaaatagccctctccactctaggggtgatggtgaggctgcagagcctgtgggaggcagagctgtgggccccgatgccctcacgggtctgaagtctcatggtcatggggttttcccaaatcaggactggcaaatggtggctcacgggccaccactgcccacctctgtgcccatggctgaaccatgggctgaacaca

SEQ ID NO: 168942 - DNA, 601 bp, Human
tttttgttttgttttgttttgagacggatctctgtcgcccaggctggagtgcagtggcgaatctcggctcactgcaacctctacctcccaggttcaagcaattctcctgcctcagcctcctgagtagctgggaccacaggcacgtgccaccacgcccagctaattttctttatttttagtggagatggggtttcaccgtgttagccaggatggtctcaatctcctgacctcatgatccacccgcctcggcctcccaaagtactgggattacaggtgtgagccaccgcgcctggcctatacscagctaattttggtattttttgtagagatgcggttttacaatgttgcccacgctggttgttcctttttatggctgaaaaattgtccaatttatgaatgtaccacactttgtgtccccattcatctgctgtgcacatttaggtcagaatcccccttaacacacaacatcctaacccagaggtctctaaccatttttttttttttttgagacaatgtcccgctctgtcggctggagtgcagtgacacaatctcagctcacggcaacctccacctcccaggttcaagccattctcctgtcaca

SEQ ID NO: 168943 - DNA, 601 bp, Human
ctcccaggttcaagccattctcctgtcacaggcttccgagtagctgggattacagttgtgtgccaccacgcccagctaattttttgtatttttagtatagagacagggtttcaccgtgttggccaggctagtctcgaactcctgacctcaagtgatctacccatcttggtctcccaaagtgctgggattacaggcatgaaccaccgcacctggccggtctctaaacttttaatcgtgctcctttcaggaaaaatgtttgcaccaatcctcccattcaatgtagatttattggtttcatatrtgctactactgtactaatatatcctgtgcattataaaatccatgtaaactatagacatcttacagagataagataatattaagaatgcttctcatatttttcacatacctgtcctggaatcattacccatcctgggcatcacccaggaagaaaatatgctcaactcacattgaaattgtagtttctgaggccgggcgtggtggctgactcctataatcccagcactttgggaggccgaggtgggcagatcacctgaggtcgggagtttgagaccagcctgaccaacatggaggaacccca

SEQ ID NO: 168944 - DNA, 601 bp, Human
atgcccagccaaaaagcgtgaactttagagtcaggtaccctgggtttgaagccaggttctgtcactgaccagttgtgtgactttgggtgtgttaacaatagctgagccttaactgtcttatctgcaaaatgctgatggtgcaggatgtattggcaagctattgctgcacaacaaattgccctacaacataaggcttataacaagaaatatttgttatctgacagtttctgtgggtgaggaatctgctaagcttggtgccactgcctcagggtctctcacaaggctataatcacagcatcakgtagggctgtggtttcatctgaaggctcaactgagggtagatccattcttttttttttttttttttttttttgagacggagtctcactctgttgcctaagctggagtgcagtggggttgatcttggcacactgcaacctccacctcctgggttcaagcgattctcctgcttcagcctccaaagtagctgggaccacaggcacgtgccaccacacccagctaatgttttgtatttttagtagagacaggatttcaccatgttaaccaggatggtcttgatctcctgacctcgtgatttgct

SEQ ID NO: 168945 - DNA, 601 bp, Human
ggctaaagaccctcagttccttgccatgcagtctttccaaagggtagtccaaaacacaacagctttcatcagagcaaccagggagtgggggagaagaggacgagcaagatggaggcagaaatcctttgtcacttactcccagaagtgatatcccatcacttcttgccatatcctgtagtggggtcagtgagatagcatgtgtaatatacccttgggatcatgcagggtgccctgtatctggcaggattgtgtctattgttattttctatttaatacacacacacacacacacacacacacatagatagatttttttttttttgagagtgtcttgctctgttgcccaggctagagtgcagtggcttaatcttggctcactgcaacctccacctcccaggttcaagtgattctcctgcctcagcctcccgagtagctgggattacaggcatccgccaccatgcccagctaatttttgtattttagtaaagacggggtttcaccatgttggccaggctggtctcaaactcctgacctcgtgatccacccgcctctgcctcccaaagtgctgggattacaggcgtgagcgaccacgcctggcccg

SEQ ID NO: 168946 - DNA, 601 bp, Human
ctctctgtcacccaggctggagtgcagtggcatgatcacggttcactacaacctccacctcctgggctcaagagatcctccccctcatcttccctggtacctgagactacaggcacgcaccaccatacctgggtaatttttttattttttagtaggggcggggttttgccatgttgcccaggctggtctccaactgctgagctcaagtgatcctcctaccttggcctcccaaagtgctgggattacaggcatgagccaccacccccagcccactgttattttttcattcatcactccatcyacttgccaggcctgggtaggggcctgagaccccagaccagcccacagctctgcagagggaaggagaacacaagatggggcccggcacatgccagcatctggaggagtcagcctgggggtgggggctgggcaggtccacagcccaggagggcctgtggctccttgttctttgagagtcggtccagtcccaggatatcttggtgtcagggcccaggaagacctttaggacctggctgaggggtgttggaaggggccacatctatggtcagagagtcctcagtgcctgtggctgaggaaggaa

SEQ ID NO: 168947 - DNA, 601 bp, Human; identical to SEQ ID NO: 30916

SEQ ID NO: 168948 - DNA, 601 bp, Human; identical to SEQ ID NO: 30917

SEQ ID NO: 168949 - DNA, 601 bp, Human; identical to SEQ ID NO: 30918

SEQ ID NO: 168950 - DNA, 601 bp, Human; identical to SEQ ID NO: 30919

SEQ ID NO: 168951 - DNA, 601 bp, Human; identical to SEQ ID NO: 30920

SEQ ID NO: 168952 - DNA, 601 bp, Human; identical to SEQ ID NO: 30921

SEQ ID NO: 168953 - DNA, 601 bp, Human; identical to SEQ ID NO: 30922

SEQ ID NO: 168954 - DNA, 601 bp, Human; identical to SEQ ID NO: 30923

SEQ ID NO: 168955 - DNA, 601 bp, Human; identical to SEQ ID NO: 30924

SEQ ID NO: 168956 - DNA, 601 bp, Human; identical to SEQ ID NO: 30925

SEQ ID NO: 168957 - DNA, 601 bp, Human; identical to SEQ ID NO: 30926

SEQ ID NO: 168958 - DNA, 601 bp, Human; identical to SEQ ID NO: 30927

SEQ ID NO: 168959 - DNA, 601 bp, Human; identical to SEQ ID NO: 30928

SEQ ID NO: 168960 - DNA, 601 bp, Human; identical to SEQ ID NO: 30929

SEQ ID NO: 168961 - DNA, 601 bp, Human; identical to SEQ ID NO: 30930

SEQ ID NO: 168962 - DNA, 601 bp, Human; identical to SEQ ID NO: 30931

SEQ ID NO: 168963 - DNA, 601 bp, Human; identical to SEQ ID NO: 30932

SEQ ID NO: 168964 - DNA, 601 bp, Human; identical to SEQ ID NO: 30933

SEQ ID NO: 168965 - DNA, 601 bp, Human; identical to SEQ ID NO: 30934

SEQ ID NO: 168966 - DNA, 601 bp, Human; identical to SEQ ID NO: 30935

SEQ ID NO: 168967 - DNA, 601 bp, Human; identical to SEQ ID NO: 30936

SEQ ID NO: 168968 - DNA, 601 bp, Human; identical to SEQ ID NO: 30937

SEQ ID NO: 168969 - DNA, 601 bp, Human; identical to SEQ ID NO: 30938

SEQ ID NO: 168970 - DNA, 601 bp, Human; identical to SEQ ID NO: 30939

SEQ ID NO: 168971 - DNA, 601 bp, Human; identical to SEQ ID NO: 30940

SEQ ID NO: 168972 - DNA, 601 bp, Human
ccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcaggtaacggatcccgggctgaggggctgggccgggagggacgggcccgccccagcacgtgccgggctctgttccgggctgggcttagccaccccggagctgcggcccggctattttcrgctgggtgttccctgtcctgaggagctgcggccccaggaaagcaagggcaggagatccgggagccgccacctgttgcctcacgtgttctcagtccgagagggttcgagacgcggaggaggctgggagaaattcagcctgtagtttcagggaattcattttggccatccccgcaggagtacgctgctaaccacagacaccgagcgcttgtttcgtactgttgtgctcattatttcactaatcttttcttgtgtaatccatgaagatcttgcaggcttgatggtgtttttcccacattgcag

SEQ ID NO: 168973 - DNA, 601 bp, Human
gctatgccagcccggagatgtgcttcgtgtttagcgacaggtataaattccggacatggcggcagctgtggctgtggctggcggaggccgagcaggtaacggatcccgggctgaggggctgggccgggagggacgggcccgccccagcacgtgccgggctctgttccgggctgggcttagccaccccggagctgcggcccggctattttcagctgggtgttccctgtcctgaggagctgcggccccaggaaagcaagggcaggagatccgggagccgccacctgttgcctcacgtgttctyagtccgagagggttcgagacgcggaggaggctgggagaaattcagcctgtagtttcagggaattcattttggccatccccgcaggagtacgctgctaaccacagacaccgagcgcttgtttcgtactgttgtgctcattatttcactaatcttttcttgtgtaatccatgaagatcttgcaggcttgatggtgtttttcccacattgcaggggagaacaaagcccggacagcttgttgtttgccctagcccatccagctattaagaacggaactgggatttgaacctgggtgcactccag

SEQ ID NO: 168974 - DNA, 601 bp, Human
tggctgtggctggcggaggccgagcaggtaacggatcccgggctgaggggctgggccgggagggacgggcccgccccagcacgtgccgggctctgttccgggctgggcttagccaccccggagctgcggcccggctattttcagctgggtgttccctgtcctgaggagctgcggccccaggaaagcaagggcaggagatccgggagccgccacctgttgcctcacgtgttctcagtccgagagggttcgagacgcggaggaggctgggagaaattcagcctgtagtttcagggaattcatyttggccatccccgcaggagtacgctgctaaccacagacaccgagcgcttgtttcgtactgttgtgctcattatttcactaatcttttcttgtgtaatccatgaagatcttgcaggcttgatggtgtttttcccacattgcaggggagaacaaagcccggacagcttgttgtttgccctagcccatccagctattaagaacggaactgggatttgaacctgggtgcactccagagcctgagctgagcacgtagccccttggttttccacagtgcctgtgtagttagtgacaggactggaat

SEQ ID NO: 168975 - DNA, 601 bp, Human
ttttttggagacagagttttgctcttgttgcccaggctggagtgcaatggcgcaatctcagctcactgcaacctctgcctcccgagttcaagcgattctcctgcctcagcctccctagtagctgggattataggcgcctgccgccacgcccagctaattttttttatttttagtagagacagggtttcactatgttggccagcctggtctcgaactcctgacctcagacgatctaccctcctcagccccccaaagtgctgggattacaggcgttagccaccacgcctggcaaatttttaaratatttatagggacagtgtttcaccatgctgcccagaatggccttgaactcctgtgttcaaacagtcctcctgccttagcctcccaaagtcctgggattacaggagtgagccagcgtacctggcctagcttgtgctcttaatcagagtatacccatggaggttgaagttagattccagataaacgtccaatttgagaataagccagtaatttttaagttgcctcaaatgctttcttatttttttgagacggagtctcgctctgtctcccaggctggagtctcctgcctcagccttccaag

SEQ ID NO: 168976 - DNA, 601 bp, Human
ttaggtttcacacatttccagtaagtgataagattacttcttgtttatgtgcatatggctttcagctgcttcttgagttctctgttttccacagtaaccttgaggtgaagaatctgaaaacatgatttaaatataagtaatttgggatgcttataaggaatgagcctgatatccactgagagagtaaatctaacagttcatttgggaaacattgggaaatacatatcaagagccttgaaaaatattctttatgatagtaaacattagaaacaatctaaatgggccgggtgtggtggctcaygcctgtaaacccaccattttgggaggtcaaggtgggcagatcccttgaggttaggagttcaccaccagcctggccaatgtggtgaaacgctgtctctactaaaaatacaaacattagccagatttggtagcatgcctgtaatcccagctactcaggaggctgaggcaggagaatcacttgaacccgggacgcggaggttgcagtgagccaagatcgcaccactgcattccagtttgggtgacagagcaagactccgtctcaaaaaaaaaaaaaaagaaaaaaatctaaatgttcaataat

SEQ ID NO: 168977 - DNA, 601 bp, Human
actgcagcctcagcttcccggattcaagtgattctcccacctcagcctcccaagtacctgggattacaggtgtgcaccaccacacttggccagtttttgtattttttgtagaaacagggttttaccatgttggccaggctggtctcaaactcctggcttcaagtgatccacctgcctcggcctcccaaagtgctgggattacaagcgtgagacaccgcacctggcctcgtaattatgttttatgttcagaaacagaccttcagtggcttgatttgggctttttttttttttttttttttttgacatggagtttcgcttttgtcatccaggctggagtgcagtggcacaatcttggctcaccgcagcctccgcctcctgggttcaagtgattctcctgcctcagcttcccgagtagctaggattacaggcatgcaccaccacgcctggctaattttgtatttttagtagagacggggtttctctgtgttggtcaggctggtctcaaactcccgatctcaggtgatccgccctccttggcctcccaaagtgctggaattacaggcatgagccatggcaccctactttgatttaggcttaatgc

SEQ ID NO: 168978 - DNA, 601 bp, Human
tggaaggctgaggcagaaggatcacttgagctccagaggtcgaggctacagtcagctatgttcatgccactgcacttcagcttgggcaacagagcaagacccagtctagaaataataataatttaaaaattgcctcttgatgaagaaagtactatgctaatcgccttttagtttcatactccttgactatttgtaaatgacattgaatctccgtaacgattatttggttaaacattttatctcttgttttatctttaccagttactccctctcttacttaaattgttctccctccaaggggtaatggtggttattaaaagaagcaatgaaaccttgatgatttaaggtctcggtctgagactttcgtgtgttctctttgggttttcaggcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtattctgaaagtgacctgcaggacacagaaactcaatggt

SEQ ID NO: 168979 - DNA, 601 bp, Human
ggttccaccatggctccttctcccaggcatttctattgggctgtggccagacatgggcacgttgcaccatgtatccttcttgagtcaggccattgtcctgagtattagtgaaaagggtggaagaatagtttattccaggagcaagttaccactcaggtccactggttgagtataacttagcataccaataagaccaagcttttctttaggatgtgtttttccttgtttgacagagtcatgttttgaattattattattttataagagtctcccagtgatgcttaggctggccttaacctcytgagttaaagcagtcctcctccgttagcctcctaagtagctgggactacagtcatgcaccactgcaatggctttaaaatattttaacctaagtctctcttgtacttattcctagagctttcatcatcacagggcagacatatacacgaaaagtggatattgaagtactgtctgtgctggctagcttgggggcatcagtgcacaaggtgagtggtggcagcatgtggggtggggacaggagctttgggcaccacagacagactgaattaacctcagacttttacttaaccatctctctcaa

SEQ ID NO: 168980 - DNA, 601 bp, Human
gctggaaggctgtggatgggggctgagagctcattcagcatgcttgcctactcactatcctctgaagtctctctgcctttgcatcttgtcctttttttacatgggcaggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccggtcagtggcacagggacatcacatacaccaagttgagtggaggtstgaaggagggacctagaagtaaaaggacatatttgagcatctctacagtctccttatccccaaggatcccagagtctagcagggaggcaaaaacataaaaaggacagtgtgataagtgttacaattggagtgtgtactgggtactgtggagcaaagaggaaggaatagtgtttgaggagtcagaaagcttcacagtagaggtgatgccttaagacttaagaaatacatgcatcttttaaagacaagatcgggagcattataaaggcacaaagcaggagaaaacacacttgagggagttac

SEQ ID NO: 168981 - DNA, 601 bp, Human
gagtgcacgtttggtcctgctctcttctccgtgaaggagagcagatgaaggtgtttatgtcattaccttcagtcacagtaatggtacagagcagtggccataatctgccatctatggagggtgattttggtgaactgaatttgttaaagtgaattacttaatcacttgtaggaaaagtccactcctagtgaaggaatgaggtctgacattctgtaggaaatgagcaggaaacgagcaaatgattcatgaggctttacagaagagggccagagcaaggtgggcatccatttcaggcttgtcmtaagatgtgggcagagagttgagaagaccctggtacagatagacacaggaaccacctcagcctagaggggttttgtgtagagctgtgtagactgcatggatgggaagtatctgatgactttttaaaagtgttcaaacgccctgttagtagggaactgacaatacttcactgtcttcccaggattgccatgagaaaatcagagtgctttctcagcaggcagcttctgtggttaagcaggaagggggtgacaatgacctcatagagcgtatccaggttgatgcctacttcagtcccattcac

SEQ ID NO: 168982 - DNA, 601 bp, Human
tccgctatgaaggcggtgagcgcgccgggagcccgggcggctggccgggggggcctggcgttggggagggacggggatggccgcgggcggcgttcccctcccggccatgggcgacccggcgacccggctgggcgtggccgcccgcccgcccttagcccgcgcttcccgctcccgctgggcgccccgccacttcctgaggctgggcccagggtgggggatccgggagggtgcagttcgggatcgcgaaggcagccccggaaggggggcgggccggtcggggtcgccacatcttagttcggarcccggccgggggcagagggtgccctaggggacgcgaaggagccgcattcctcctagagcgtttcaccggacccgggggctccccctctcgtcttcctccgttccccaacttggaataaagaatcacctagtaagtggcgccctgtctcagctggttttctctgccacgacctgaagtctgcaattccgatctgttttgctctgctcgttcgaattgttctggttccatcttcccacgcctgggggtctggctttgtgtgcgaagacccctttcctgcagtctaggcgtggacgggggcgg

SEQ ID NO: 168983 - DNA, 601 bp, Human
cagtctaggcgtggacgggggcgggagagtgggcggagggtgtggggccccactccacagccccaggtttgctgctgcgctgtctgcttggagattaaaatgaaacgtgacttctaggtgagacgaatctgtgtgtctttgcattcctgagaccctcataaatcgattctgcagcttctccggtggatgagtcgtgcccagccacaccctagcaaaataccgtgggtcacacaccacctgcatttctgagttccggttaccatctcactctctctccacgttattttacgttttctgtaartgaatatttcctctccctgcgtcaaggtcacacagtggtagaacaactgcgaccaccaacctatgttcagtgtacaacctcctgagacctgggaggatccccttgaactccgccttagacttatacattcagaaattcgggcggtgagactcagacatctgcattgtaaccagctctcacaggcgatttttagctggcttaagtctgagaattactgcccatgattatagtaaatgtatcctttgctggccttttggagggagttccgaaaaaaaactgccaatacagaggctccctaaa

SEQ ID NO: 168984 - DNA, 601 bp, Human
gacgaatctgtgtgtctttgcattcctgagaccctcataaatcgattctgcagcttctccggtggatgagtcgtgcccagccacaccctagcaaaataccgtgggtcacacaccacctgcatttctgagttccggttaccatctcactctctctccacgttattttacgttttctgtaaatgaatatttcctctccctgcgtcaaggtcacacagtggtagaacaactgcgaccaccaacctatgttcagtgtacaacctcctgagacctgggaggatccccttgaactccgccttagacytatacattcagaaattcgggcggtgagactcagacatctgcattgtaaccagctctcacaggcgatttttagctggcttaagtctgagaattactgcccatgattatagtaaatgtatcctttgctggccttttggagggagttccgaaaaaaaactgccaatacagaggctccctaaaatcttaagtcatttggaaagctcatttgaaggcttttgatgttaatatcagatgaaatatgtagttggggccaatatttaggattgttcaggtaagaaaggtgcttgaagagttgcctttc

SEQ ID NO: 168985 - DNA, 601 bp, Human
cgttttctgtaaatgaatatttcctctccctgcgtcaaggtcacacagtggtagaacaactgcgaccaccaacctatgttcagtgtacaacctcctgagacctgggaggatccccttgaactccgccttagacttatacattcagaaattcgggcggtgagactcagacatctgcattgtaaccagctctcacaggcgatttttagctggcttaagtctgagaattactgcccatgattatagtaaatgtatcctttgctggccttttggagggagttccgaaaaaaaactgccaatacaraggctccctaaaatcttaagtcatttggaaagctcatttgaaggcttttgatgttaatatcagatgaaatatgtagttggggccaatatttaggattgttcaggtaagaaaggtgcttgaagagttgcctttcctctggtgtccttgttacacacataactgggtgtgtttggaaaccagcaacaccgttgcccgtatgttgatttgttggtgatcttgacttgagcactattagcatgctgttgtggtgaggcaggttttcttccagaccgggggacggtctaggtctggaggctgaac

SEQ ID NO: 168986 - DNA, 601 bp, Human
gaaagctcatttgaaggcttttgatgttaatatcagatgaaatatgtagttggggccaatatttaggattgttcaggtaagaaaggtgcttgaagagttgcctttcctctggtgtccttgttacacacataactgggtgtgtttggaaaccagcaacaccgttgcccgtatgttgatttgttggtgatcttgacttgagcactattagcatgctgttgtggtgaggcaggttttcttccagaccgggggacggtctaggtctggaggctgaactttatgtaattcagggggtcctttaaargaaaatctaaaatatagttttgcatattttacaaaaatgggactgacgaatgcatttccttggaagggaccctgaaccttaattttctgtgggataaagctgcctctgtccacagcaggtcacacttaagcccctcctccccagtaactgagtggtgctgggattatgcaggctgaggcctctccacacattttcatgaagtggttgctcaccctctaagtgagacgtaaagactgcagtgttcggagccctttgggaaataaatgtggtgaaaagaaaggagggacgaggtttaaagga

SEQ ID NO: 168987 - DNA, 601 bp, Human
aagaatggagagatgttaccagaacgaaatctagtttgagcagagaaaaagactggctttctagtaggcttgtaaaatgctttcctgcagcaagctacttgtgtccatagatcttctctggagggttaaggtagccttttgtaaaccaaaggaatctataatatctatatttgaaataattaatgagttggaaaagccacccagcgtagaagagtcaatccaagctttaattctgccatctcagaatggtgataaaccatttctcccccatcatctaaatggaatatattgtgcttatagrtattttctttaaaagaaaaaaaagaatatattggaagggactggcaggggtcactttccctgctaacttggtgtttgtagattaaattcttaatgttactgggatgactcagtctctatgttattaatctcatcagccttaactaaggcttttggaaagggtgtaagtttcagtaaccctctgggtttacctgggctttcttcagggctggggaagggcaggtaagtagcctgctgtagggaggatggagcaggacacatgtgttaaggatatattctgatgccaccagtctgtaacctt

SEQ ID NO: 168988 - DNA, 601 bp, Human; identical to SEQ ID NO: 110698

SEQ ID NO: 168989 - DNA, 601 bp, Human; identical to SEQ ID NO: 110699

SEQ ID NO: 168990 - DNA, 601 bp, Human; identical to SEQ ID NO: 110700

SEQ ID NO: 168991 - DNA, 601 bp, Human; identical to SEQ ID NO: 110701

SEQ ID NO: 168992 - DNA, 601 bp, Human; identical to SEQ ID NO: 110702

SEQ ID NO: 168993 - DNA, 601 bp, Human; identical to SEQ ID NO: 110703

SEQ ID NO: 168994 - DNA, 601 bp, Human; identical to SEQ ID NO: 110704

SEQ ID NO: 168995 - DNA, 601 bp, Human; identical to SEQ ID NO: 110705

SEQ ID NO: 168996 - DNA, 601 bp, Human; identical to SEQ ID NO: 110706

SEQ ID NO: 168997 - DNA, 601 bp, Human; identical to SEQ ID NO: 110707

SEQ ID NO: 168998 - DNA, 601 bp, Human; identical to SEQ ID NO: 110708

SEQ ID NO: 168999 - DNA, 601 bp, Human; identical to SEQ ID NO: 110709

SEQ ID NO: 169000 - DNA, 601 bp, Human
gggcagcctgaggggcagcaggacagagtgttctcaggtatccaatgtggaattaaggtataagtaactgcaagacagtccttgagggacttgataaacattaattcaagtggcttcatagcaatcctgccgaaaacaccaacatccccactttacagaaaaggaaactgaggctgacggaggttcagcaactcatccagggtcactgagtgaggggcagcaggctgactctgagacccatgctccttttacggcctctgggtgtttgccacacaaatggttttaccaccaatccattctrtcccttccccaatcttgatatttttatctggaaaacaaagggctcataaaagatgatcttcccagagccctttgagcctcaacattatgtgggtcacatgcagaaattgcttgaaacataggctaggggttaaggagcaacacttactgcatgttcgtcaagtgctagacacttcacaaccacggaatcttttttttttgtagacggagtctcgctctgtcacccaggttggagtgcagtagcgtgatctcggctcactgcaacctctgtctcccgggttcaattgattctcctgcctca

SEQ ID NO: 169001 - DNA, 601 bp, Human
ggccagaagggctgctgctggccctactagtgactctggagagatatggggcagcctgaggggcagcaggacagagtgttctcaggtatccaatgtggaattaaggtataagtaactgcaagacagtccttgagggacttgataaacattaattcaagtggcttcatagcaatcctgccgaaaacaccaacatccccactttacagaaaaggaaactgaggctgacggaggttcagcaactcatccagggtcactgagtgaggggcagcaggctgactctgagacccatgctccttttacrgcctctgggtgtttgccacacaaatggttttaccaccaatccattctatcccttccccaatcttgatatttttatctggaaaacaaagggctcataaaagatgatcttcccagagccctttgagcctcaacattatgtgggtcacatgcagaaattgcttgaaacataggctaggggttaaggagcaacacttactgcatgttcgtcaagtgctagacacttcacaaccacggaatcttttttttttgtagacggagtctcgctctgtcacccaggttggagtgcagtagcgtgatctcg

SEQ ID NO: 169002 - DNA, 601 bp, Human
ggagtcttactctgttgcccaggctggagtgcaatggcacgatctcggctcactgcaacttccacctcccaggttcaagggattctcctgcctcagcctccggagtagttgggactatagacatgtgtcaccatgcctggctaattttttttttttttcttgagacgaagtctcgctcttgttccccaggctggagtgcaatggtacgatctcagctcactgcaacctccgccccccgggttcaagtgattctcctgtctcagtctcccaagtagctgggattacaggcatctgccaccaygcccaactaatttttgtatttttagtagagacagggtttcaccacgttggccaggtcgaactcctgacctcaggtgatctgcccgcctcggcctcccaaagtgctgggattacaggtgtgagccaacgcacccggcatgtttttttgttttgttttgttttgttttgtttttttgatacggagtctccctctgttgcccaggctggagtgcagtggcgcgatcttggctcactgcaacctccagctccccagttcaagcgattctcctgcctcagcctccagaatagctgggaatacagg

SEQ ID NO: 169003 - DNA, 601 bp, Human
ggctggagtgcagtgacacaatcatggctcactgcatcctctatctcccagactcaaatgatcctcccacttcagcctcccaagtagctgagaccacaggtgagcaccaccacgtctggctaatttttgttgttgtttgagatggagtcttactctgttgcccaggctggagtgcaatggcacgatctcggctcactgcaacttccacctcccaggttcaagggattctcctgcctcagcctccggagtagttgggactatagacatgtgtcaccatgcctggctaattttttttttttttcttgagacgaagtctcgctcttgttccccaggctggagtgcaatggtacgatctcagctcactgcaacctccgccccccgggttcaagtgattctcctgtctcagtctcccaagtagctgggattacaggcatctgccaccacgcccaactaatttttgtatttttagtagagacagggtttcaccacgttggccaggtcgaactcctgacctcaggtgatctgcccgcctcggcctcccaaagtgctgggattacaggtgtgagccaacgcacccggcatgtttttttgttttgttttg

SEQ ID NO: 169004 - DNA, 601 bp, Human
tcttgcatgaaaatgatgaaagctgaaaagtatgaaacaaaagaaatggtagaccttaggctgggcgtggtggctcacgcctgtaatcccagcactttgggaagccgaggcgggtggatcacaaggtcaggagttcaagaccagcctggccaagatggtgaaaccccgtctgtactaaaaatacaaaaaattagctgggtgcggtggcaggcgcctgtaatcccagctacttgggaggctgaggcaggagaatcgcttgaactcagagggcagaggttgcagtgagccgaaatcgcgccastgcactccagcctggctgacagaatgagactccgtctcaaaaaaaaaaaaaaaggtagaccttgacccagagtgacttcactcagggatcaggggtcctttccatccttaacaccaacagcagaactagtgcttatgagcacaagctctggacaaatccaggttttgatcctagctcagcttcatctttcttttttcttctattttttttttcttttttcgagacagggtctcactctgtcacccaggctggagtgcagtgacacaatcatggctcactgcatcctctatctcccagact

SEQ ID NO: 169005 - DNA, 601 bp, Human
tttttttgtatttttttgagatggagtttcactctgttgcccaggctggagtgcagtggcgtaatctcagctcactgcaacctccacctcctgggttcaagcgattctcttgcctcagcctcctgagtagctgggactacaggtgcgtgctaccacacccggctaatttttgtatgttttagtagagacggggtttcaccatgttggtcaggctggtctcgaactcctgacctcaagtgatctgcctgacttggcctcccaaagtgatgggattacaggcatgatccaccatgcccggccraacccaggagtttgagaccagcctgggaaacatagcaagacctcatctctactaaaaattaaaaacaaaaaaaaacactatactttttggcttattatgtgctttgtttattgtcagtctctaaactggaggcagccctagcggggcagaatccttgtctgttctgttgtatccctgctgtatcccctatgcttggagcagtgctgggcacatggtgagaatgcagtccaagtttgagaaatgaatgaaagaggagctaagacattcttgcatgaaaatgatgaaagctgaaaagtatga

SEQ ID NO: 169006 - DNA, 601 bp, Human
gaggcgggcagattgctggagctcaggagttcacgactagcctgggcaacatggcaaaaccccatttccacttaaaaaaagatacaaaatattagccaggagtggtgatgtgtgcctgtagtcccagctactcgagagactgaggcagaactgcttgaatccaggaggcggaggctgcagtgagccaagatcacgccactgcacgccagcctggatgacagagtgagactccatcttcacaaaaaaaaaaaaaaaaaaaaaaaaaagaaagaaaaagaaagaaagaaaaagaaaagaaaakaaattacttgtcccaaactgttaatactgcttacctgggaaagaggaataggagatggctaaatttttctttattcattgtaattttttataaagattttaaagtgtgttaagcatttctgaattcatgaactctctcgatcattgtacatgcatctgcttcattagcaaaaagacaattatcagcctggtgcggtggctcatgcctgtaatcccagcactttgggaggccgaggcgggcggattgcctgaggtcaggagtttgaggctagcctggccaacatggtgaaactcagtctct

SEQ ID NO: 169007 - DNA, 601 bp, Human
ggctgggcatggtggctcatgcctgtaatcctagcattttgggaggctgaggcgggcagattgctggagctcaggagttcacgactagcctgggcaacatggcaaaaccccatttccacttaaaaaaagatacaaaatattagccaggagtggtgatgtgtgcctgtagtcccagctactcgagagactgaggcagaactgcttgaatccaggaggcggaggctgcagtgagccaagatcacgccactgcacgccagcctggatgacagagtgagactccatcttcacaaaaaaaaaaaaraaaaaaaaaaaaagaaagaaaaagaaagaaagaaaaagaaaagaaaataaattacttgtcccaaactgttaatactgcttacctgggaaagaggaataggagatggctaaatttttctttattcattgtaattttttataaagattttaaagtgtgttaagcatttctgaattcatgaactctctcgatcattgtacatgcatctgcttcattagcaaaaagacaattatcagcctggtgcggtggctcatgcctgtaatcccagcactttgggaggccgaggcgggcggattgcctgag

SEQ ID NO: 169008 - DNA, 601 bp, Human
ggagggtctgctgccagctcctactggaccagaactgcactcccatcctaaacacatacccaaggtcccagcaggaggcaggggtgcttattttgagactaccaatcttcccgctccacagccttggtgcagcttgcagccaggcctgaaaaggaagtctcccaatggagacaattcctagccagggagcctggcaagagggatccctgagtggcagcaagccttatcccttttttcttttttctcttttgttttttccaagtgaggtcacaggaagccctatcctttcttttctttttttcttttctttttttttgagacagagtcttgctcttgttgctcaggctggagtgcagtggtgcgatctcggctcactgcaacctcggcctcccgggttcaagcaattttcctgcctcagcctcctgagtagctgagattacaggcgcgtaccaccacatccaggtaattttcgtatttttacaatacaaatactcggctgccctatccctttttaagacttttatgtggttagacaaatgtcttaggctgggtgtgatggctcacgcctgcaatcccagcactttgggaggccaaggcaggc

SEQ ID NO: 169009 - DNA, 601 bp, Human; identical to SEQ ID NO: 28183

SEQ ID NO: 169010 - DNA, 601 bp, Human; identical to SEQ ID NO: 28184

SEQ ID NO: 169011 - DNA, 601 bp, Human; identical to SEQ ID NO: 28185

SEQ ID NO: 169012 - DNA, 601 bp, Human; identical to SEQ ID NO: 28186

SEQ ID NO: 169013 - DNA, 601 bp, Human; identical to SEQ ID NO: 28187

SEQ ID NO: 169014 - DNA, 601 bp, Human; identical to SEQ ID NO: 28188

SEQ ID NO: 169015 - DNA, 601 bp, Human; identical to SEQ ID NO: 28189

SEQ ID NO: 169016 - DNA, 601 bp, Human; identical to SEQ ID NO: 28190

SEQ ID NO: 169017 - DNA, 601 bp, Human; identical to SEQ ID NO: 28191

SEQ ID NO: 169018 - DNA, 601 bp, Human; identical to SEQ ID NO: 28192

SEQ ID NO: 169019 - DNA, 601 bp, Human; identical to SEQ ID NO: 28193

SEQ ID NO: 169020 - DNA, 601 bp, Human; identical to SEQ ID NO: 28194

SEQ ID NO: 169021 - DNA, 601 bp, Human; identical to SEQ ID NO: 28195

SEQ ID NO: 169022 - DNA, 601 bp, Human; identical to SEQ ID NO: 28196

SEQ ID NO: 169023 - DNA, 601 bp, Human; identical to SEQ ID NO: 28197

SEQ ID NO: 169024 - DNA, 601 bp, Human; identical to SEQ ID NO: 28198

SEQ ID NO: 169025 - DNA, 601 bp, Human; identical to SEQ ID NO: 28199

SEQ ID NO: 169026 - DNA, 601 bp, Human; identical to SEQ ID NO: 28200

SEQ ID NO: 169027 - DNA, 601 bp, Human; identical to SEQ ID NO: 28201

SEQ ID NO: 169028 - DNA, 601 bp, Human; identical to SEQ ID NO: 28202

SEQ ID NO: 169029 - DNA, 601 bp, Human; identical to SEQ ID NO: 28203

SEQ ID NO: 169030 - DNA, 601 bp, Human; identical to SEQ ID NO: 28204

SEQ ID NO: 169031 - DNA, 601 bp, Human; identical to SEQ ID NO: 28205

SEQ ID NO: 169032 - DNA, 601 bp, Human; identical to SEQ ID NO: 28206

SEQ ID NO: 169033 - DNA, 601 bp, Human; identical to SEQ ID NO: 28207

SEQ ID NO: 169034 - DNA, 601 bp, Human
cattttgttatcccagggtgggccattttgaagttggtaagggtttattttaaaggattgggccttctcagagagagagtagacaatgataggcaaagatggggctctcttcttaggaggtatttcatactcccagtccctactagagtctgtgttgaaggtttctaaattttatttctaaccctgaagtctcactaggcatctattggaagtcatagtttccaatcaaatgtatagccttcagtttgaagcatttgaacatgtttaaagtcaaatttgccatttgtcctaaaatagcagsctcccttttcaaactaacttatctctgttaatgcaatattattctctaaatttacgcaggcataaaatctaaagtggagtcactcatctttgatttatcccttgtttaaaaagttgagatcaaatccacattacataaaattcagcattttaccaactttaaggtgcacaactcagtaatttttagtatattcacaatgttgtacaaccatcactactatccaattccagagtatttcccatatttcccaatttcctcctcccctcatcctggcactaccaatctacaatctgtctctat

SEQ ID NO: 169035 - DNA, 601 bp, Human
ccaaggaatttaatttctccatatcgtcaccaacattgttattttctgttttgttttgttttggtttttaataatagccatcctaaggagtgtaaagtggaacaatgcccaaggattgtgttctttttgatgctgttgtgcatcaaattattttcctactttcattgttggattgttcattgctaatatatagaaatacaactaatttttgtatattggtcttgtatccttcaactttgaatagaagtagtgagaatagtaattttcttttttttcatgatactagggagaaattttcaamctttcaccattaagtataatgttagcagtgggtttttcaaagatgacctttatgagattgaagaatttcctttctttttctggtctggtgtgtttttaaatcatgaaagggtactggattttgtcaaatgctttttctgtatctattgagatgatgatttttttccctttatcctattaatattatattgattaatttttatatatcaaatcaatctttcatttctggaataaactccacttggtagtgatgtacaaggagacttcaaatgtttgtgaaaatggagttaaaaaatataaa

SEQ ID NO: 169036 - DNA, 601 bp, Human
agatcttgttcagacatgttataagttagtacaagttcattttagtgcaaaaaattgaaatccatgcattctcttctcatatgtgttttccatgaacttttgaagatccctcagataatcattttcatatgctactgaagtcaatttgttagtattttgttgaagatttgtacatccatattcacaatggatattggtctgttattttcttttccctgttgtctttgtctggtgttagtattagggtaatattggtcttatagaaggtgttaggaagtatcccctgccctttatttttttwaaaaatctttgtgaaagcttaaggataattatttgaaaatttggcagaatttatcagtgaagccatccagtcatgggcttttttttttttttttcttgtctttttcctttttttcccccttttaaaacatggtcgggctgggcacggtggctcacgcttgtaatcccagcacttcgggaggctgaggcaggtggatcacctgaggtcaggagttcaagaccagcctgaccaatatggtgaaacctcatctccactaaaaaatacaaaaattaacctggtgtggtggcatgcgcctgtagt

SEQ ID NO: 169037 - DNA, 601 bp, Human
atatgctactgaagtcaatttgttagtattttgttgaagatttgtacatccatattcacaatggatattggtctgttattttcttttccctgttgtctttgtctggtgttagtattagggtaatattggtcttatagaaggtgttaggaagtatcccctgccctttatttttttaaaaaatctttgtgaaagcttaaggataattatttgaaaatttggcagaatttatcagtgaagccatccagtcatgggcttttttttttttttttcttgtctttttcctttttttcccccttttaaracatggtcgggctgggcacggtggctcacgcttgtaatcccagcacttcgggaggctgaggcaggtggatcacctgaggtcaggagttcaagaccagcctgaccaatatggtgaaacctcatctccactaaaaaatacaaaaattaacctggtgtggtggcatgcgcctgtagtcccagctactagggaggctgagacaggagaatcgcttgaactgaggaggcggaggttgtggtgagccgatatcatgccactgcactccagcctgggcaacagagtgagactctgtttcaaaaaaaa

SEQ ID NO: 169038 - DNA, 601 bp, Human
tattagggtaatattggtcttatagaaggtgttaggaagtatcccctgccctttatttttttaaaaaatctttgtgaaagcttaaggataattatttgaaaatttggcagaatttatcagtgaagccatccagtcatgggcttttttttttttttttcttgtctttttcctttttttcccccttttaaaacatggtcgggctgggcacggtggctcacgcttgtaatcccagcacttcgggaggctgaggcaggtggatcacctgaggtcaggagttcaagaccagcctgaccaatatggwgaaacctcatctccactaaaaaatacaaaaattaacctggtgtggtggcatgcgcctgtagtcccagctactagggaggctgagacaggagaatcgcttgaactgaggaggcggaggttgtggtgagccgatatcatgccactgcactccagcctgggcaacagagtgagactctgtttcaaaaaaaaaaaaaaaaagacaagatctctctctctgtcacccaggctggaatgcattggacaaatcatagctcactgaagcctcaaacttctggactcaggagatccttccactgcagcc

SEQ ID NO: 169039 - DNA, 601 bp, Human
tgaaagcttaaggataattatttgaaaatttggcagaatttatcagtgaagccatccagtcatgggcttttttttttttttttcttgtctttttcctttttttcccccttttaaaacatggtcgggctgggcacggtggctcacgcttgtaatcccagcacttcgggaggctgaggcaggtggatcacctgaggtcaggagttcaagaccagcctgaccaatatggtgaaacctcatctccactaaaaaatacaaaaattaacctggtgtggtggcatgcgcctgtagtcccagctactasggaggctgagacaggagaatcgcttgaactgaggaggcggaggttgtggtgagccgatatcatgccactgcactccagcctgggcaacagagtgagactctgtttcaaaaaaaaaaaaaaaaagacaagatctctctctctgtcacccaggctggaatgcattggacaaatcatagctcactgaagcctcaaacttctggactcaggagatccttccactgcagccccccatgtatctagagctacaggtgcacaccaccatgctcagctaatcttttttaaatttttttgtagagacag

SEQ ID NO: 169040 - DNA, 601 bp, Human
tactgtttgcaggaaatacttatcttttctcattcttttactttcaacctgtttgtgtctttaaatctaaagggagacttttacaaacagcatatagttggatcatgtttttttttgaaattcattcttctaacctctgccttttgagagctaattcattcacatttaatgtaattactgaaaagaaagggcttacgtgtgccattttgctatgtattatgtatatgtcttatatcttttttgcacctcagttcctccgttactagtttcttctgtgttaaatagacacttttctaggggrccactttaattcctttaccatttcttttactacatacttttgagctattttcttggcaatttccctgggaattataattaacatcttaatttataacaatgtaattaggattaataccaacttttaatgttatacacaattttgttcctatatagttcagtttcttgctttatgctgttactgtcacaaattacttcttaatacattgtttttccatcaatataaatttataattattgctttatgtagctgtcttttaaatcagatttttaaaaagggagttacaaacaaaaatacatt

SEQ ID NO: 169041 - DNA, 601 bp, Human
agtgctgggactacaggcataagccaaagcacctggagggaaataatttttaaaaagcactttttaaaatccacatttgctatttataaggtgaacactcagaacaaagagacaaagaaaggttgaaacttaaagaatggcagtgtagtaactgaaagaaagcttgtgtagttataatacatgactatcagacaaaaattttgctaaaataaatgggttactacataaccatcaatgtttttatttcccaggaagatataaacttcttaactcttatgtacctaataaaatttaaactatrtaaagtaaaaaatgacaaacttacaaaaaaattgacaaatacaccaccattgtgacagattctagcatacctctttcagtaactgatagaatctctgcttaaaacatctacaggggattatttaaacaacaccataagtttgatccaactgattatatgtaaaacgtagtaacaagtgaaaagtatacttttataaaaatcaagcatatatgaggtcataaattatattctaacatattaaaaataatcagtttcccagagaccaagttctctgaacataatgcagttaaattacaatat

SEQ ID NO: 169042 - DNA, 601 bp, Human
gagacagggtcttctgtcactgaggctggagtgcaatggcacgatcatagctcactgcagcctcaaactcctgggctcaagcactcttcctgcctcagcctcccatgtagctgggactacaagcatgcctcaccacatccagctaattttttttccatttgttggagagacagggacccactttgttgccggagctggttttgaactcctagcttcaagtaatgctccagccgcagcctccaaaagtgctgggattacaggcacacaccacagcacctggctgggtaaatagttcttgatygtcttagagaccaaggaaaatgtatccagccaatttctctccatcctcccaaatccttgccaggcctttcctcttgcttcaggacctgtagcccaatttgctcttcctcctgtaacaaccgcaccagatctctggctggtccagaagtcaggtgaaagagtactgtcatcctctgaaagcccatcctttactaggctgagttttgctttgtgtccagcgaacaaggctgacttgaaagaggaccataccctgaagaagaaaataataggactttccatcttcaaagctcctccctacaca

SEQ ID NO: 169043 - DNA, 601 bp, Human
tctcatttatggaagtgtctcttaatggagtctttctctcatatgtgtgtgtatttgtgtgtatgtgtgtgtacgtataattggaagagggccctgtgttgggtccattctgtcagaagtatgtctgaatttaatcccctttctccattcccacggctatagtcctaactcagggccaagcatttttggcccggactttttcaacactcctccccatctcctccttgcccctggcctctccctactgcatttaccctccctactgacaccaggtcatccctagtttaaatttctgcttacratagaattcaaaccctccacactctgaacccaaattaacttttcaatcttttttctcaactgggacagccaccccaccctgtgattcaataacatcatatgtgtctccaggtctttgcttgtgccatttcttttctatgagatggtcttttcttgtgggcaacgtggacaaatcttagctattcttcagatacgccatttcctctgtgaaatttgttctgaccccaccacttcttcccctatgttccacatccatatcattttgtacataacccttagaacagcacttcagtatttcaat

SEQ ID NO: 169044 - DNA, 601 bp, Human
gctccttaagttctccaaggccagattgagatttgtttttctgaaccttgagggacattcgggagaaacgagcctgagttttatataacaaaataaaagtttacaagagccctgagttatatacaataaattcagtgatcgaaggtgtagggtaggtagacaagagaattcatgggaaaatgcctccagagctaataacttgtatttgtcaaacactttccagttcacagagcattttcacgtatattatgtcacatcatcttcacaaccctgtggaatacaaattatctctattttacaygctaggacaaagcattgattaagtagcttgccccatatcatgaataaatgttccaaagtggtcagtatgcagactcagaccccaacctctgcctcccagcaactatattttctgctatgactcactgtgactcaggactcaagcagcccagtgtccagtctggctgctcttcccaggagctttcccacctggcctccttctgctcaatgggtcctgctggagacccttccattggtccaactggtggtctctaccaactgccacagaagcttccaacagccacattccacccatccaacc

SEQ ID NO: 169045 - DNA, 601 bp, Human
tgtgatccatccgcctcggcctcccaaagtgctaggattacaggcgtgagccaccacacccggcctgtgagaccccaactcttaaaaaaaaaaagttacttaggtgaatgcatcactgatcaccccagaaaaagccccccatgcttgctatcatgaaacttgcattacagtcaggacagactaactaaataattaacatgccaaatggtgatggacattgtgatgaaaaataaacttaggaaattaactggtggaatggggtctatgttggaaagaagttggtcagggaaggcagatttartaagacacctaaatgcagtaagggaagaagcgaagccaattggccctcaagagaagggttttccaggcacagagaacataatgcaaaggccctaagcttcactcatacttaggttattcacagaatgggaaggaggccagtgtggctggagcagaatgaacaaagcgggggagtgtggtagaagatgaggtcagagtgagcaagtgagggacctgattttgtaatgcctcataggcccatagaagattgttgtttttcaggcattcaacctcgttcaaacaaaccaagcaattattttag

SEQ ID NO: 169046 - DNA, 601 bp, Human
acagtcaggacagactaactaaataattaacatgccaaatggtgatggacattgtgatgaaaaataaacttaggaaattaactggtggaatggggtctatgttggaaagaagttggtcagggaaggcagatttaataagacacctaaatgcagtaagggaagaagcgaagccaattggccctcaagagaagggttttccaggcacagagaacataatgcaaaggccctaagcttcactcatacttaggttattcacagaatgggaaggaggccagtgtggctggagcagaatgaacaaagsgggggagtgtggtagaagatgaggtcagagtgagcaagtgagggacctgattttgtaatgcctcataggcccatagaagattgttgtttttcaggcattcaacctcgttcaaacaaaccaagcaattattttaggccagaattgttgggtgctgatgatacagagatgaataagacaaaggcgttactgtcaagaagctgagtctgatgaagaacagagacaagtaagcagacagctatatcacagtgtaactggtactgcaagagggttaagccctgattcctgtagtaacatatggag

SEQ ID NO: 169047 - DNA, 601 bp, Human
tgattgttttgttagtgctcatgtactttttacttctactttcaaaaaatgtggctactacaaaatctacaattaaataaatatgtggctcacattatatttctactggacagcacattatatttctactggacagcactaatctaaactcaaagtggaagagacaaaccagggatgtagaagaaacctcaaggcagagggtctacatgtgccaacgtccagatcacaaagagagcatggcaccttcgaggaggaacaaataactcagaatgatgagtcctgaagtgccagcaagcaggtmggcggagatgaggaagaaaaaataaacagaagttgggtctgaaggtctcgtgtgttatttaagggaatttgaacttcattgtgagtataacagggagctaccgagggaagacacccagccagctgggattgttgcaaaggtcattctggctatcatgtggagcatacactgaagtggggcaagaatggaaggaggaaaaccagttagtgctggttgcaaaaatgaggcaagagtcgggggcagtgacagtggagaagagagaagtgggctaatgtgagacattatgagaggtcaagttgg

SEQ ID NO: 169048 - DNA, 601 bp, Human
tgtgttatcagtaaggcttctagttaactgtagactgttagtagttaagttttgggaaagtcaaaagttacacttggaggccgggcatggtggctcacgcctgtaatcccagcactttgggaggccgaggtgggcggatcacgaggtcaagagtttgagaccagcctgagcaacatagtgaaaccctgtctctactaaaaatacaaaaattagccatgaatggtggcgtgcacctacagtcccagctacctgggaagctgaggcgggggaatcttgagcccaggaggtggaggttgcagtwagccgagatcgcaccattgcactccagacagagtgagactccgtctccaaaaaaaaaaaaaaaaaagttacacttggatttccgaccgtgccaggggtcagcacccctaacctaaccccttcattattcaggggtcaactgtacttagaaatagcctagctcagctgctgtactgggtgcaaggtcccaggcaaatcaagttctgtctctgtactagaaaattaaggacatgagctagattattcctaggctgtcttctacttgggtgactccagggttctaaactgttatgtttctggg

SEQ ID NO: 169049 - DNA, 601 bp, Human
ttatcagtaaggcttctagttaactgtagactgttagtagttaagttttgggaaagtcaaaagttacacttggaggccgggcatggtggctcacgcctgtaatcccagcactttgggaggccgaggtgggcggatcacgaggtcaagagtttgagaccagcctgagcaacatagtgaaaccctgtctctactaaaaatacaaaaattagccatgaatggtggcgtgcacctacagtcccagctacctgggaagctgaggcgggggaatcttgagcccaggaggtggaggttgcagttagcygagatcgcaccattgcactccagacagagtgagactccgtctccaaaaaaaaaaaaaaaaaagttacacttggatttccgaccgtgccaggggtcagcacccctaacctaaccccttcattattcaggggtcaactgtacttagaaatagcctagctcagctgctgtactgggtgcaaggtcccaggcaaatcaagttctgtctctgtactagaaaattaaggacatgagctagattattcctaggctgtcttctacttgggtgactccagggttctaaactgttatgtttctggggttc

SEQ ID NO: 169050 - DNA, 601 bp, Human
tgcccccacttcaggtgcccaggctacctgcacttctgcctgactacaaattcaagggttcccatgactccccctcaggtttaatcactggctagaatgactcacagaattcagggaaccactttgcttacatttactagcttattttaaaaggtgcaacttaggaatagccaaatggaagagatgtctggggcacagtatggggcagggcacgcaaagtttccacactctgtccaggtgcaccctgtcccagcccatccctgtgttcaccagcccagaagcttcctgggtcccattgttmaagactttttataatcaatttcaagagccctgcctcccaccctttctgaagttcaggggatgggactgaaagttcagcctttctggtgaccagcctccatcctggagatatctaggcgctccaacctgagtcacctcattagcataaatccagatgtggttaaaggggttccttgtgaataacaaaaggcactcctgtcagtcgggaagttccaagggttttaggaacttcttgacttgaacaagagactaaaactaaatatattttttattgtaccacaattgcacacagattcttaat

SEQ ID NO: 169051 - DNA, 601 bp, Human
tgtctggggcacagtatggggcagggcacgcaaagtttccacactctgtccaggtgcaccctgtcccagcccatccctgtgttcaccagcccagaagcttcctgggtcccattgttcaagactttttataatcaatttcaagagccctgcctcccaccctttctgaagttcaggggatgggactgaaagttcagcctttctggtgaccagcctccatcctggagatatctaggcgctccaacctgagtcacctcattagcataaatccagatgtggttaaaggggttccttgtgaataacraaaggcactcctgtcagtcgggaagttccaagggttttaggaacttcttgacttgaacaagagactaaaactaaatatattttttattgtaccacaattgcacacagattcttaattaaacatgtatcagttaattcactgactagcttagaacacaagaagcctgatgaggggctaaaaatggctaagaaatcccttatctctaaaatcagaaagattatgggaaaccctttagtttgggacaggtcattctgctagaagaacatataaccccaactccatacataaccttgaagttgg

SEQ ID NO: 169052 - DNA, 601 bp, Human
attgtgaatagtgctccaatgaatgtatgtgtgcatgtgtccttatggtggaacaatttatattcctttgggtatatactgagtaatgggacaaatggtagctgtttttggctctttgaggatctgccacactgctttccacaatggttaaactaatttgcactcccaccaacagtgtataaggattcccttttctgtgtaacctcaccaacatctgttattttttaactttttttttgcctcccgggttgaagcaattctcctgcttcagcctccagagtagctgggactacagggatgygccacaatgcctggctaatttttgtagttttagtagagacagggtttcaccatgttagccaggctggtctcgaactcctgacctcaggcaatctgcccacctcagcctcccaaagtgctgggattacagacatgagccactgcgcccggccttgactttttaataatagccactctgactggtgtgaaatggtatctaatgtggttttgatttgcatttctctaatgatcagtgatatttagattttttatatgcttgttggccacatgtatgtctttttttgaaaagtgtcttttcatg

SEQ ID NO: 169053 - DNA, 601 bp, Human
tggttaaactaatttgcactcccaccaacagtgtataaggattcccttttctgtgtaacctcaccaacatctgttattttttaactttttttttgcctcccgggttgaagcaattctcctgcttcagcctccagagtagctgggactacagggatgcgccacaatgcctggctaatttttgtagttttagtagagacagggtttcaccatgttagccaggctggtctcgaactcctgacctcaggcaatctgcccacctcagcctcccaaagtgctgggattacagacatgagccactgcrcccggccttgactttttaataatagccactctgactggtgtgaaatggtatctaatgtggttttgatttgcatttctctaatgatcagtgatatttagattttttatatgcttgttggccacatgtatgtctttttttgaaaagtgtcttttcatgtcctttgcccattttttaatggtttttttttcttgtaaatttgtttaagtcccttatagatgctggaaataagacctttgtcagatgcatagattgcaaatattttctcccattctatactttgtctgtttactctgttgatag

SEQ ID NO: 169054 - DNA, 601 bp, Human
gcaagaaataattatgtgatctgtggctacacaaaaaaatgaattgctatagcagtagatagtgtaagcatatagactccaaaataaaaatccacaaacatatatgttttatgagagaaggaataattatttctgtactctatcacttactacaatgcaagccacatagtaaatattctaataaatatttgtgaagtaaatgaataaatgaattccagctctgtctggctctatcattactacctgtatgacattacctaagttactgaatttctttctttctttctttctttttttttttgagatagagtctcactctgttgcccaggctggagtgcagtggcatgatcacggctcactgcaacttctgcctccagagtgcaagggttcaagtgattcttgtgtctaaaaccaagtagctgggattacaggcatgcatcaccacactcagctaatttttgtatgtttagtagagacgggtttcgccatgttggccaggctggtctcaaactcctggcctcaagtgatacgcctgcctcagccttccaaagtgctggggttacaggtgtgggccaccacacccagcctgaaggtactaaac

SEQ ID NO: 169055 - DNA, 601 bp, Human
tgttatgggctaaatgaattgtgtccccctgcccaagtttatatgttgaagtcaacccccaatacctccaagtgtccttataggaattggaaatattgacacagagacaccaggcacacgtgcacacagagaaagaccatgtgaggagacagtgagaaagtggccatctgcaagccacagagagaggccttaggagacaccaaacctgctgacaccttcatcttggaattctagcctccagaactgtgggaaaataaatttctgctgtttaaaccactcagcctggggtattttgttatarcagccttatcaaactaatacaataggagaaataatgttcatagatcacctagcacatgaatgctcagtaaatatttctaatactaaaaatatctgagcagggcactgaaaaatatataatacacacaaaaacatacaaaagggaatcagtagaattatttttctacacctgaggaccttgggggacagagaaaactgaacctgccctgcatactattctctgcactgggatcatgaaagagtgtatccacaaatgacattctagtccagaacatctcaaactttaaagtgcatatggatc

SEQ ID NO: 169056 - DNA, 601 bp, Human
tgttaaaatgcaaattctggttcagtgggtctacggtctgcatttcaaacaagctcccagttgattctgatgctactggttacaggaccacaccaggcaacactgaagaaataggttgctgagtcctaaggagagttataaacccttggatacacaagacacaaaaccaaatacatcgagtggccagaaaatactcagtaaattgaatcctatatttgtatatatcatgactagagatggcagtgccacttaagtatatatataataattcaggaccatggagttaaagtgctcaggcagrtaaagtcatctggagaattcctgaaggaagaaaggaagacacttgattcagcaggggaaaataaagaaaacattctctgtaggagaacccgtctgggttaaagcgaacttaaatagttcaagttgagttgtatttagttccttacttccctaccttaataagtacaggggcggcatttgctgctcctctggaagggtgaggggagggaggaacgtgtgggtgtgcttatggcactgtttgctccggctagctaatgtttggtttccttatctttggagagtgtaatgggtgttggtgcca

SEQ ID NO: 169057 - DNA, 601 bp, Human
tgctctggcaaatgtctaaatggacaaggagtgatgaagcagagcatgtttacttttagtttggagacttaaataagaaaaggattaaaagtggatgtgtttgaactgagttttgagaaatgagaattggccaggtattctagagtgtgtgtgttgtgtgtgggcactcggtggaaggggaggattggtgggcatgggtcaccaagaaacaagcaacagcatggcttgtcagggacctggaagaggtttgaagttgccagaggatgggatgtgtggggaaggtggtagagcaatagataargttacacagctagatcaaggtcaactcacagagggtcttgtaagccatacttagaagtttgggcaatgaaaagccagtaagaggggagtggtttggtcagacatatgggtgttataaggaaaattttttctctagttgcaaaaatagtttattttcaatggggaaaaaaaaccacaaaaaaaaattacatatgaactcactactaatacccaactcataatgtactggagtgagttttccagagagaataacagagtgtaaaaggaaaaaaaaaggttttttcctactctctctgctccc

SEQ ID NO: 169058 - DNA, 601 bp, Human
ttggtgggcatgggtcaccaagaaacaagcaacagcatggcttgtcagggacctggaagaggtttgaagttgccagaggatgggatgtgtggggaaggtggtagagcaatagataaggttacacagctagatcaaggtcaactcacagagggtcttgtaagccatacttagaagtttgggcaatgaaaagccagtaagaggggagtggtttggtcagacatatgggtgttataaggaaaattttttctctagttgcaaaaatagtttattttcaatggggaaaaaaaaccacaaaaaaaaattacatatgaactcactactaatacccaactcataatgtactggagtgagttttccagagagaataacagagtgtaaaaggaaaaaaaaaggttttttcctactctctctgctccctatttactcaatacagaacacttcttagaccagatgtgtgtttttccccacacaccaagcaattctccagcagaccctctctgggtatcctagaatccaattctgattctatctacctggatatagcatcagatcccagtggttgtgggctcagtcccacaaaactgctctcacttcagaggcc

SEQ ID NO: 169059 - DNA, 601 bp, Human
agtcccacaaaactgctctcacttcagaggccaattgcaagtctgggccacctttatttttcaccaaccggctataaactgagattccctcaactttctgctgggatttgattaatttgctgggatggctcatggaattcagggaaacatttaccagcttattaactgttttaccagtttagtacaaacgatattacaaaggatacagataaacagccagacgaagagatgcacagggcaaggtatggcagagcggttgcagagcttccacgccgtgtctaggtgagccaccctcctggcrtctcctagtgtttagcagtcccaaagctcatcaactcttgtttgagtgtttatagagcttgatgttcagcaacaccctccctcccctccttggaggttggagggtagggttgaaagttccaatcctctaatcacttggtctttctggtgactggtcctatcctgagactaactagggcccccacactaagtcaccttattagtataaatgctggagttattaaaggagctcattatgaataacaaagatgttcctatcacccaggaaattctaggggttttagaagctatgataggaacc

SEQ ID NO: 169060 - DNA, 601 bp, Human
aatcaagatgaacagtgcaaagaggacacagggttttgctatttctcagtgggagctttgcctgggccctttatgaagtgggatgcagggagcctcactgcagcaggtggaagaatggatggaaagtgacggtaaatgcagtctgtacttttagagagcttgactatgatgggagacggttttgtggtggattgatttgttttgcttttaaagactggagaaaatagcatatttttatgatagaaaggagccaatagtggctaaacatgaagactggagagagggaataaccaaggttgcmaagttctacagcagtttttctcaaccggggacattcagtatctggaaacatttttggctgtcacaactggggtagaggagttgttaccagcatctgctagacagagtccagggaggctgctaaatatcctttaatgtacagcacagcccctcatgacaaagaattatctggccattgccaacaatgtggaggtcaagaaaccctattctaaaggaagaaaaaacagaccaagaatgcaagtgataggattagcttccacctgatataactcaatgcatatttgttaaataaattaatgaa

SEQ ID NO: 169061 - DNA, 601 bp, Human
actttcatggaaagtataatttaattggaaagtgggaaagaataatgtttacaaagtatcttgcagagatttctgtatttccgggtcacagagcagaggctgacaggcacagatcaccactgaacctctaaacattcctgttctccccaacccccaatgtctttccctgtcctggaaaagtgcaaaaaagcagtatacatcccaggctgctggacatatgcccaattattctctagggcaagaagtctacccctgatagtgatatatataaatgctcatgctttaaaaaaaaaaaaaaaaatacagcaagtttaaccaggcgcaatagttcacatcagtaatcccagtggctgggaaagctgaggtaggaggatcacttttagcccaggagttcaaggctgcagtgagctatgattgcgccactccactccagcctgggcgacacagcaagaccccattcaaaaaaaaaaaaaatacagtcagtttaagcacgatgtatcattttcaggtcacgagttcactaatctctactccagtttatttttaaaatacgcagtcatagtttcacaatttctatgtaagtctcatttcacacaaaaga

SEQ ID NO: 169062 - DNA, 601 bp, Human
gggtagtccaagatcaaggtgccagcagactcagcatctagtgagagccggttcttcatagatggtgccttctgtgagtccttacaagacagaaggagcaagaaagcaccctcaagcctcttttataagggcactaatcctattcattcaggtggagccctcatgagttaatcacttcccaaaggtaccgcctcttaatactattacactgagtattaggctctaacatatgcatgtggggggacactgcattcatactgtagataaaaggagccgaagaaacaaacagcctctcgcatartgttgtttacatccttctaatgtctctagagaaattcatatataaatagggaatactttatatgcctgatgtggccggtgaccagaatgccattatttaggaagagtagaaaaagtagcagctctgataactaaggaaaaaaataaacccacaaatatgaggcttattcagttaaaataccaaacctaggaggatgagcttcaactgcttgccataaaaatctcactacaagagtctgcagctttccactgcaaaactagaaaattaaatatctttcatcttcattttcacaccctttac

SEQ ID NO: 169063 - DNA, 601 bp, Human
cagctctgataactaaggaaaaaaataaacccacaaatatgaggcttattcagttaaaataccaaacctaggaggatgagcttcaactgcttgccataaaaatctcactacaagagtctgcagctttccactgcaaaactagaaaattaaatatctttcatcttcattttcacaccctttactgtattttcttactaatattaggagccgcagatggcaaatcaatagattgtttctatgatagcatggaccaaaaagaatggtgtagaaagagataagtctgtctctagctattccatcrtggcttcatcaattggacagggtgaatgtcacctctgttgccgatttaatcctcctctttcaagtctggacacctgcattcctcaactatcctagctccaggggaggactaacagggagggaatttgtttttttaggtattgaaagaaaatcacatcaaataataaattactctctatatctcttttaaaactgtctcgtgtgtctttaaaatgtcatgggagaaataaaaaggtacactgagagagtatgctcaatgaaatatttaaaccataaaggcagcaaggccggtgattaagga

SEQ ID NO: 169064 - DNA, 601 bp, Human
caggggaggactaacagggagggaatttgtttttttaggtattgaaagaaaatcacatcaaataataaattactctctatatctcttttaaaactgtctcgtgtgtctttaaaatgtcatgggagaaataaaaaggtacactgagagagtatgctcaatgaaatatttaaaccataaaggcagcaaggccggtgattaaggagattaaatagatctggatgatggatacaaatcagaagcatgttgtcaaagattagtagatattaaagctctttattgtccttccaacagaaaaaaaaaagcagtaatacggtttttttgatgtcagtctgagccatcaagccattatgtaatttttatcttttcttactccttttgccatgaggcaagacaatttatttcccctgtagtaaataaatttcctctgcctcaaacatgctctgaatgtaatcctgggctagccacccacctcttaggattcactttcctcatttgctaaaggagggaattggttctcatagttctgacattctgtgtttctctgaaagatgtttagagagttctaggatgtgagttatcatatatcatctacactaagaca

SEQ ID NO: 169065 - DNA, 601 bp, Human
aaataaaaaggtacactgagagagtatgctcaatgaaatatttaaaccataaaggcagcaaggccggtgattaaggagattaaatagatctggatgatggatacaaatcagaagcatgttgtcaaagattagtagatattaaagctctttattgtccttccaacagaaaaaaaaaagcagtaatacggtttttttgatgtcagtctgagccatcaagccattatgtaatttttatcttttcttactccttttgccatgaggcaagacaatttatttcccctgtagtaaataaatttcctcygcctcaaacatgctctgaatgtaatcctgggctagccacccacctcttaggattcactttcctcatttgctaaaggagggaattggttctcatagttctgacattctgtgtttctctgaaagatgtttagagagttctaggatgtgagttatcatatatcatctacactaagacacatttaattataagataagccattattttatgtactactaacaaaaaaaagatcctgccaactaaactatgacagaataccctaactatagccctgtgacctcaggattaatcacaccagcctct

SEQ ID NO: 169066 - DNA, 601 bp, Human
atgttgagaaggcactttactgccttctttgagattgcttcttatggcaaactgcactgcagtcttgaatcaccacggctggctaaaatcatggcgacccaaccttcacctaagactctggaatctgattcacattcacctcccagcctctgctgacctctcatgcctctatcagactgcgaaactgaatgctaaggtccacgtagaggactcaatgtaacacaagagcttacatttccttgactcctcaacaccagtggccttgccttcttatcctcccctgcagctgctcccagccctmctcctccttgtccttgtttttccaccattctatgacatcccatccctgcatatcgacttcctgccttctgcatccaggtggctacaagcaattatatagattcatttgctccaactttaggtgaccctcaagctgctgctaacctgttccttctgtcattcttctcaacagctctctcacgcattctctttttttccttaaaccctcaacaccttcatcacctgcaacttcagtaaatcatctttctactttatgagaaaattaaagctatcaggtcggaactccctgagctccatcaac

SEQ ID NO: 169067 - DNA, 601 bp, Human
tgagattgcttcttatggcaaactgcactgcagtcttgaatcaccacggctggctaaaatcatggcgacccaaccttcacctaagactctggaatctgattcacattcacctcccagcctctgctgacctctcatgcctctatcagactgcgaaactgaatgctaaggtccacgtagaggactcaatgtaacacaagagcttacatttccttgactcctcaacaccagtggccttgccttcttatcctcccctgcagctgctcccagccctactcctccttgtccttgtttttccaccatyctatgacatcccatccctgcatatcgacttcctgccttctgcatccaggtggctacaagcaattatatagattcatttgctccaactttaggtgaccctcaagctgctgctaacctgttccttctgtcattcttctcaacagctctctcacgcattctctttttttccttaaaccctcaacaccttcatcacctgcaacttcagtaaatcatctttctactttatgagaaaattaaagctatcaggtcggaactccctgagctccatcaacaacacctaaaaactctcagtctaattcta

SEQ ID NO: 169068 - DNA, 601 bp, Human
caaaacgagcaagttggcagaggtggctgagagcagctgagtgggtggagggggcggggagccgggttgtgttggcttgcaaaggtgagatcagtgctgtggcttgtcacaccctggctgactcaagctaagcccaggcccctcgggaactgttcacactgggctgtctagtaaaaatcagctagacaagtcgcctaactgccgttctcttgtgtttacaagttctgagttgtagggcttggaattctttgctcaagttgctgcaaagctgctaattaggaacctgcaatgatattgctcyagggccattccctttctggttatatggtatctgggtgataagagtcagggcagaatttaaatttcttctttgtacttttttgtttgttgggaatgtttagaatgcatccttttttcaaaaccttatcttgaagtgtagtggtggagctggatcgccacctcaaagctaaggctccaggcagcattgatcctgaccatgcccagcaccctaagaggatgaggctctgctgagagatcctgggatgctgccccatagggccagctttgcttagaagccactgggaatttgtcctggcagctt

SEQ ID NO: 169069 - DNA, 601 bp, Human
aaataaaaaataaaagaattagcaggttgtggtggtgtgagcctgtagtcccagctacttgggaggctaaggcaagggaattgcttgagcccaggaggccaaggctgcagtgagccgtgatcatgccactgtgctccagcctgggcaagagagatagacaaaaaacggaaggaaggaaggaaggacagatggaaggaaggaaggaaggggaaggggaaagggaagaaggaaggaagaaagaaagaaggaaaggagggagggaaggaaggaaggaaggaagggagggaggaaggaaggaagmaaggagagcgagaaaagaaaaagaaaaaaacaaagaccgagaccaaagacttgataaaggtgaactttctgaacccataaagttccttaagtgctgcctctgctcatttagtcttctgctcacctgagcccactgatgaataaatgaaaatctttggaaatgattcatgaaaatcatcacaaggaagcatattcttggcctctgaagtcttcatttcaaaatgaagtttatagtttaagactataaacaatacacgattcttataaaaataaaagtagaaacaaaaaatattagccatag

SEQ ID NO: 169070 - DNA, 601 bp, Human
gctggagaggtgtgtttagagctgcagttagggcagcaaaagcagagagagttggcaccagtgaggatgggcagagttggctatggatataatccatcatttgccaaatagctcaaagttgtatgaatatcattaaatatttcatgtaaatgctgttttttttcaagggcaagtcctgtttcatagaaaatatagttcccgagcatagtaaaggagcatgtgctccatactaagcacttctaaatgattatttcatttaagaatctcaacaattcagagttaagtgctctcttctccagtctgcacataggacaattaaacagcagaaaagtaaaataagttgccaagaggacttgctaataaatgtttgagccaacattagaacatagagctgacttcaaagtttgtgatctttgctctacattatgctgcctcccttgttaaacctaacagataaacataagtgcaattttaaaaaagagttaatgcttattgattaaaggcagggctttctctgggatccaggagtcaccattatgggtaggcaggatcatttacaacattcttttgaggatccctttaaaaaaaaaatgaccactgg

SEQ ID NO: 169071 - DNA, 601 bp, Human
ctggagaggtgtgtttagagctgcagttagggcagcaaaagcagagagagttggcaccagtgaggatgggcagagttggctatggatataatccatcatttgccaaatagctcaaagttgtatgaatatcattaaatatttcatgtaaatgctgttttttttcaagggcaagtcctgtttcatagaaaatatagttcccgagcatagtaaaggagcatgtgctccatactaagcacttctaaatgattatttcatttaagaatctcaacaattcagagttaagtgctctcttctccagttygcacataggacaattaaacagcagaaaagtaaaataagttgccaagaggacttgctaataaatgtttgagccaacattagaacatagagctgacttcaaagtttgtgatctttgctctacattatgctgcctcccttgttaaacctaacagataaacataagtgcaattttaaaaaagagttaatgcttattgattaaaggcagggctttctctgggatccaggagtcaccattatgggtaggcaggatcatttacaacattcttttgaggatccctttaaaaaaaaaatgaccactggg

SEQ ID NO: 169072 - DNA, 601 bp, Human
tggatataatccatcatttgccaaatagctcaaagttgtatgaatatcattaaatatttcatgtaaatgctgttttttttcaagggcaagtcctgtttcatagaaaatatagttcccgagcatagtaaaggagcatgtgctccatactaagcacttctaaatgattatttcatttaagaatctcaacaattcagagttaagtgctctcttctccagtttgcacataggacaattaaacagcagaaaagtaaaataagttgccaagaggacttgctaataaatgtttgagccaacattagamcatagagctgacttcaaagtttgtgatctttgctctacattatgctgcctcccttgttaaacctaacagataaacataagtgcaattttaaaaaagagttaatgcttattgattaaaggcagggctttctctgggatccaggagtcaccattatgggtaggcaggatcatttacaacattcttttgaggatccctttaaaaaaaaaatgaccactgggtccagccaggtcaacaatggatgaggaactcttccatggagttctgaaaggccctacagaggctctgacaacaaggaggcca

SEQ ID NO: 169073 - DNA, 601 bp, Human
ccttgttaaacctaacagataaacataagtgcaattttaaaaaagagttaatgcttattgattaaaggcagggctttctctgggatccaggagtcaccattatgggtaggcaggatcatttacaacattcttttgaggatccctttaaaaaaaaaatgaccactgggtccagccaggtcaacaatggatgaggaactcttccatggagttctgaaaggccctacagaggctctgacaacaaggaggccacaggacagcttccacctcccagtttttcctaggccaatccttgggacatagyatggttgatggaaatggaaactattgcttcttggtgcattttttaaaggaatggttaaattataacgtaagagtctgttttcccactagacttgagttttataatatcagggaccatgtctgtcttcttcattgccatagtcccattccttgtacagtgcttggtccatagcagatgatcttagtccatttgagctgctataacagaatgccatagagtgggtagcttatgaacatcagaaatttatttctcatagttctgcaggctgggaagtcccaaatctgcagtgctgagagatgt

SEQ ID NO: 169074 - DNA, 601 bp, Human
caccacgcctggccacatgattaattaaaacactggccattggtgatcaatttgagcttcggcccttctcttctccccagatgttgggggtgggctgaaagtctcaaccctctaattatgacttggtctttccagtgaccaggccccatcctgaagctaccaaggggctgtgagccactagccaattactaacacataaaaagacagcactttggagattctaagagttttaggagttgtatgtcaggaagaggggttgaagactgacatggtttggatgtttgtcccccccaagtctcakgttgaaatgtaatccccagtgttggaggtggggtctggtgggaggtgattggatcacgggggcggcagggggatccctcatgaatgactcagcaccattcccttggtgatgagtgaactctcactcagttagttctgcctcgtgagataaggtttttttttaaagtgtgcggcactgtccccttctctcttgctccctctcttgccatgtgatgcgctggcttcctcttcaccttccaagatgattgtaagcttcctgaggccctcaccagaagcagatgccggcaccatgctttgtgta

SEQ ID NO: 169075 - DNA, 601 bp, Human
ggtaggcagatgtgagtttcagcagtcaaaatcagaagctgaggttgctgcatctggcttactcccctctccataacagcagaatgtgggatttccaagacctttcttgagggcctggtctctcctcagtgaggtccacatacttatatttagaccatgtaagaacgcattcattaacctcgatgacaatgttcagtgtgggtaaaccacctgcttctctttggtgaggccggtgatcaccgtgggatcttttgtatccaagaagttgaatttcagccactctctaatttcaaccacaccsattgtcctgggtgtccaggacaatgaccataccagagagtggtaacccactgctgagaaaggagatccttgtctatgatcacccctcactcctaacacaagaggaagatgccaaagaccagctgaggagaaggaaagggaggaataaagctatgtaatgactaaggaggactaagagattttactgaatagacttatctagcaggttaacgtgaatgggggtaaagggatttggtgctttctgtggctgaaggttgctattactctagaaatggaaaatgagaaaaatatctccttctcc

SEQ ID NO: 169076 - DNA, 601 bp, Human
gcttctctttggtgaggccggtgatcaccgtgggatcttttgtatccaagaagttgaatttcagccactctctaatttcaaccacacccattgtcctgggtgtccaggacaatgaccataccagagagtggtaacccactgctgagaaaggagatccttgtctatgatcacccctcactcctaacacaagaggaagatgccaaagaccagctgaggagaaggaaagggaggaataaagctatgtaatgactaaggaggactaagagattttactgaatagacttatctagcaggttaacgygaatgggggtaaagggatttggtgctttctgtggctgaaggttgctattactctagaaatggaaaatgagaaaaatatctccttctccaagtagagaaacaaacactcaggaaaaaactcacccttcctgtctatgtaccatcttccctgatgacaggtagcagaaagtatagttgagaggtgcccaggtttgaaagttcaaatcccagttctgccatttctctcctgtgtaaccttggacaagtttcttagcctttttgtgcctttcatttgtaaaaaagagaaaataataataccttc

SEQ ID NO: 169077 - DNA, 601 bp, Human
ttctttggtgcccttttccttgttcttccttttgggccaatctattgacagccaccctgcaaaatggcaaggaggtgaatttcctttcttataaattcatcctcaaaataattgcatgattaaaacagttgtgggccctctatcaagagtaatcagcaatgtgctttgaagcctggggtctgctgactctctgatggcacctgggaccatgtttatctccatttatatgattcggccaccactctgcctcactgggttccctgatgttagattgctttgaggtcttttgggagaggaagayctaccaccagagcttcaagttagtgtgacaattctccattgaactcagacaagagactgacatggtttcttgccaggcagcaattagtgactacaggactgaagtggtttccaagattcaggatttgcctagtagttgtaagaggtaacagccaacaggagaagaggagacccaaacccagactatgctgtgaagtgtagggcatgactggtattctaaggaaggtagtttccacatttttgtggcttgtgaatcactttggcaggataaaatttcccaagggccaatttacccgaccga

SEQ ID NO: 169078 - DNA, 601 bp, Human
acctgggaccatgtttatctccatttatatgattcggccaccactctgcctcactgggttccctgatgttagattgctttgaggtcttttgggagaggaagatctaccaccagagcttcaagttagtgtgacaattctccattgaactcagacaagagactgacatggtttcttgccaggcagcaattagtgactacaggactgaagtggtttccaagattcaggatttgcctagtagttgtaagaggtaacagccaacaggagaagaggagacccaaacccagactatgctgtgaagtgyagggcatgactggtattctaaggaaggtagtttccacatttttgtggcttgtgaatcactttggcaggataaaatttcccaagggccaatttacccgaccgattaccacttgccaatgcaaaaccaaataaacgtacatatgtttattgggaagaaaaccaaagctttggagaggacagggacaatgtctttggatccccagggcctaatggtctcaaaaaatattcactgaggtcatctgattcctctgagaggctaagcatacataattttccaatcattttggtcttcgtactatat

SEQ ID NO: 169079 - DNA, 601 bp, Human
ctatattcagagagtgaatctctgtgttaagtacaaccaggtgatggacaatgggtggactgaatttttcatttttatcaagcatggtatggaagaagcagcagtagcctgaccttctcaactgcttggaattcatggattaatttactgatgatttgttaaagatgtttctgtcttggtaggtgaagaaaggaggaactaaagtggtcacccaaaaagccagaaatccaaacactgttacaggccaaagtcttggcctaagaacaaagaaaattaggcaataggattgggctgtgccttkctgaagtcatgtcagcagtctcctgggccacagctttggcttgctcagatgcaatttgttcaggcagtgcagctgggggcagcagggcttcagctacaaaagtgttggctggtaagagaaaatcaaaataatccccattaagttcccattatcttaaaaatgagaaactctaatgagaggcttccagagcaagctgagcagcaggagggcacctctgatggatgctgtcctctgtaaggatgtcactgtcgtcaccaggggcaagctgagggcccaaatgcctctgcgcagtttccctgg

SEQ ID NO: 169080 - DNA, 601 bp, Human
agagggagagggagtgaattcattttcatatcaatgtctcactgctgagttctgctgagctgacctcttgcactagacttacagtgctttcttttggtgataaacctgagcgattttaagatcacaaattggttctggaactcattaaagtcagcaaatgagcattaaaagatacttgcacaggctgagtttgtgctaatctgtctatttaggcaattacagctcagaggatgaacagaggggcggtgagaaagaaccctccaactcccagcaagatgatccatttcagatgtctgtcaasgatgcacatgccctggcttttcttcctttacaccttgaaccctgggtgcaggaggcaagggaaggatttgagaatgcttcacctctaccctttgccaggttcaaagcccaagtgagaccttcaatcaggtccctggcacacctgacacttcattattattattttttttaatcaaaagcccacttctttggtagcaaatgctatttctattctctgttttagaacttgacccttacttttttttacttaaatgttagtcattcaagatttcttaaccctttggttacagagtcttccatc

SEQ ID NO: 169081 - DNA, 601 bp, Human
tggccaatctataacaatcctaatcagtagaaactctggaaaaactgaggtcataatttctgaatctggtttgaatttggaatttgctccctcagctcaaaattaatattgtaaatttactgcaaatgtgttttctacttttcggactcagctagtagttttatacacaaagtttgctatctggcttaactagttactgaaagaaaaaggacatctccagctccttttctggcctttctcctattccactacttccctccacccaacacacacacacacacacacacacacacacacacaaccaacaccagtcactgaagatggggaagatggagttcttccttgaattccccttaggttgtatcattgtttggaagttattggttcttatccaaaagcagacgtggacagagtaaggagttttagctcagccatataaagtagcataagccccaggctttaatcttcctgtaaggctgcactggtatatagtcgttcttctactgaatataacagatccatattaacaagcatttattgagtgcttactttgaaaaccagtactctattgtccctcatattatctcatttaatttaattg

SEQ ID NO: 169082 - DNA, 601 bp, Human
ggccaatctataacaatcctaatcagtagaaactctggaaaaactgaggtcataatttctgaatctggtttgaatttggaatttgctccctcagctcaaaattaatattgtaaatttactgcaaatgtgttttctacttttcggactcagctagtagttttatacacaaagtttgctatctggcttaactagttactgaaagaaaaaggacatctccagctccttttctggcctttctcctattccactacttccctccacccaacacacacacacacacacacacacacacacacacacacaacaccagtcactgaagatggggaagatggagttcttccttgaattccccttaggttgtatcattgtttggaagttattggttcttatccaaaagcagacgtggacagagtaaggagttttagctcagccatataaagtagcataagccccaggctttaatcttcctgtaaggctgcactggtatatagtcgttcttctactgaatataacagatccatattaacaagcatttattgagtgcttactttgaaaaccagtactctattgtccctcatattatctcatttaatttaattgt

SEQ ID NO: 169083 - DNA, 601 bp, Human
ccaatctataacaatcctaatcagtagaaactctggaaaaactgaggtcataatttctgaatctggtttgaatttggaatttgctccctcagctcaaaattaatattgtaaatttactgcaaatgtgttttctacttttcggactcagctagtagttttatacacaaagtttgctatctggcttaactagttactgaaagaaaaaggacatctccagctccttttctggcctttctcctattccactacttccctccacccaacacacacacacacacacacacacacacacacacaccccacaccagtcactgaagatggggaagatggagttcttccttgaattccccttaggttgtatcattgtttggaagttattggttcttatccaaaagcagacgtggacagagtaaggagttttagctcagccatataaagtagcataagccccaggctttaatcttcctgtaaggctgcactggtatatagtcgttcttctactgaatataacagatccatattaacaagcatttattgagtgcttactttgaaaaccagtactctattgtccctcatattatctcatttaatttaattgttg

SEQ ID NO: 169084 - DNA, 601 bp, Human
tctataacaatcctaatcagtagaaactctggaaaaactgaggtcataatttctgaatctggtttgaatttggaatttgctccctcagctcaaaattaatattgtaaatttactgcaaatgtgttttctacttttcggactcagctagtagttttatacacaaagtttgctatctggcttaactagttactgaaagaaaaaggacatctccagctccttttctggcctttctcctattccactacttccctccacccaacacacacacacacacacacacacacacacacacacccaacaacagtcactgaagatggggaagatggagttcttccttgaattccccttaggttgtatcattgtttggaagttattggttcttatccaaaagcagacgtggacagagtaaggagttttagctcagccatataaagtagcataagccccaggctttaatcttcctgtaaggctgcactggtatatagtcgttcttctactgaatataacagatccatattaacaagcatttattgagtgcttactttgaaaaccagtactctattgtccctcatattatctcatttaatttaattgttgctct

SEQ ID NO: 169085 - DNA, 601 bp, Human
atttgaactcacgctgtgtgactccagagcctacatgtttaaccacacttagggttgccagataaaatatagttacactggatttttgggtaaacaaatcctaaatatttcatggaacatatttttactaaaagcacattttttgtttatctaaattcaaattcaactggggatcctctatttttatttgctaaatctagcaaccctaaccacactattctgccttctgtaaattcagatatccatatatttgggttgtttaatttgcagtttacacgtgcttgagtttttttttttttttacagaataaatgatgttaattcacatctacaaaactaggcttctggatttctctttccctccatttattgaagggcgggttggtctgatgccagtcttctccctgatagtgaagctaagtgcaagcttttctcttctgataaaaaaagacttcacttactgttggcacattctggccttctgcctacactgggctctctctccagtggccagctgtgtcttgcctggtgctcatcattatccaacttccttgcctcaggaatccttgactctttccaagatttgcagaggtgcatggcta

SEQ ID NO: 169086 - DNA, 601 bp, Human
cagtcttctccctgatagtgaagctaagtgcaagcttttctcttctgataaaaaaagacttcacttactgttggcacattctggccttctgcctacactgggctctctctccagtggccagctgtgtcttgcctggtgctcatcattatccaacttccttgcctcaggaatccttgactctttccaagatttgcagaggtgcatggctaagtagcagcttccttccagacaacagtgttcacagaaggaaagagaaaagaatcagtgggctagaacttagaagaactttatatataaagtctgttgaataaaacatataaataggcaatatatacaccaccaaatgaacaactcttgtttctccatgggtatcttccactctgatttagctctctcacaatgcacaatatgcacctgcctgtataccttctttcaccactcggatcacctaagctgaaaatatagaaactgttttcaatggccatcaagaaaccaactgtattgccgctcaaatcacacaatgcattaaaaaacaaatataaaagcctttggagttggctgatctttatcatcttttaacaatgtgaataaccgaaaagta

SEQ ID NO: 169087 - DNA, 601 bp, Human
gtcttctccctgatagtgaagctaagtgcaagcttttctcttctgataaaaaaagacttcacttactgttggcacattctggccttctgcctacactgggctctctctccagtggccagctgtgtcttgcctggtgctcatcattatccaacttccttgcctcaggaatccttgactctttccaagatttgcagaggtgcatggctaagtagcagcttccttccagacaacagtgttcacagaaggaaagagaaaagaatcagtgggctagaacttagaagaactttatatataaagtctgttgaataaaacatataaataggcaatatatacaccaccaaatgaacaactcttgtttctccatgggtatcttccactctgatttagctctctcacaatgcacaatatgcacctgcctgtataccttctttcaccactcggatcacctaagctgaaaatatagaaactgttttcaatggccatcaagaaaccaactgtattgccgctcaaatcacacaatgcattaaaaaacaaatataaaagcctttggagttggctgatctttatcatcttttaacaatgtgaataaccgaaaagtaat

SEQ ID NO: 169088 - DNA, 601 bp, Human
ttctccctgatagtgaagctaagtgcaagcttttctcttctgataaaaaaagacttcacttactgttggcacattctggccttctgcctacactgggctctctctccagtggccagctgtgtcttgcctggtgctcatcattatccaacttccttgcctcaggaatccttgactctttccaagatttgcagaggtgcatggctaagtagcagcttccttccagacaacagtgttcacagaaggaaagagaaaagaatcagtgggctagaacttagaagaactttatatataaagtctgttraataaaacatataaataggcaatatatacaccaccaaatgaacaactcttgtttctccatgggtatcttccactctgatttagctctctcacaatgcacaatatgcacctgcctgtataccttctttcaccactcggatcacctaagctgaaaatatagaaactgttttcaatggccatcaagaaaccaactgtattgccgctcaaatcacacaatgcattaaaaaacaaatataaaagcctttggagttggctgatctttatcatcttttaacaatgtgaataaccgaaaagtaattgt

SEQ ID NO: 169089 - DNA, 601 bp, Human
tctccctgatagtgaagctaagtgcaagcttttctcttctgataaaaaaagacttcacttactgttggcacattctggccttctgcctacactgggctctctctccagtggccagctgtgtcttgcctggtgctcatcattatccaacttccttgcctcaggaatccttgactctttccaagatttgcagaggtgcatggctaagtagcagcttccttccagacaacagtgttcacagaaggaaagagaaaagaatcagtgggctagaacttagaagaactttatatataaagtctgttgwataaaacatataaataggcaatatatacaccaccaaatgaacaactcttgtttctccatgggtatcttccactctgatttagctctctcacaatgcacaatatgcacctgcctgtataccttctttcaccactcggatcacctaagctgaaaatatagaaactgttttcaatggccatcaagaaaccaactgtattgccgctcaaatcacacaatgcattaaaaaacaaatataaaagcctttggagttggctgatctttatcatcttttaacaatgtgaataaccgaaaagtaattgtc

SEQ ID NO: 169090 - DNA, 601 bp, Human
ttaatagctctccgcttttgtataaattcatttaatccttctaagcaagtctttctctttacaaaatgagactaataatacgtactttaatgtcatcattggtagcattagatattgtgaaaactgtaaaatcacataccaatgccaggtcacatttttatcatgggcccttcctgagtgaagggatggtatttttcctgcctttgtatccttagcaggaagcataagggcttgctaagtggcaagcttaaaaatatattttctaaacatttattagatggaagcttctttttattgataygtatcacaatcttcttaaagtcttcaattggtcctagaagtgtctatgcttttcctgtcagttctaagaataatggtgttctttagcattacaacctagaactgaattgtaaaagtgccctaagtttggggaggaagaaattctcagccaataataacatgaaaagaaatgtacctagtctgtttctcttcaaacgtctgaacttcatgttagaaaagttgcttccagggtataaagactttctttttgagggctagtgatgttactgttagagttagacaggggtatggatgctctaca

SEQ ID NO: 169091 - DNA, 601 bp, Human
taagcaagtctttctctttacaaaatgagactaataatacgtactttaatgtcatcattggtagcattagatattgtgaaaactgtaaaatcacataccaatgccaggtcacatttttatcatgggcccttcctgagtgaagggatggtatttttcctgcctttgtatccttagcaggaagcataagggcttgctaagtggcaagcttaaaaatatattttctaaacatttattagatggaagcttctttttattgatatgtatcacaatcttcttaaagtcttcaattggtcctagaagkgtctatgcttttcctgtcagttctaagaataatggtgttctttagcattacaacctagaactgaattgtaaaagtgccctaagtttggggaggaagaaattctcagccaataataacatgaaaagaaatgtacctagtctgtttctcttcaaacgtctgaacttcatgttagaaaagttgcttccagggtataaagactttctttttgagggctagtgatgttactgttagagttagacaggggtatggatgctctacagatttcatgaaagtgcataactacattcagtggctatttga

SEQ ID NO: 169092 - DNA, 601 bp, Human
cctctactaaaaataaaaaaattagctggccgtggtggcctgtgcctgtagtcccagctactcgggaggctgaagcaggagaatcgcttgaacctgggaggtggaggttgcagtgagccaagaccgtgccactgcactccagcctggtgacagagtgagactctgtctcaaaaaaaaaaaaaaaaaaaaaatttacttcctcagttgcattagctgcatttaaagtgctcaatagccatatgtaactcctgtattggactatgcagataaagaacatttccatcacagtgcaatgtttatygaacagtgcagctcactatgctttagggactaattaggcatagaatgaggaagatggattaaaggaggcttcggtttggcagctgagtgactgagaaaggtagtgccatgaacagaaaagaggaagtcaggaagaggaggagctggatttaggaagaaaggtgtttagtttctgtcaaatactaggccagataaagtgtctacccaaatcatcagatatccctggtgaaaggaaagggcagggaaagcaaagtgcccattgggttctcccaaagcttgtaaaggagccctgggaggattt

SEQ ID NO: 169093 - DNA, 601 bp, Human
gacagaagcccaagggctttgctgtttccttagctccttggagccagcttgaacctttttctcacagatgctttgtgcttcctgtcccctaaccgccttactcacccttccccatgctcaacttttggaaagtccccttggcctcacttgtttgattacttcctctcaaactacttctcacagggaccacagcaaaccattgactctaccactttttacttgccctgtcttccctcccagcttaaattccaaggtctatcactataatcactcccttacataatactcctacccctctcayaggctttccccagcaaaactcagacctggtcaaatacaattctcctccaacccccaagcaatggagtgtggctggaggagaatcacacggccttgctgagtggtctcactttaatgtatgatcatcaactcaagagggccctcagcactgtccatgctaagcttctctagtcacttttccactcttcaaggagattatttctcaccttcttctatctcctttaatagccaacagcttttcattgcatagagaacagatcttacctcatcaatcccagtgaggcagccagtacatatggca

SEQ ID NO: 169094 - DNA, 601 bp, Human
cttccagcccctttcccgccttctttaccctcatgtcttccgtagcttaccatgtgttcgccttttcagtgttacttttcatgggtctctgcttcttccctgaattttgttagggaagaggtcacggtgtgattcttgttatccttcaaactagcggcttggtaagagtatctcttgcccccttaatcaggaagttaaggacggtgtcttcagccgagttgtgtaatttactgctacggggagaagatgagaggaagacatttgtgcctacaaaatgggatctcctcttagggctgagaamcagagtttagggaacctttgacctcttggaaaaagaactgccattgaggagtaatgcattctgttttgggagggaaaatcattttgttacttctttgaagggaggaggtataagaaatgaaatagaataatagagcagaaggtcaatgagccacagccctacaggtagccagccactcttcttaggtggcggatgatgtttttgttttgattacagtaagaataaagtatcagctcttagatttaacttggggctcctaccttcaaaagcatgaagggccgtctcagaagagatgctgct

SEQ ID NO: 169095 - DNA, 601 bp, Human
caaactagcggcttggtaagagtatctcttgcccccttaatcaggaagttaaggacggtgtcttcagccgagttgtgtaatttactgctacggggagaagatgagaggaagacatttgtgcctacaaaatgggatctcctcttagggctgagaaacagagtttagggaacctttgacctcttggaaaaagaactgccattgaggagtaatgcattctgttttgggagggaaaatcattttgttacttctttgaagggaggaggtataagaaatgaaatagaataatagagcagaaggtcartgagccacagccctacaggtagccagccactcttcttaggtggcggatgatgtttttgttttgattacagtaagaataaagtatcagctcttagatttaacttggggctcctaccttcaaaagcatgaagggccgtctcagaagagatgctgctggaaacaggatttggaaactttctttgggtttcctgtcagaatgtgtgggggtggacatgcctatgtgtagtttttctttccttgtgatgtaatttatttctgtgatactttgacataataagcattaaattaggccccagacttt

SEQ ID NO: 169096 - DNA, 601 bp, Human
taaagttaataggcatttattcacaaaattttgcattagttttagggaccctctgaggccaaccatgaacttatgtcttagaagtgaactggatggaatccctcagtgttacacagttccatattaaaacagctcaaaagcctttgttcactttttgtatggcttcaagaaggacagtatctacacttaatataccccagaagacaggtatattcatatacgttgttcctgtagtccttctgaaaatgaatcccaaggaaatattccaaaagaaagaaaatgttgtatatgcacatgttcrtttaattattttaatagatgggaagaaaaggaaactacttgcccaacagcagaaagatacacaattttgcaatcactgaaaaaggttagaagtgaagattattaatctcctaattgatcttccagcttccactcttgcccctccaccccaagttgatttccacacagcagctacaatgatgctcacaaacttcagaacaagtctctcttctattcaaaaccctccagtgttttcccatctcattcacagtagaatccaaagttcttaccatggcctacaagccttacagctgcccagcta

SEQ ID NO: 169097 - DNA, 601 bp, Human
gatacacaattttgcaatcactgaaaaaggttagaagtgaagattattaatctcctaattgatcttccagcttccactcttgcccctccaccccaagttgatttccacacagcagctacaatgatgctcacaaacttcagaacaagtctctcttctattcaaaaccctccagtgttttcccatctcattcacagtagaatccaaagttcttaccatggcctacaagccttacagctgcccagctatttccctaatctcaagcccctttacttttcctcttgcttactgtactccagccacrctggcctcctacatcccaaaaaggtcaaatacactgaggtgtctgcacttaatgtcctctctgcctgtaacctttttccccaaggcagtatatatccctcacttcttcaggtctctgcaccagtctcaggtcttcccttactacccttccctgccactgtttctatcctctcaccctaccttatactcttaagactaggttatactgattttgacagccacagttgttgacaaacattccatggtaatgtcgcttgtatacttgcattggacattattgtttaacatttaaaaaataatg

SEQ ID NO: 169098 - DNA, 601 bp, Human
ctccagtgttttcccatctcattcacagtagaatccaaagttcttaccatggcctacaagccttacagctgcccagctatttccctaatctcaagcccctttacttttcctcttgcttactgtactccagccacactggcctcctacatcccaaaaaggtcaaatacactgaggtgtctgcacttaatgtcctctctgcctgtaacctttttccccaaggcagtatatatccctcacttcttcaggtctctgcaccagtctcaggtcttcccttactacccttccctgccactgtttctakcctctcaccctaccttatactcttaagactaggttatactgattttgacagccacagttgttgacaaacattccatggtaatgtcgcttgtatacttgcattggacattattgtttaacatttaaaaaataatgtcagtcataaaaagataactttcagattgttaagttgaatttttcaatagctcacatttaaattttggatgttagcttacctctcttcaacatttaactacaggatgctaattgttggatacagagatgaattagacagggtctctgccctcagggagtttcacag

SEQ ID NO: 169099 - DNA, 601 bp, Human
aagtgttgggattacaggtgtgagctactgtggctggcaacaaaggaatttttaatggtatctgtaatttgtttaatttctgttttgtatgatgcttttagaatattatagctgtgaccgccccatgttttgttctttgagacagagtcttgctctgtcacccaggctggagtacagtgatgtgatcttggctcactgcaacctctgcctccgaggttcaagggattctcctgccttagcctcctgagtaactgggattacaggcacgtgccaccacacccggctaatttttgtatttttwtttagtagagacagagtttcaccatgttggtcaggctggtcttgaactcctgacctcatgatccgcccgcctcggcctcccagaatgctggactcctgcggctgagactattgtttttgttaaataggtcaacattgaaattttatttggtttataggggatgacgacaccagccagttttgatagaaaactataccactgtgagggctttgcccagaatttctggttctggaacctagatggcttgatttggcataggtggggagctttgacatctacacaagggagtgggttgaatca

SEQ ID NO: 169100 - DNA, 601 bp, Human
tacaggtgtgagctactgtggctggcaacaaaggaatttttaatggtatctgtaatttgtttaatttctgttttgtatgatgcttttagaatattatagctgtgaccgccccatgttttgttctttgagacagagtcttgctctgtcacccaggctggagtacagtgatgtgatcttggctcactgcaacctctgcctccgaggttcaagggattctcctgccttagcctcctgagtaactgggattacaggcacgtgccaccacacccggctaatttttgtatttttttttagtagagasagagtttcaccatgttggtcaggctggtcttgaactcctgacctcatgatccgcccgcctcggcctcccagaatgctggactcctgcggctgagactattgtttttgttaaataggtcaacattgaaattttatttggtttataggggatgacgacaccagccagttttgatagaaaactataccactgtgagggctttgcccagaatttctggttctggaacctagatggcttgatttggcataggtggggagctttgacatctacacaagggagtgggttgaatcacttgagttactt

SEQ ID NO: 169101 - DNA, 601 bp, Human
aatttctgttttgtatgatgcttttagaatattatagctgtgaccgccccatgttttgttctttgagacagagtcttgctctgtcacccaggctggagtacagtgatgtgatcttggctcactgcaacctctgcctccgaggttcaagggattctcctgccttagcctcctgagtaactgggattacaggcacgtgccaccacacccggctaatttttgtatttttttttagtagagacagagtttcaccatgttggtcaggctggtcttgaactcctgacctcatgatccgcccgcctcrgcctcccagaatgctggactcctgcggctgagactattgtttttgttaaataggtcaacattgaaattttatttggtttataggggatgacgacaccagccagttttgatagaaaactataccactgtgagggctttgcccagaatttctggttctggaacctagatggcttgatttggcataggtggggagctttgacatctacacaagggagtgggttgaatcacttgagttacttgaaagcaccttgctctgtttctgacatgtgatagggacaccgtaaatgttcattgaacctca

SEQ ID NO: 169102 - DNA, 601 bp, Human
cgacaccagccagttttgatagaaaactataccactgtgagggctttgcccagaatttctggttctggaacctagatggcttgatttggcataggtggggagctttgacatctacacaagggagtgggttgaatcacttgagttacttgaaagcaccttgctctgtttctgacatgtgatagggacaccgtaaatgttcattgaacctcagatcacttctaatctcgtgattctaaaattctcttattttagttggtcaatgaaaataactaatgtaaagcatttatattttaatattggratacatttgaaattgtgaatgtaagtttactcgtttataatgtcccttttcaaattaattggttataacaattaattgattacatctaatcatttgtaagaagagttacggcctatttccaagaattttttgcttattctgatgtcatataattgctgcattacttaatgccagattcatatcttatgaaaaagattagcattaaacaaaaatatttaagctttagtatgttactgagacagatgaagtgtccattttttcttttattgtgtgcatgaagtatggggattacaagcagta

SEQ ID NO: 169103 - DNA, 601 bp, Human
tatggggattacaagcagtagtttttatgtgctttttagtttttcatatacaaagataatgttaatattagctcatttacattttgaaacttttgtaatagtggtatagatttgcactgcataattcacattctctcagtctcctgcacacagttgtgagatgactggttaagagggcactttgtttcaaagttaaatgatccagatgagtattgaacctataagcttagctttgttcattatcatgaggttctgatcaacaaagcagttcaacagagaaccatgccatgctgtcatttcygcttgaaaataagccttttagaggtagaaggtacaaacatgcatatacacatgcaccaataaaaaaaggaaattgtgtatggttattaaggtagagttgaaacaggaaataacgtgcgtttataagtggtttaaaaataattcttttaataaaattttcagaaatacttgatatacgcatggaaaattaaatgttttatgaaataaactccaatcagtagacaagttaatggcttttttaaaagcactaatgacttatttacttaggctatataaatttaggttagataaatctgaaaaa

SEQ ID NO: 169104 - DNA, 601 bp, Human
ttgttttctaacagcttatgagtattagaccaaatcagtttcccagttgtttaaaatagagttaaataagaattgtttgctttactgcctgttttacttcagtccaagacttattttttgtaaatagcttttctgcatatgtatacatacacacacacacacacacacacacacacacatatgcatgtatatacacacgttgtagggaagttgtttcctggttcagctagcaatttcaattctctgtttaacgtcagaagttgttttgtagaatgggatgttaatatttttttctacactkattaaaatcatcctttgccactaaagtcaagtatctgctaggacagaaatgtgcaaatagcatgcgtaaatgtgcatttttagtgactgttgttagcttgacagttttattttcaagatcctcttctctcccgacctaattaattatgatgtgtttataaggcaacaataatatatttagttagtttgcaaaatgagaacaatttttctggtttttccatttttgcatgttttgagtttggattaattggacttgtattattctcagtagacatatataataaaatagtccatttaactg

SEQ ID NO: 169105 - DNA, 601 bp, Human
ggtactactgagttttggatgacattctttacacaacctaaaagtaaaggtgagcataatagaagctggaaacaagctgctgggcataatagaagctggtaacaagtctgacgttttctttgcactaggaaatgtatttcttattccaagtaatatgcccttgttaggttcaggatctttttcagtggttataactgcttaaacatttttttttctgtttaaagtaattcatgttatactgtggcaaattttgaaaaaaatgttaagtgtaaagaataaattgaaaacatccatgatcctrtcatccagaaaaaattactactgatactttaatatacatttttccagtttattccttgcatgtacggattttttatttattttttttacgaaacttagaattataactttatatatactgttttgatcatacttttttttcctgaatgggatgttggtctcctagtttgagactttaaagttgattctttataatattactgttttaaataacactgggacagacattttttgtacatgtatctttgattgcatctctgttttttttttcttcctgtaggatagattcccagaagtggga

SEQ ID NO: 169106 - DNA, 601 bp, Human
gggataactggatcagagggtgattaccctgtgtataagagtatgtgtctcactgcaccttcaatggcattgagtaggtcagtttttacaatctttgccaatgtgatagatatctgttacattcttgggtggtaatagcagaaatcctcatattattaataatctgtaaaaccatcatagtgtatgaaagaaatttgcaattgtcctgaaatgagtttctttaaaaatattttaggtaaaagtaatctgtgaccaaaaaaaaaattactgattaaagttggaatttcagcatttttttttttggagagctagaattttaatgttcttttattaaaatgacaaacatgagaaagcttgttttatagtatgtaataaatataaatattatgtaaaactaaattatttcagatagatgaggggggtagtcacatggttctgactttgaaaaaacaaaaaaaaaatctgtgaatgtttagagcagtagctctggagttgggcagcctgggtttgtgtccttgctttgccacttactaagtacatgattggaggcaacctgctaaatatgtgtatgatttgatttttctgaaccttggcttcctta

SEQ ID NO: 169107 - DNA, 601 bp, Human
tgcagtaattttatttagttagcattttgagttcttggttaacaggatatcctcgcttttagactttgtatttctggagctattaccttaaaactcttcactgtaaggtgaaattcttctgcatgtggtttttgtagcatttgtgattgctgcaggactttaaaaaaaccagtcgtgtgagcagaggtgatgagaagtgaaatacagacttcttgtttgttaagcagcttctaagtaaaatataggagcaaaaaaatgggaaattgtgtgtatgatgtttagaaaaacattacttttagtrttcctgttttctctctcagccctgaattttcctaattaaaaaaagagagtttgcagatgccatttttagtcattctagaacctgactagagctctactcatactttccacttgactgaataatataaagcaagttagccagagattgatattaatagtatttctttttgactgataagtaaactcacatgaactgtgaattgtctgctcggtatcttccaatggagaaaagaagcaaccaccaatttaaaaaaatacaggcttgtgatacttataaggtgtttgcattttttaaaacagt

SEQ ID NO: 169108 - DNA, 601 bp, Human
ttatattgactcaaatcattatcatacattgtagcgatttgcagattgttaaggaaataaaatattgtacttatcccttcaagatcctagcactgggttttgttagtttttaagtctttggcaatttgagaattttgattagcttttacttatgtgattaataagatgtcattgcagttggtagacaaaaatctttaaacacgtgaaatccatggaatagaataaagtttttttatagaaaggttgggagccattgattaatgtcctatctgtaatggacctacagggagaagggaactcwtatgtttttgagtgtagaccccttacatcctatttaatttgcacagtaaatctacaaagtagatattgttattgtccagtttttttacaggtgatgaaactcaaagtaattatgtaatttgtgaaaatttacacagctctaattatagagaatcacgtgggtagtaaacttccagaagaagggacttttgcaatacaaagcagaaaataggtgatcaatacatatttgtatcttgcttaaatgtaaacatgaatgaatgagtaaatgacaggagactgcctctgtccctatactgttttc

SEQ ID NO: 169109 - DNA, 601 bp, Human
gtgatgaaactcaaagtaattatgtaatttgtgaaaatttacacagctctaattatagagaatcacgtgggtagtaaacttccagaagaagggacttttgcaatacaaagcagaaaataggtgatcaatacatatttgtatcttgcttaaatgtaaacatgaatgaatgagtaaatgacaggagactgcctctgtccctatactgttttcagtgagtcacaccatttttctcctaaatgagtctagaaaatttcttcagaaataaagtgacttaacctgtctttttttccataaatcatayggtgaaaatcctgaggagagaaataaagaccaaacacttacaaagtataattttctcttgggctttgttaactgagtaatttgtagagtttttggctttaaaaaaaaaaagtctgctttgcaccatagtgttcattatcaataacatcttttggttctgtttatatcttaattttttttgtaaccatttaagaatttagtattctgaaatgaggtgatggaattacagtagtccaaatgtttatgtagccagtgttagttgtctgcctaatatctatcacagtctgtggggagtggggca

SEQ ID NO: 169110 - DNA, 601 bp, Human
tcttcagaaataaagtgacttaacctgtctttttttccataaatcatacggtgaaaatcctgaggagagaaataaagaccaaacacttacaaagtataattttctcttgggctttgttaactgagtaatttgtagagtttttggctttaaaaaaaaaaagtctgctttgcaccatagtgttcattatcaataacatcttttggttctgtttatatcttaattttttttgtaaccatttaagaatttagtattctgaaatgaggtgatggaattacagtagtccaaatgtttatgtagccartgttagttgtctgcctaatatctatcacagtctgtggggagtggggcagggttggtggcatgtgtttgtttctgtcttctattagaatatcaaagtgtgtgatttgttgctcagaaatatgaactcataattctgggtcatttaatggttagtaggataaatgagggctttttttttttttaaactaatgcctacacccaggcagaataggagtatgaaatctctaaaccctgtgtttataaagtttctaatccttcaaattaattaatatcttaataaattctaagtttagtattcttt

SEQ ID NO: 169111 - DNA, 601 bp, Human
tataagtaattgagaaattgaaagaaatcagagtaaggttgagaaaggaacgtaattatgatacagaatttaccataggggaataacacatggaagttgacgtgctagactgtggaaaaggaatttattttctcaaaaaagagaaatgaaattgatggaatgagggctaggaggaggtaaattatggttgaaggagtagaatactttggattagatattggagcctacggccaggtgtggtggctcatgcctgtaatcccagcactttgggaggtcgaggcgggcggatcacctgaggtcrggagtttgagatcaccctgaccaacatggagaaaccccgtctccactaaaaaaaaaaatacaaaaaaactagctgggcgcggtggcgcatgcctgtaatcccagctactcaggaggctgaggcaggagaatcccttgaacctgggaggcagaggttgtggtgagccaggatggtgccattgcactgcagcctgggcaacaagagcaaaacttggtctcaaaaaaaaaaaaaaaaaaaaaaaaagatactgcagcctgcagggaccttcagagagaatatgattaatctgtcaccatttgt

SEQ ID NO: 169112 - DNA, 601 bp, Human
tactcatcctaatattcccattaggcttcagacgtggactgctgtcacaacagaacatacttgagatgtgtcaccactcagtgccatctgcctacatgggtacataagctatatagtaggccttaaatattggacataaagaatcattgctttgtggttttcttagctgactctgcttaacttctagtgttctgggctgagcctgtagtcaattttgatcttttgcatttataacaacactcccataaccacatgttcagtgtcctctgtgtgttggtataccaaagatggacatgtgaarttttttaatagtgcaaagaaattggctgtttaatcagtaaaatttaaaggtgattttaaaaacattcaaatatttgagagagtgccctttatatgaaggaccaactatctcttccctccctggttaattttcacaatataataaatattttttagttatataggccaaagtgttctatagaaaatcaatcataaaattgcatttgtctgtgctatttttaaaaagttctctattgttacattggtaaatgcagattaccagtgtttacatagtatgattttagtacttatttttaaaata

SEQ ID NO: 169113 - DNA, 601 bp, Human
acaccaaaagacctagattattatctctgatgtatgggttatagatattttattatatgttatatattatatgtattattatatgtcatatattttatttcccttgttaagccttttatgaactttacatttatatatatatatgtatgtatgtatgtatttatttatttatttattttattcatttattttttcgagatggagtctcactctgttgccaggctggagtgcagtggtgtgatctcggctcactgcaacctccacctcctgggttcaagcgattcttctgcctcagcctccygagtagctgggattacaggcacgcaccgccacgcccagctaatttttgtatttttagtagagacggggtttcaccatgttggccaggatggtctcgatctgctgacttcatgatctacccgcctcggcctcccaaagtgctagggttacaggcatgagccaccacgcctggcctgttcatatattttataatcaaactaaaagttctaaaatcaattcattatagagtatgaaattaaatttaataaagcttttaaagataaagattcttaggtgataaaatgagttaaaggctttacaa

SEQ ID NO: 169114 - DNA, 601 bp, Human
ttttctgggcatggggatgggagaaataggaaagattttgtactgttgtaccttgccttggaaaccttttgattcttctaactcagatttgcttcagttacgtcatatgctgttttatggataagtgtttaattataggatttaaacttatttatataaatggtatgcaaaatcttgctttgaatatttggtcatttgtatttgtggtcagcaggcaaaacactttgcaaaagtttgcatgtagtgcctaccagtttttctcagttttctcatctgtcagtggagaaagaacaatatctayatcttgtttgaggattaaataagcatgcctgaggtacaagaagcacttaaaattattgctgctgttattaccccaaagttgggattgatgtttctttgttttctttgtgttttgttttgtttctgaaacagtgtctcactctgtcgcccagggtggagttcagtggctgcaatctctgctcactgcaacctctgcctgcagggttcaagcaattctcatgcctcagcctcccaggtagctggggttataggcttgtgccaccacacccagttaatctttttatttttagtagagatggag

SEQ ID NO: 169115 - DNA, 601 bp, Human
tcaggtgatccccccacctcagcctcccaaagtgttggaattacaggtgtgagccactgtgcctggccagcattgatgtttccatgaaactgaggtaaaagatccctagggactggaacaatatcttatgccatgtatcccctattttggtcaaccctgtgtattccccattaattaagtgggacggttagttcctcacttaggtagtttcattgtttatgtatacaataaatctttggcattcacgacttaatagtttagacctaaagtatttagcatgaaaaatttataatctggtatrggcaaaattttgaattcaaggctgatgtgctgaacaagtctgttaactagagaattgaatatagctgacagtatcccagtttttattacccaacagtgacgtgacttttgttctctacttaattttcatcctagaattaaaaactgtttctttgtgaatttagtgcccggggaaagccagtagttaatactggtttttgcagatttagataaactcttgattttagacaacaaacactatggcaataaagtaagtttattttagtagcaattcaattcatgagtgttgcttatttctttt

SEQ ID NO: 169116 - DNA, 601 bp, Human
tgagccactgtgcctggccagcattgatgtttccatgaaactgaggtaaaagatccctagggactggaacaatatcttatgccatgtatcccctattttggtcaaccctgtgtattccccattaattaagtgggacggttagttcctcacttaggtagtttcattgtttatgtatacaataaatctttggcattcacgacttaatagtttagacctaaagtatttagcatgaaaaatttataatctggtataggcaaaattttgaattcaaggctgatgtgctgaacaagtctgttaactrgagaattgaatatagctgacagtatcccagtttttattacccaacagtgacgtgacttttgttctctacttaattttcatcctagaattaaaaactgtttctttgtgaatttagtgcccggggaaagccagtagttaatactggtttttgcagatttagataaactcttgattttagacaacaaacactatggcaataaagtaagtttattttagtagcaattcaattcatgagtgttgcttatttcttttctgttcttcacaatgtcttgcgcccagtggagataatgaacaataaggt

SEQ ID NO: 169117 - DNA, 601 bp, Human
acagtaccccatctctaatggataaatactatagatgtatagtagtatgtgaatttgccatcatttgtttaaatgatttgtctatagttttcaattttttattataaaagttctactatgaatatcattatagttgaatttttccatgcatccttaattatttctgtaggataaattccaaaaagtagaattacttcattctgtacattttaatattttttggtgtatatgacttagaaagtgaaagtccatttccccaaggacagccaccatcaaaatcaatctttgtctagccttttcytgtatatatcctaacataaataactatatatattatttatataaaacctacatataaataattttatatagctgtttctgtctcttaaaaaagaaaaatatattgttccttaactacagcaagttgcttttttgcctaacgcattttgcctgagagattttagtcatcccatatcactatgtataattctacctcattcttgtaagctgtatgatacatagtaatttgtccattcttctacggaaggatcttttctttcccattttgttttgtttttgcgtatgtctttgttttttattt

SEQ ID NO: 169118 - DNA, 601 bp, Human
ttccttaactacagcaagttgcttttttgcctaacgcattttgcctgagagattttagtcatcccatatcactatgtataattctacctcattcttgtaagctgtatgatacatagtaatttgtccattcttctacggaaggatcttttctttcccattttgttttgtttttgcgtatgtctttgttttttatttctgcagcataaattcccatttgtaatagaattctgggtcatttatgaattgaaagtactttatatgtgctggtctttttctgtgtttatttttctttctttctttcttttctgtttttgtttttgagacagaatcttaatcctacccccgggctagggtgctgtggcagggtcacggcttatccactcaggtgattcccccaccttagcctcctgagtagctgggactacaggcgcatgccaacatgcctggctaactttttgtattttttgtagagacagtgctttgctgtgttgcccagaatggtcttgaactcttgggctcaagccattcacccacctttgccccccaaagttctgggattataggtgtgagccaccgtaccctgtgttttctatttttttca

SEQ ID NO: 169119 - DNA, 601 bp, Human
tcaaatatgccttttaatctttggtttattgattgaagtattttggacttatactctttctgctatcaaggttttattctttttaaaggagatacactatcttttttacatttctggtaatgtgtttagtttaggtacatcatactgtgttgtttctgcttatttctgtagttctctacttataccttcagagttatacatagattttcctgaggtttattaatctaatatagctcaaaatatcagaatagatgttatagtaggtaacacttttctgaattagaatccgattttttaagartctagtgttttggctggatttatgtaggtttctttatgagaaaacagtaaacattgcagaagaattacactttgctttttaaagtagaaatgtgtttagtttctaaaaatgctaatttttttctgagactattctttctttaaatgtagccactcacagcattgttaaaatttttaaatgttgattctgatactatatactattagtaactaatacattatgaactttttttttttttccttaggacatactgtcaggtgagattctcaaatggttttagtgttctggaagagttagttt

SEQ ID NO: 169120 - DNA, 601 bp, Human
ggaaggccaaggtgggaggatagcttgagcccatgagtttgagaccagcctgagcaacatagtgagaccctgtctctacaaaaattaaaacaaaaaattagcagggtgtggtggtgcatacctataatcccagatactcagaaggctgaggtgggaggatcgcttgagcatgggaggttgaggctgcagtgagccatgattgtgccactacactccagcctaggtgacagtgagaccctgtctcaaaaaaaacaaaaaacaccactatttttgttaagtaatgtattttaaaaggaatacragtaatgccctgaaaagtacagatcaagaaaagaatgcaaatgagacaaaaataatggttatcagtttgctgtgtatccttacagaagtttcctgtaaaaacatgcatatgtacatatatgcatatatagaaataattagttttctttttacaattccttttgtttttaagtcttcaggtgtagcaatgagacaagaagactagttctatattagcatgttagcaaataaaaattccattcttcagagataagttttgtcaagtttctctcatctttctgcttgctcctcccttcactct

SEQ ID NO: 169121 - DNA, 601 bp, Human
gaatccaaggggccatcttcctcagtttctctatcttctagaaggaaggggtgtgtgcgtgtgtgtgtgtgtgcgcgcgcatgcacataggtctttgtaatcctttaaattctctaagaaatgtaccaccacagatttctaatttattctagtattggttcatccatagtgtttgtatactttaattctaaagaaaaataatatttgcatagtacagattagatagacaagaagatgactggtaaggcaatatagtattgtagttaaccacactgatgctagagccacagtgccagagttwtaatcctggctccataatttatgtatgttgagcttggacaagttagttttagcctttttgcctcgtctataaaatggggacagtaggctgggcacagtggctcaaacctataatcccagcactttgggaggccaaggtgggcggatcacctgaggttggtagtttgagaccagcctaaccaacatgaagaaaccctgtctctactaaaaatacaacagttagccgggtgtggtggtgcatgcctgtaatcccagctacttgggaggttgaggcaggagaatcacgtgaacccgggaggcg

SEQ ID NO: 169122 - DNA, 601 bp, Human
tgaagttaatgcgtcttctgataaactagagtaggtgttaactttttttttttttttgagacggtgtctcactgtctcccaggctagagttcagtggcactatcttagctcactgcaagctccgcttcctaggttcacgccattctcctgcgtcagcctcctgagtagctgggactacaggcgcctgccaccacgcgcggctaattttttgtatttttagcagagacagggtttcaccatgttagccaggatggtttcgatctcctgacctcgtgatccacccgccttggcctcccaaggwgctgggattacaggcgtgagccgccgtgcccagcctttttttttttttttttgaggcaaagtctcgctgtgtcgcccaggctggagtgtagtgtgatcttggctcactcctgggttcaggtgattctcctgcctcagcctcccgggtagctgggactacaggtgtgcgccaccacacccggctaattttttgttattattagtagagatggggtttcaccgtgttggtcaggctggtctcaaactcctgatcttgtgatctgcccacctcagcctcccaaagtgctgggattacaggcgt

SEQ ID NO: 169123 - DNA, 601 bp, Human
gggccagatagtaagtactttaggattttggggccatatggtccctgttgcagatattcaactctgctgttatagggtgaaagccatttacataagcaaatgagagtgattgtgtctcctttatttatgaacactgaaggtgtccttaaatatagaaacagtccttagttcacaagccacgcaaaaacagacagtggcccagatttggcctgtggttcatagtgtgctggcccctgaagtaaggtaaacaaacctgcacattctgataactattttagacgtcttttctttcttggacatkccttcatttttaaatttctctgtacattgggatactctagaaagttaattttttggcatcaagtttagaactttaaaattctactcacagctttgagcttaagctgtttattagcactatttgaaacagtgaaactttgtgaactctctcctcctcaaacaatgacatatataactgtatttagggttctttggttgcaagcaacagaaccatcatggttcattggagattttattctttggtacagaatttaacttaaatgccttgtggatgtacatgaaactgagtcctttatttcag

SEQ ID NO: 169124 - DNA, 601 bp, Human
attgggatactctagaaagttaattttttggcatcaagtttagaactttaaaattctactcacagctttgagcttaagctgtttattagcactatttgaaacagtgaaactttgtgaactctctcctcctcaaacaatgacatatataactgtatttagggttctttggttgcaagcaacagaaccatcatggttcattggagattttattctttggtacagaatttaacttaaatgccttgtggatgtacatgaaactgagtcctttatttcagagtcatagcagcaagcaaatgacaayccgtgcttatcatcagcactggtgtgtagtaggtcttctctcagagaactgggcagatacctacagaacctataagaccatacacacattcacataccatacacacacatgcatacattatgtaaataaagatacttatttcaaggaattggcttatgtgattgtgggggctggaaagtccaaaatctatatggcaggccaacacattgcagattctgtagctgaagctgataatgcagtctttcagtagaatttcttcttcagcgaaacctgagttttgctcttaaggcttttcaactg

SEQ ID NO: 169125 - DNA, 601 bp, Human
ggaattcttgtacaagtaaacatcttttccttttgtacccctcatcactgcgaatttgatagaacccttagtaaatgaccaggttgttttttacacttttttttctctcccacaacgtaacatgggtttggcaagctttaaaaaatgttagtatgtttgtatccactagtatacctctgaccatttaataggagatccctgccaattagagctagtgatgttttgttctaatttggagagacagggtgtgtctgtctttaaattctctgtcagttttcctttttgtaaaaaaaaaaaaaamaaaacaaaacctcaattcccaaattataaataaatttgagcaattgcagactaagggaataagaatgaatgaatgaatgcatccattggagtagaacatcttctctttttctttctttttttttggacggagtctcactctgtcccctaggctggagtacagtggtgcaatctcggctcactgcaagctccacctcccgggttcacgccattctcctgcctcagcctcccgagtagctgggactacaggtgcccgccaccacacccggctaatttttgtatttttagtagagacggggtt

SEQ ID NO: 169126 - DNA, 601 bp, Human
ttcttgtacaagtaaacatcttttccttttgtacccctcatcactgcgaatttgatagaacccttagtaaatgaccaggttgttttttacacttttttttctctcccacaacgtaacatgggtttggcaagctttaaaaaatgttagtatgtttgtatccactagtatacctctgaccatttaataggagatccctgccaattagagctagtgatgttttgttctaatttggagagacagggtgtgtctgtctttaaattctctgtcagttttcctttttgtaaaaaaaaaaaaaacaaaacaaaacctcaattcccaaattataaataaatttgagcaattgcagactaagggaataagaatgaatgaatgaatgcatccattggagtagaacatcttctctttttctttctttttttttggacggagtctcactctgtcccctaggctggagtacagtggtgcaatctcggctcactgcaagctccacctcccgggttcacgccattctcctgcctcagcctcccgagtagctgggactacaggtgcccgccaccacacccggctaatttttgtatttttagtagagacggggtttcac

SEQ ID NO: 169127 - DNA, 601 bp, Human
gacgagtggaacaccttcttaacacagaactagttgatttattttttcctaatgcttggctttttccaagtttttgttacccaagataacattagtcaaactagcactttgagaaaaggagttaaagtttttttattgttaaatttgggtaactggtcatattttcctttgtctcttactgtctcatacccttagatcaggggtctccaacccctgggccacagactagttagtaaaggtccatggcctgttaggaaccaggctgcacagcaggaggtaagcagcgttgagtgttactgcmtgagccccgcctcttatcagatcactagtggcattagattctcataggagtgcaaaccctattatgaattgcatatgtacataatctagcttgcacgcttcttatgagaatctaatgcctgatgatctgttgctgtctcccatcacccccagatgggactgtctagttgcaggaaaataagctcagggttcccactgattctacagtatggtgagctgtataattgtttcatatcattattattattacagtgtaataataatagaaagaaagtgcacaataaatgtaatgcgtttgaat

SEQ ID NO: 169128 - DNA, 601 bp, Human
ctttttccaagtttttgttacccaagataacattagtcaaactagcactttgagaaaaggagttaaagtttttttattgttaaatttgggtaactggtcatattttcctttgtctcttactgtctcatacccttagatcaggggtctccaacccctgggccacagactagttagtaaaggtccatggcctgttaggaaccaggctgcacagcaggaggtaagcagcgttgagtgttactgcctgagccccgcctcttatcagatcactagtggcattagattctcataggagtgcaaaccmtattatgaattgcatatgtacataatctagcttgcacgcttcttatgagaatctaatgcctgatgatctgttgctgtctcccatcacccccagatgggactgtctagttgcaggaaaataagctcagggttcccactgattctacagtatggtgagctgtataattgtttcatatcattattattattacagtgtaataataatagaaagaaagtgcacaataaatgtaatgcgtttgaatcatcctgaatccatctcccacgcccactccagtctgtgaaaaaattgtcttccatgaaa

SEQ ID NO: 169129 - DNA, 601 bp, Human
catctcccacgcccactccagtctgtgaaaaaattgtcttccatgaaactggttctgccaaaaaggttggggatcgctgccttaaattatgtagataaacgtaacagatatttgtggttatatcagggactattataacattttttctgtattaatctagatatttagctaaagctcaacatgctttacagattgatatggctaatgtttcaattgtttgcttcttgctactgtaaggtttcttagaattagggctctagatctttttttttttttccttcttttaaattaagagatgagktccaagctggtctcaaactcctaaccccttcccaccttagcctctcaaagtgctaggattactgacatgagccagtgtgcctggccagggatccagatctaatacatgttaagatcatagcttttagaatgtttagtcataggtatttaactgtagtttcttcctttgaaccccgaacttcaaggcgtttagtaacacttttaaggtctgtgttcaggtggtttttggtttgactgtaaatacttttttctgtttaacatttcttagttcaaatctaggtcacaacctgtctgtactctt

SEQ ID NO: 169130 - DNA, 601 bp, Human
ctcaacatgctttacagattgatatggctaatgtttcaattgtttgcttcttgctactgtaaggtttcttagaattagggctctagatctttttttttttttccttcttttaaattaagagatgaggtccaagctggtctcaaactcctaaccccttcccaccttagcctctcaaagtgctaggattactgacatgagccagtgtgcctggccagggatccagatctaatacatgttaagatcatagcttttagaatgtttagtcataggtatttaactgtagtttcttcctttgaacccygaacttcaaggcgtttagtaacacttttaaggtctgtgttcaggtggtttttggtttgactgtaaatacttttttctgtttaacatttcttagttcaaatctaggtcacaacctgtctgtactcttgtagagaattttattttttaaattttatttatttatttatttttcacagtcttgctctgttgcccaggctggagtgcagtggcacaatcttggctcactggagcctctgcctcccaggttcaaacagtgtgtgtgtgtgtgtgtgtgtgtgtgtgtattttttttttttttgac

SEQ ID NO: 169131 - DNA, 601 bp, Human
tttcttcctttgaaccccgaacttcaaggcgtttagtaacacttttaaggtctgtgttcaggtggtttttggtttgactgtaaatacttttttctgtttaacatttcttagttcaaatctaggtcacaacctgtctgtactcttgtagagaattttattttttaaattttatttatttatttatttttcacagtcttgctctgttgcccaggctggagtgcagtggcacaatcttggctcactggagcctctgcctcccaggttcaaacagtgtgtgtgtgtgtgtgtgtgtgtgtgtgtrttttttttttttttgacttccagtgacctttgaactttttattggcttcctgctccccaaagggtaccctgcttctgctggcttaattctcagaactttggtgtcattggtctcagataccactttgccatccactatctggtggatggtcgtcttttggatggttcgcatggagttgctgctgtccagggcatcaccaagattgaagtccttgccatcttccagcaggtggtggtaggtggcgatctcagcctctagtttgaccttgatattcagcagggcctcgtactcactcctggg

SEQ ID NO: 169132 - DNA, 601 bp, Human
tttttttttgacttccagtgacctttgaactttttattggcttcctgctccccaaagggtaccctgcttctgctggcttaattctcagaactttggtgtcattggtctcagataccactttgccatccactatctggtggatggtcgtcttttggatggttcgcatggagttgctgctgtccagggcatcaccaagattgaagtccttgccatcttccagcaggtggtggtaggtggcgatctcagcctctagtttgaccttgatattcagcagggcctcgtactcactcctgggcctggygttgcccctctgcccgggtctgtgccagctctgactgcagttgcagcaggatcccgttaagctgctccatctgcaggaagtagagggcctccacctccctcagtctgttctacaaactggccttcacatttctcactgagtccaggtcaatctttaaggactggactgtatgtctcagctctgtgagcgtcatcttagcctctccagcctcagcagactgcgtggtgaccactgtggtgccctcctcaatctgctgagaccagtacttgtctagctcctgtcgattctttcaagccagct

SEQ ID NO: 169133 - DNA, 601 bp, Human
taccctgcttctgctggcttaattctcagaactttggtgtcattggtctcagataccactttgccatccactatctggtggatggtcgtcttttggatggttcgcatggagttgctgctgtccagggcatcaccaagattgaagtccttgccatcttccagcaggtggtggtaggtggcgatctcagcctctagtttgaccttgatattcagcagggcctcgtactcactcctgggcctggcgttgcccctctgcccgggtctgtgccagctctgactgcagttgcagcaggatcccgttwagctgctccatctgcaggaagtagagggcctccacctccctcagtctgttctacaaactggccttcacatttctcactgagtccaggtcaatctttaaggactggactgtatgtctcagctctgtgagcgtcatcttagcctctccagcctcagcagactgcgtggtgaccactgtggtgccctcctcaatctgctgagaccagtacttgtctagctcctgtcgattctttcaagccagctcattgtattgggccgagatgtctgccatgatcttgctgtcctgagatttgggggcatct

SEQ ID NO: 169134 - DNA, 601 bp, Human
atctgagctctcacgtcctcgatggtcttgaagtaatggccccagtccctgagctggggtcccttcttctccaggtgctcctggattttgctctccagcttccggttctcggtttccaggctctcactctgtccaggtaggaggccaggcattgaggcgttgcatggtctcctcattctggatgcctcccattcctgccagcccctcggccatccctgcagccagaccccaagctgtcccagaagctggtggagtgggacacggagatctgggaaccagagcccccagcacctggatagaygctggccaggcgccatagctggctgccttgacagagctcagggactggtagttggtggataaggtgaagcgagtggtaaagctcatgctctctggggaggagagtgagaggataggactcaggctttgccgacgaccagaatattagatattatcattgcctaatatccctttcttcttttgctgttgataatcaaaactttattactgattctgacttgatttttgaggtttggttcccatagaatttttagcagagaggttagtatttaaagggatatttaatacattatttctttta

SEQ ID NO: 169135 - DNA, 601 bp, Human
gtaatggccccagtccctgagctggggtcccttcttctccaggtgctcctggattttgctctccagcttccggttctcggtttccaggctctcactctgtccaggtaggaggccaggcattgaggcgttgcatggtctcctcattctggatgcctcccattcctgccagcccctcggccatccctgcagccagaccccaagctgtcccagaagctggtggagtgggacacggagatctgggaaccagagcccccagcacctggatagacgctggccaggcgccatagctggctgccttgasagagctcagggactggtagttggtggataaggtgaagcgagtggtaaagctcatgctctctggggaggagagtgagaggataggactcaggctttgccgacgaccagaatattagatattatcattgcctaatatccctttcttcttttgctgttgataatcaaaactttattactgattctgacttgatttttgaggtttggttcccatagaatttttagcagagaggttagtatttaaagggatatttaatacattatttcttttagctagaataagctaaaggtgcaaaagaatgaa

SEQ ID NO: 169136 - DNA, 601 bp, Human
tgataatcaaaactttattactgattctgacttgatttttgaggtttggttcccatagaatttttagcagagaggttagtatttaaagggatatttaatacattatttcttttagctagaataagctaaaggtgcaaaagaatgaatgttgtcttaggttcctaagacctggaaaaccggtctgaatgcttttatgcactgggttaacctttatgccattcagaatgtgagaccagtttggtctgattttcattcctctgttaggcttaaaaaagaatcaccacactgttcattgatgtcrttaggattattaggaaaaatgtttgttatgagtatgaagacccagagaactcttgtttacacttattttaatagtgaaaacttggttttgatttagaattcttctaacaatatatataagtaatatttgtggagtggtagagtgctttttttttttttttttttttttacatttactaagtttgtctcatttgatcttcacaattctgtgaaaaaggtaggacagatagtgtcactcctacttttaaagataagaagtttgggcttcaaagaaattcagtgacttgccctgagataaata

SEQ ID NO: 169137 - DNA, 601 bp, Human
gacacatacttattatgcagagtccatagtttaccttagagttcacttttggttttgtatattctatgggtttggacaaatgtaaaatgatgtgtgtccaccttatagtttctttcttttttttttgagacagagtcttgctctgtcgcccaggctggagtacagtggcgcgatcactgcaacggctcactgcaacctccgcctcccaggttcacaccattctcctgcctcagcctcccaagtagctgggactacaggcacccgccaccacgcccggctaatttttttgtatttttagtasagatggagtttcaccatgttagccaggatggtctcgatctcctgacctcgtgatccgcccgcctcggcctcccaaagtgctgggattacaggtgtgagccactgcgcccgtcttcaccttatagtttcatacagatggttttgctgccctaaaagtcttctgtgttcctgtcttgtttgtttgcttgttttggctatatataaagaggaacagatagcaagttcttccacattgtattactgtaattttaatcttatttgtagttgtgggatttagaaatacttgattcagaagtatgtc

SEQ ID NO: 169138 - DNA, 601 bp, Human
tcgccatattggccagtctcgtctcgaactcctgatctcaggtgatccacccaccttagcctcgcaaagtgctgggattataggcctgacccagttcaagtatttttagaacctctgttcttgtattcatagaccctgtgcaaatctctatgtggaaatacaaaataatccttaccttgcattcagcaaagttgacgttgacagcaaaggcaaggctaattatgaaacagttagaggagaggtcaccaaactttggtccaagacctgttttgtatggccctcaagctaagaatggtttttrctttttaaagagttttttttttttaaataagaaagaataatatgtgacataggccatatgtggctcacaaagcataaaacatttaccatctagctcttcatagataaagtttgctgactatgaattagaagaatatatatcatataaaatataaacagagaccttagggaaacgcaaatcaaaaccataatgagatattatttcatacacactaggaaggctgtaatttaggggaaaaaaggacaataacaagtgttggccaggatgtagagagattggaactctcatacattgctgatg

SEQ ID NO: 169139 - DNA, 601 bp, Human
tattcatagaccctgtgcaaatctctatgtggaaatacaaaataatccttaccttgcattcagcaaagttgacgttgacagcaaaggcaaggctaattatgaaacagttagaggagaggtcaccaaactttggtccaagacctgttttgtatggccctcaagctaagaatggtttttactttttaaagagttttttttttttaaataagaaagaataatatgtgacataggccatatgtggctcacaaagcataaaacatttaccatctagctcttcatagataaagtttgctgactatgrattagaagaatatatatcatataaaatataaacagagaccttagggaaacgcaaatcaaaaccataatgagatattatttcatacacactaggaaggctgtaatttaggggaaaaaaggacaataacaagtgttggccaggatgtagagagattggaactctcatacattgctgatgagaatgtaaaatggtacagccactgtggaaaacagtttggcagttcctgagaaagttaaacatatgctaaagagatgcaatgaaaaagaataaataaataaaaataaaagaaaaatatagagt

SEQ ID NO: 169140 - DNA, 601 bp, Human
cttgaggccaggagttggaggctgcactaagctgtgatcgtgccactgcactccagcggtgacagagtgagaccctgtctgaaaaaataaatgtgggccagaccatagaccaagtagttatagcaaaagagagtttctaaattactcacaacagaacttccattcttaaactagtcttttgctttaatccactggtacccaatccttagcagttataaaccaaactcatgagctatgaggggaaaatgaccatgggaaacatagatttaatgcaaaataactgaaaaaaaagaaaaaaaaacaatgcaataaaacaaaaaaaaaacaacagaaattaacttgagcgtgataaacagctaaaagcaaacaatatctgagggaaaacgggataatcaaaaaaagtggctattcttaataaatagaacagactgcttgataggaacaaactttttttaaagataaatgaaaaagaatacgcattcacaaaagaaaaaagcacatgactgataaatatttgaaaactttaacctcactaatcggagaaacttagagtaataaaattttgataatacagttaactaaataggaacatttatgttga

SEQ ID NO: 169141 - DNA, 601 bp, Human
actgcactccagcggtgacagagtgagaccctgtctgaaaaaataaatgtgggccagaccatagaccaagtagttatagcaaaagagagtttctaaattactcacaacagaacttccattcttaaactagtcttttgctttaatccactggtacccaatccttagcagttataaaccaaactcatgagctatgaggggaaaatgaccatgggaaacatagatttaatgcaaaataactgaaaaaaaagaaaaaaaaacaatgcaataaaacaaaaaaaaaacaacagaaattaacttgagygtgataaacagctaaaagcaaacaatatctgagggaaaacgggataatcaaaaaaagtggctattcttaataaatagaacagactgcttgataggaacaaactttttttaaagataaatgaaaaagaatacgcattcacaaaagaaaaaagcacatgactgataaatatttgaaaactttaacctcactaatcggagaaacttagagtaataaaattttgataatacagttaactaaataggaacatttatgttgaaactgtgctattagggatatggtgaaatgggacccacacattcc

SEQ ID NO: 169142 - DNA, 601 bp, Human
tatagaaatacagtcacacatcacttaacaacatatctcctagctgtgatcacaccactgcagtccagcctgggcaacagagtgagaccctgtctctaaaataattaagtaaataaataaagtaaatcattcaattcaaccttagcttattgtaacttttttactttataaactttttgactcctgtaataacacttagcttaaaacacaaacacattgttgtctgttaaaaaaaatttcctttctttagttccttattctataaactttttttctatttttaaaattttttactttttaracatttttgttaaaaactaagacacaaacacacatattcacctaggcctacactggttcaggatcattaagatgtcactaggcaataggaatttttcagctccattgtaatcctatgggaccaccatcacatatgcggtctaaacaatgcggattaaaacaatgtcctgcagtacctggctgtattctgtaaatgttgattagatccaattgattgatggtgttgtttacttcagctacgaccttactgattttctgcctgccggatctgtcagttactgacaagggtgttgagggctcc

SEQ ID NO: 169143 - DNA, 601 bp, Human
ttttactttataaactttttgactcctgtaataacacttagcttaaaacacaaacacattgttgtctgttaaaaaaaatttcctttctttagttccttattctataaactttttttctatttttaaaattttttactttttaaacatttttgttaaaaactaagacacaaacacacatattcacctaggcctacactggttcaggatcattaagatgtcactaggcaataggaatttttcagctccattgtaatcctatgggaccaccatcacatatgcggtctaaacaatgcggattaaracaatgtcctgcagtacctggctgtattctgtaaatgttgattagatccaattgattgatggtgttgtttacttcagctacgaccttactgattttctgcctgccggatctgtcagttactgacaagggtgttgagggctccagctataataatggattcatctgtttctccttgcagtatccatttttgcctcatgtattttgacactgttgttagatgcatgcacattaagaattgttatgtcttcttggagaattgatgcctttatcgttatgtaatactcttcttcatacctgata

SEQ ID NO: 169144 - DNA, 601 bp, Human
agggctaagattgttcctcaatcagatgttttcaaaacaaaggtgtctagggggtgttatttctcttcacaaaattaatagctctgggaacaaaaaatttgtgtagaactgtagcacttacgaggataggaaactcataacactctggccatactaagagagatttgatgctcttatatgagcaaacagatttaataaacagcgattctaatagttttctaatgtggcagtgtttttatcaactaaaacattgattctcttcactttagtttgggaaggaaaaaagcattaagcttctgtacctaaaatatgttattaaatatgttgtttacttaacagaaaccagtgaggtatcttagtccagctttgttgtgtaaataaagaagttgaatattaatgaggataaatgacttgtcttggctcacacaacttatagatcctgattttggacccagatattcctgcaaaagtctctttggttttgttgttgttgttgttgtgtttttgacacagtcttgctctgtcgccaggctggagcaagtggcatgatcttggctcactgtaacctccgactccctgattctagtgattctcctgcctc

SEQ ID NO: 169145 - DNA, 601 bp, Human
cagcgattctaatagttttctaatgtggcagtgtttttatcaactaaaacattgattctcttcactttagtttgggaaggaaaaaagcattaagcttctgtacctaaaatatgttattaaatatgttgtttacttaacagaaaccagtgaggtatcttagtccagctttgttgtgtaaataaagaagttgaatattaatgaggataaatgacttgtcttggctcacacaacttatagatcctgattttggacccagatattcctgcaaaagtctctttggttttgttgttgttgttgttgtgtttttgacacagtcttgctctgtcgccaggctggagcaagtggcatgatcttggctcactgtaacctccgactccctgattctagtgattctcctgcctcagcctcctgagtagctgggattacaggcacgagccaccatgcccagttaatttttgtatttttagtagagacagggtttcaccatgttggccaggatggtcttgatctcctgacctcatgatccacccgccttggcctcccaaagtgctgggattacaggcgtgagccaccgtgcctggccaaggctctttgtttttga

SEQ ID NO: 169146 - DNA, 601 bp, Human
taataaagtagtgatagtagtatttttaagtggataattgccaggcactctcctaagtgctacatatgcattatctaatttggtgttcacagcaacattgctgaactatgtcccttactttaagattagccctccatctaaatggtctcaccacattttaaagattgcttggattaattgaattaccgaatatagtggaaaaggtcttaggcattagtgttagacgacacctagctttgaagccaaggtcaaccccttttttctttcattcaataaatgtttattgagcatctactatttyccaactattgttctgagcactaggaatggcatcttttatctgcattttgaagggaagataatgtctgccttgaaggttgctaaagtctaagaaaaaggcacttaaaaaaaaaaggtttgcttccttgccctcctaactgatcttccttctctagtttttcattcctctgttgcaatctacagagtactcatagagctttcttttttctcttcaaactcttgctcaaaagccttagatggcttttctcatctgataggaaagtttcaagttcataggatgtcatagaggaacttttatagc

SEQ ID NO: 169147 - DNA, 601 bp, Human
atgggccaggcacggtggctcacgcctgtaatcccagcactttgggaggccacggagggtggatcacctgaggtcaggagttcaagacgagcctggccagcacggtaaaaccctgcctactacaaatacaaaaaaattatccgggcatggtggcacatgcctgtagtcccagctacttgggaggctaaggcagaagaatcgcttgaaccaaggaggcggaggttgtagtaagctgagattgcgcaactgcactacagcctgggcaacaaagtgagactctgtctcaaaaaaaaaaaaaaamaaaaaacaaaaaacaaaaccacatatgtactaagtcctttcctctctcaccctttcacagtaaatgctcaggccacctagacttttttttaaatataagttttctattagatcatcacagagtctcttgagtctctgccttttttctggaattccatgtctataacattctgtctacctacacccccttcctctccctgggcttcaagaaatacatacaaagtacacagtgaaaaatctcttttctttccatgtcctgtcattcctcagcttccttcccaaaggtattctatgcatatac

SEQ ID NO: 169148 - DNA, 601 bp, Human
gtagtcccagctacttgggaggctaaggcagaagaatcgcttgaaccaaggaggcggaggttgtagtaagctgagattgcgcaactgcactacagcctgggcaacaaagtgagactctgtctcaaaaaaaaaaaaaaaaaaaaaacaaaaaacaaaaccacatatgtactaagtcctttcctctctcaccctttcacagtaaatgctcaggccacctagacttttttttaaatataagttttctattagatcatcacagagtctcttgagtctctgccttttttctggaattccatgtctrtaacattctgtctacctacacccccttcctctccctgggcttcaagaaatacatacaaagtacacagtgaaaaatctcttttctttccatgtcctgtcattcctcagcttccttcccaaaggtattctatgcatatacaagttttatgtacatgaatgaatacaggcagattggcatgttagattgtgaaccctgaaaccaggttgcctgagtttaaatcgtggcttttcttcctagatatgtgactttggggatattactagtatctgccttgtaagcttattgtgaggatttcttaca

SEQ ID NO: 169149 - DNA, 601 bp, Human
gcgcaactgcactacagcctgggcaacaaagtgagactctgtctcaaaaaaaaaaaaaaaaaaaaaacaaaaaacaaaaccacatatgtactaagtcctttcctctctcaccctttcacagtaaatgctcaggccacctagacttttttttaaatataagttttctattagatcatcacagagtctcttgagtctctgccttttttctggaattccatgtctataacattctgtctacctacacccccttcctctccctgggcttcaagaaatacatacaaagtacacagtgaaaaatctyttttctttccatgtcctgtcattcctcagcttccttcccaaaggtattctatgcatatacaagttttatgtacatgaatgaatacaggcagattggcatgttagattgtgaaccctgaaaccaggttgcctgagtttaaatcgtggcttttcttcctagatatgtgactttggggatattactagtatctgccttgtaagcttattgtgaggatttcttacagcacttcctggcacatggtaagcactcagtaaatgtttgccattactattgttgtgttgttgttatataacagcataa

SEQ ID NO: 169150 - DNA, 601 bp, Human
atactaatacctgcaaaaactgtcatttagggattatttgtacagttctatgtggtaacactcagccatgcaacatgtgcatatattagtttccatatgtaaaatctggaattactgaaacaatctgtcttagactttttttgatgaagaattagattaaaaactccttatttataacaacatggtagtcattgaatgtaagaactcagatcacattgcagatattctaaaaatagaatgtaaattaggttttaacactaattctgagattattatatgtggcaaataatttgaatgataytcagcagtctaatttaggtaatcaaatcacagagatttaaaaaaaaaaagcattgatttgcatttgtgatcagtattgcttaggaaaaatgcctgatactataagagtatataaagttttgactcaaaggggtcagggaagcatatcttagggaattaatacttgtgctcagatccaaggaaaagagcaggcattattaactaagtggagaaggaagaagtcattgcaggcaaagggaatagcttctgcaaaagccctgtggcagaagggagcatatcaggtttaagaaactgaaagatg

SEQ ID NO: 169151 - DNA, 601 bp, Human
atgtggtaacactcagccatgcaacatgtgcatatattagtttccatatgtaaaatctggaattactgaaacaatctgtcttagactttttttgatgaagaattagattaaaaactccttatttataacaacatggtagtcattgaatgtaagaactcagatcacattgcagatattctaaaaatagaatgtaaattaggttttaacactaattctgagattattatatgtggcaaataatttgaatgatattcagcagtctaatttaggtaatcaaatcacagagatttaaaaaaaaaaagcattgatttgcatttgtgatcagtattgcttaggaaaaatgcctgatactataagagtatataaagttttgactcaaaggggtcagggaagcatatcttagggaattaatacttgtgctcagatccaaggaaaagagcaggcattattaactaagtggagaaggaagaagtcattgcaggcaaagggaatagcttctgcaaaagccctgtggcagaagggagcatatcaggtttaagaaactgaaagatggccagtgtggctgtcatagagagtaaatagggatatggagcaagatagg

SEQ ID NO: 169152 - DNA, 601 bp, Human
agtagtattctgtgattaaattatcacacttttattatagattatattcttgataactaatattcataattttatgttgagaatattataaagaaatgttttcatcaaatgtagattcatggctgggcatggtggctcactcctgtaatatcagcactttgggaggccgaggcggctggatcacttgacgtcaggagttcgagaccagcctggctaacatggcgaaacctgtctctactaaaaatacaaattagctgggcgtggtggcccgcacctgtaatcacagctactcgggaggctyaggcaggagaattgcttgaacctgggaggcggaggttgcagtgagccaagatcgcgccatcacactccagcctgggcgacaagagcaagactccgtctcaaaaaaaaaaaaaaatgtgggttcatgacttctcactgtgaagaagtgcatattggccatttaagattttttaaatgaaggtcccattttacaactggaaacctaaaggaacagtatcaaggaactgacataagatatgctcagaggctaaaaagtaagtgaaagctagactcagcactcagagcctatttttgtcttgat

SEQ ID NO: 169153 - DNA, 601 bp, Human
gctagactcagcactcagagcctatttttgtcttgatggcacctactgaaccagctaaacctgggcttatggtttcattgccttcgcagacatagaggataggagactaagctcagtctatgaggagactccaccgagtgtctgtgcacccctccccacccctactcctgccaactccgaggaaactggactgtcacaaatgttggcactaagttgaagtggtggtgcaggtttgggggttgttattctttgacattttatagttgcaacctagcctttatgtttccatatctaaatcacrctttttgggttagcccaaaagtatcttaaaatttgactatggttcaaagtaattctggccactagtaactccaggcacttgcagaagcaaatgcacatcacagtaaaagatcacacaactcaaaaagaaaaagagactgaaaatacggattatccaggataacagacaactgaattggacccccattgacttcatattttggaattattagacaggaatttaaaatcagtgtgtttagcgaggtaaagattaaaaatataagaatgatgggattatgatagctaacattttgtagtgctt

SEQ ID NO: 169154 - DNA, 601 bp, Human
ccatctctacaaaaaaatacaaaaattagctgggcatggtggtgtgtgcctgtagtcccagctacttgggaggttgaggtatgaggatcccttgagtccaggaggtcaaggctgcagtgagctgtgccactgcgttccagcctgggcaacagaatgagaccctatctcaagaaaaaaaaaaaaaagaaaaaaaagaaagaaaagaaatgtataaataaaaatcttaaaagtcaatggacaggcttaacaatagattataattagtgacctggaagatgacctgaaaaataagttaaccaarataaagagacagaaatggaaaatatgtaaaaaggaaaaaagaaaattggacaaccatagcctaaattgctagttttccctgataccattctgtgtctaataagtagtggatatattagttggatgctctgttgcctagctaaaacttctgtttcattgccttcctgatagtgagatttgactatgtgacaaggctttggtaatttggggtgcaaattgaaatgtgtgtaacttctagatcatgcctgtgagaggaaaggggatatgccgttttctttatctttcttcctgcccatgaact

SEQ ID NO: 169155 - DNA, 601 bp, Human
tgtgtaacttctagatcatgcctgtgagaggaaaggggatatgccgttttctttatctttcttcctgcccatgaactggaatgtaaacatggcaatgagatatttttgcctgtgtagaagggggcaatactctaaggatgacagagcaataagacataagagcttggctctctcagactacctagctgccaaacaagagtgtcatgtgagaggaaaataaccctgaattttggttaagccacttttgagtctcttattaacagcagccagtgtctacatcttaactaatccaagaagagcrtgaaaaggtctaatagttgtctaaccagaatttcagatatgaagaaaaatcaagtagatacagtatttaaggagattacaattagaatttccaaaactgcaaaaagatacaaattcaagaagtcaaatcctaagcagagtgaatagaaatgtaaacctaaagtcttcatagttaaatttgcagatgatcagagatgtcaaaaataaccagaaggacaacacagatcactttcaaaagctctgcaattaggctagcagctgacttattgaaaggaaagtagaaatcaaaagacagtagaat

SEQ ID NO: 169156 - DNA, 601 bp, Human
cagataaataaaactgggagtttttttttgttctcactatttgcacagcactaagaaagattccaaaagatatactttaggtagaaggaaagtgacccctaatggaggatctgaaatattaattaggaaagaaaaatggtcccaggcgcattggtgcattcctgtaatcccagcaccttgggaggccaaggtgggcagatagcttgagcctaggagttcgagaccagcctgggcaagatggcgaaaccctgtctctaccaaaaatacaaaaaaattagccggacgtggtggcatgcacctstagtcccagctactctggaggctgaagtgggaagattgcttgagctcaggaggcggaggttacagtgagccaagatcatgccactgcactccagcctgggtgacagagttgagactctgtctcaaactaacaaacaaaaaaaccaaaaatggctgaaattattgaggcaggtatccaacttaggttagaaaaacattagaataaactaaagaaaggaaataataaacataaaagcagaaattaaagaaatagaaaagaggtctacaatgaaacatcaacaaagccaaagttggttgtttg

SEQ ID NO: 169157 - DNA, 601 bp, Human
aagaaaaatggtcccaggcgcattggtgcattcctgtaatcccagcaccttgggaggccaaggtgggcagatagcttgagcctaggagttcgagaccagcctgggcaagatggcgaaaccctgtctctaccaaaaatacaaaaaaattagccggacgtggtggcatgcacctgtagtcccagctactctggaggctgaagtgggaagattgcttgagctcaggaggcggaggttacagtgagccaagatcatgccactgcactccagcctgggtgacagagttgagactctgtctcaaacwaacaaacaaaaaaaccaaaaatggctgaaattattgaggcaggtatccaacttaggttagaaaaacattagaataaactaaagaaaggaaataataaacataaaagcagaaattaaagaaatagaaaagaggtctacaatgaaacatcaacaaagccaaagttggttgtttgaaaaagactaataaaagtaacaaacctggtaaaatgaccagaagtaaaagaggaagggcacagataaacaatccgaatgaaaaaggagatataactaaagatgtggcagatttttataaaagagagaa

SEQ ID NO: 169158 - DNA, 601 bp, Human
agtggcgtgatcttggctcactgcaacctccgcctccctggttcaagcgattcttgtgcctcagcctcccgggtagctgggattacaggcacatgccaccacacctggctaatttctgtattttcagtagagacagggttcaccatgttggccaggctagtcttgaactcctaacctgaagcgatccacccgccttggcctcccaaagtgctgggattacaggcatgagccactacgccctgccagctccagtaatttttgacatgttacattttaattattatttagttcaaattgtttwatttccatcttgatttctttcttcacttatggattatttagaattctgtttcatttacaaacatttggggataatgtggttatatttttatgttgatttctagtttaatttcattttggttagaaattacactctgtatgatttcagtccattgaaatttcttgagacttgatttatggctcagcatggtctgttctagtaaattatccatgtacactggaaaaggatgtatagtttgcagttgttgggtgtggtgttctatatgtctcttaagttgattcattatctgctcaaatcttc

SEQ ID NO: 169159 - DNA, 601 bp, Human
attattatttagttcaaattgtttaatttccatcttgatttctttcttcacttatggattatttagaattctgtttcatttacaaacatttggggataatgtggttatatttttatgttgatttctagtttaatttcattttggttagaaattacactctgtatgatttcagtccattgaaatttcttgagacttgatttatggctcagcatggtctgttctagtaaattatccatgtacactggaaaaggatgtatagtttgcagttgttgggtgtggtgttctatatgtctcttaagtagattcattatctgctcaaatcttctatatatccttcctggttttgtcttccctttctgtcatttactgagtaagttctgttaaattctattcatgattcccattctgtcaagttttgctttgtatgctttaatttatatttaaattttatttttctattgagtgctattaacataaattaatattaacatatttatatacatggattgtctgacatctttccatttattttcagtttgttgatctgttctttgtttctttgagattgttatttaggatactgcaagaaattcataatgtc

SEQ ID NO: 169160 - DNA, 601 bp, Human
ttccctttctgtcatttactgagtaagttctgttaaattctattcatgattcccattctgtcaagttttgctttgtatgctttaatttatatttaaattttatttttctattgagtgctattaacataaattaatattaacatatttatatacatggattgtctgacatctttccatttattttcagtttgttgatctgttctttgtttctttgagattgttatttaggatactgcaagaaattcataatgtcttgggtataaaattagggagtagctcagctgggtgaatcgagtctaartctctgatgatgttgcagtaagatggttgctgtctgggatcatcttgaagcctttattattcacagatgtgggaagacagaaacagctgggactctggcaaccatgtctttctctgtggtctctccaaagtggtggctgcacggcagcctaacacttaggactccatagataggtatccccaaagagaaaaaattcaggaggaagctctgatgccttttctaacctagcttaagaattcagacagcagcaccatgttggctggattttgttcattgctaaccctgcctgtattcaaggag

SEQ ID NO: 169161 - DNA, 601 bp, Human
aaaatgtcagcgatccccagactggaaagggggtagggatgtaggcatccttttacgtgaaatatatgctcttgtgtttagctgtcagtatttttcttttcatggacatcactttttttttttttcatggaatcacctaatacagatagaggtataagatgcctagtgtcccacacaaaactctcccacctcactctaccttttcaaaaatgtggtggttatttttaaaggctcacccagttcttaccttgcttctctttctcattggttgacctcatccactgctatggtttcaatgctrccatcttgaccaccattgactcccgagtctgtacctctagtccattggtttctacagaacctccagacttggcttttaaaatatctatcagatacctttacttgttcttcccataggaatctcatagttaatttttggaagaaagtattatctttctttttaaacctccttttgtatttcctgtcttaattggaggtaggctatcaaccacttacttgctcaagctagatacctaggagttatcactgactcttcttcattccttttagtagcttatcagttatggagtcctgtcagttt

SEQ ID NO: 169162 - DNA, 601 bp, Human
tagcttcctagctattctccctgcctctagtctcttctttcttcagtccatcttgcatactgtcagttgtttttccagaatacaaatctaatcatattaattgtttttaaatcactttgtcttttccccgttatttactagataaaatatgagctctttaacatgacaaatgccgagctatgtagtatccctggatcttttgtatttaattctttagtgtgtttgcttaagctgtttcctttgcttggaatgtccttctaagcattatagctgaaatattcctattcagttttttgcttakctcttcatatgagctagtcaaaatttaaaaaactgtcctgggccgggtgtggtggctcacacctgtaatcccagcactttgggaggccgaggcgggtggatcatgaggtcaggagatcgagaccatcctggctaacatggtgaaaccccgtctctacaaaaaattagccaggtgtggtggcgggcacctgtagtctcagctactcgggaggctgaggcaggaaaatggtgtgaacccaggaggcggagtttgcagtgagccgagatcgcgccactgcactccagcctgggcgacagagtg

SEQ ID NO: 169163 - DNA, 601 bp, Human
cactttgggaggccgaggcgggtggatcatgaggtcaggagatcgagaccatcctggctaacatggtgaaaccccgtctctacaaaaaattagccaggtgtggtggcgggcacctgtagtctcagctactcgggaggctgaggcaggaaaatggtgtgaacccaggaggcggagtttgcagtgagccgagatcgcgccactgcactccagcctgggcgacagagtgagactctgtctaaaaaaaacaaaacaaaaaaaacagcctggagtctcctctgttcgtccatccttccctagcccrttaattttgtcttgtaccagctttattcccattgctttgtagttatttgtttctttctcctttataagctccttgaggatggaaaacacatacttttcatttttgttaccttgacacctagtacagaactggtacctagaaaatactttgcaaatgcctgattcagaataatgatatttgccattatgtctgctttatagtgtcctcactatgtatgtatattagttcattttcatgctgctgataaagacatacccaagactgggcaaaagaaagagatttaattggactttgagttcc

SEQ ID NO: 169164 - DNA, 601 bp, Human
ggcacctgtagtctcagctactcgggaggctgaggcaggaaaatggtgtgaacccaggaggcggagtttgcagtgagccgagatcgcgccactgcactccagcctgggcgacagagtgagactctgtctaaaaaaaacaaaacaaaaaaaacagcctggagtctcctctgttcgtccatccttccctagcccattaattttgtcttgtaccagctttattcccattgctttgtagttatttgtttctttctcctttataagctccttgaggatggaaaacacatacttttcatttttgttwccttgacacctagtacagaactggtacctagaaaatactttgcaaatgcctgattcagaataatgatatttgccattatgtctgctttatagtgtcctcactatgtatgtatattagttcattttcatgctgctgataaagacatacccaagactgggcaaaagaaagagatttaattggactttgagttccatgtggctggggaagcgtcacaatcgtgacagaaggcaaggaagagcaagtcccatcttacgtggatggcagcaggcaaagagaaaatgagaatcaagtgaaacaggt

SEQ ID NO: 169165 - DNA, 601 bp, Human
actggtattctgagaaatttcccaaataaataattcaaggtgagatttgggtggggacacagagccaaaccatatcagtatgtatctagtattctgagaaatttctctctttcccgcattgaattaacttaaattaactttttaagctgtgatttacatgtaataaaatgtatatattttaaataattcagttcaataagttttggtaaataaatatacctatacaactattaccacaatcaagatacagatcattctcatcaccccaaaaagtatcctcatgctcctttgtagccattayccctgtgccaccaccactggccccaaacagctttctgtcactgttttatcttttctagattttattttatcttctctagatttttttttttttaagagaccaagtctttctctgttgtgcaggctggagtgcagtggtacaatctcaactcactgtaccctccgcttcccatgttcaagcaattctcctgcctcagcctcccgagtagccaggattacaggtgcgtgccaccacacccagctaatttttgtatttttagtagagatgaggtttcaccatattggccaggccggtctcgaa

SEQ ID NO: 169166 - DNA, 601 bp, Human
accacaccacaacctgcggtgccttttaggatctagacttggaagtcacatattttagcttctgccgtatcgtattggtcacatgacgaatcttgattcagcatgggagggaacttattcaaggatatgtataatgagagggaacgatacaaggtatgaatacaaggagaccaggatcattgattgagagctgtcttgcaggatggggtgtcacaatatacctttattaaaaatgaattaatgtgttgctgtgtttcgacttctggacttaatttggtttccctgatttgtatgtttgtcrttatgctgatatcacacaatatgtattactacagttttatagtctagaaatcagataatataagactttgttcttttttaaaaccatattagcttttctgaattatttgcattttcatataagttttaaagttatcttgtcagtttctacaaacactgctgattgagtttgcattgaatctgcagatcaacatgaagagaatgacatcttactaataatatgggcaaatactaatatatggcatagctctctattaagtctttaatttcagccatgttttgtagttttggtatataagtc

SEQ ID NO: 169167 - DNA, 601 bp, Human
tgtacttacacaaatctggatgtataatatagcataccacatacctaggctgtattgtatagcctactgcttgtaggctacaaacctgtacatcatattactgtacagaatactgtaggcagttgtaacacaatggtatttgtgtgtttaaacatagaaaagttacagtaaaaatgttattataatctataagaccaccaccgtatatgtaatagagtctgttgactgaaatgtcattatgcagcacatgactgttcaggtgggtttttttttttgtatcaactttttatcctgcaacttygctaaattcacttgttagtctggtagcatttttgtatattccttaagatttcctacatacaggattgtcatctgtggataaaagcagttttacttcttccttttgcatatgtactatacctagcttagtgcaatgtcaatagaagtggtaagagtagacatattgatacaataaaaagaaaaaccatatactatcagtaaatgcagtaaaagcattttgggaaaaaaaatccaacatcttttcctcagaacccagataaatgaaagctcttaagaatgtaaaagtgggggttccgggtaa

SEQ ID NO: 169168 - DNA, 601 bp, Human
ctacagcctctgctggtgacacccaggcaaacagggtctggagtggacctccagcaaactccagcagacctgcagaagaggggccagactgttagaaggaaaactaacaaacagaaagcaataacatcaacatcaacaaaaaggaagcccatgcaaaaacctcatccaaaggtcctcagcacaaagactaaaggtagataaatccatgaagatgaggaaaaaccagcacaaaaatactgaaaactgctgggtgtggtggctcacgcctgtaatcccagccctttgggaggctgaggcagayggatcgtgaggtcaggagtttgagaccagcctggccaacatggtgaaaccccgtctctactaaaaatacaaaagttagccaggtgtggtgcatttataatggttggtgccagctactcaggaggctgaggcaggagaatcacttgaactcaaggaggcggaggttgcagtgagccaagattgtgtcattgcactccagcctggacaacagagtgaaactccgtctcaggggaaaaaatgctgaaaattccgaaaaccagcatgcctcttctcctccaaaggatcacaactcctccccaac

SEQ ID NO: 169169 - DNA, 601 bp, Human
caggagtttgagaccagcctggccaacatggtgaaaccccgtctctactaaaaatacaaaagttagccaggtgtggtgcatttataatggttggtgccagctactcaggaggctgaggcaggagaatcacttgaactcaaggaggcggaggttgcagtgagccaagattgtgtcattgcactccagcctggacaacagagtgaaactccgtctcaggggaaaaaatgctgaaaattccgaaaaccagcatgcctcttctcctccaaaggatcacaactcctccccaacaagggaacaaaaytggatggaaaatgagtttgatgaattcacagaagtaggcttcagaaggtggataataacaaactcttccaagctaaagtgcatgttctaacccaatgcaaggaagctaagaaccttgataaaaggttgcaggaactgctaactagaataaccagtttagagaagaacataaatgacctgatggagctgaaaaacatagcacgagaactttgtgaagcatacacaagtatcaatagctgaattgatcaagtggaagaaaggatatcagagattgaagatcaacttaatgaattaaagcgtg

SEQ ID NO: 169170 - DNA, 601 bp, Human
tattaaccttaagtgtaaattggctaaatgccccaattaaaaaacacagactggcaaattggataaagagtcaagacccatcagtgtgctgtattcaggagacccatctcatgtgcaaagacacacataggcccaaaataaagggatggaggaatatttaccaagcaaatggaaagccaaaaaaaaaaaaaagcgggggttgcaatcctagtctctgataaaacagactttaaaccaacaaagattaaaaaaagacagtggcattacataatgataaagggatcaatgcaatgagagctamctatcctaaatatatatggacccaatacaggagtacccagattcataaagcaagttcttagagacctgcaaagagacttagacttccacacaatcatagtgggagactttaacacaccactgtcaatattagatcaacgagacagaaaattggcaaggatattctgaacttgaacccagctctggaccaagcggacctaatagacatctacagaaccgtccaccccaaatcaacagaatatacattcttctcagcaccacataacacttattctaaaattgaccacataattggaagtaa

SEQ ID NO: 169171 - DNA, 601 bp, Human
taaagggatggaggaatatttaccaagcaaatggaaagccaaaaaaaaaaaaaagcgggggttgcaatcctagtctctgataaaacagactttaaaccaacaaagattaaaaaaagacagtggcattacataatgataaagggatcaatgcaatgagagctaactatcctaaatatatatggacccaatacaggagtacccagattcataaagcaagttcttagagacctgcaaagagacttagacttccacacaatcatagtgggagactttaacacaccactgtcaatattagatcaaygagacagaaaattggcaaggatattctgaacttgaacccagctctggaccaagcggacctaatagacatctacagaaccgtccaccccaaatcaacagaatatacattcttctcagcaccacataacacttattctaaaattgaccacataattggaagtaaaatactcctcagcatatgtaaaggaacggaaataataagtctctcagaccacagtgcaatcaaattagaactcaggattaagaaactcactcaaaactgcacaactacatggaaactgaacaacctgctcctgaatga

SEQ ID NO: 169172 - DNA, 601 bp, Human
ttaaacataagccctaaaaccataaaaacccgagaagataacctaggcgataccattcaggacataggcatgggcaaagtcttcatggctaaaacaccaaaagcaatggcaacgaaagccaaaatgccacaaatgggatctaattaaaccaaagagcttctgcacagcaaaagaaactatcagcagagcgaacaggcaacctacagaatgggagaaaatttttgcaatctatccatctgacaaagggctaatatccagaatctacaaggaacttaaacaaatttacaaaaaaaaaacaacstcatcaaaaaataggcgaaagacatgaacagacacttctcaaaagaagacatttatgcagccaacaaacatatgaaaaaaagctgatcatcactggtcgttagagaaatgcaaatcaaaaccacaatgagataccatctcacgccagttagaatagcgatcattaaaaagtcaggaaacaacatatgttggagaggatatggagaaacaggaatgcttttacactgttggtaggagtgtaaattagttcaacctttgtggaagacagtgtggtgattcctcaaggatctagaaccagaaa

SEQ ID NO: 169173 - DNA, 601 bp, Human
cctataattccaacactttgggaggccgaggcgtcttgagccttacttaatggcctctttcattatgttgcgcaggctagtctcaaatgattcaaattcccaaaagtgagaatcacttgtgcccaggagtttgagactagcctgggcaacataatgagaccccatctctgcaaaagagaaaaaaaaagaaaaagaaaaagaaaattacccagttgtggtggtgcatgtctgtagtcccagctactcaggaggctgaggcggaaggatgacttgagcaagggaggtggagactgcagtgagytgtgattgtgccactgcactccagcctgagcaacagagtgagaccctatctcaaaaaaaaaaaaaaaaaaaaaaaaagttagtttataaagaagacctggaaccaaaaagtttgagaactggactaaagtaacctaaaatggtaactgtttaaagtaggtagggattcttaatccagggttcccaatactcttatagaaagaaaaaatatttttatatctatatatcttttttttttcactaacctctgaatgaaattcagtgtttctattttgaatgcaggcaacaaaacacagcagta

SEQ ID NO: 169174 - DNA, 601 bp, Human
atgcaggcaacaaaacacagcagtaatattagcagcaactgtgactttgttgccaatagatgttttttcctatatccatatttaaagattgtttcttgaagcaacatatagttaggtcttgcttttttatattgcctttgaattggaatgtttagacaatttgcatttaaggtaatgatgtgatttcctttcaattctaccatcttgccttttgccttgtatttgtcccatttttttctttgcttttttttgcttatttgtttgcatttttcatactttctttttgattgagttgaatttytttttttttttttgacatggagtctcgctctgttgcccagggtggagtgcagtggcataatcttggctcactgcaacctctgtctcctgggtttaagcaattctcctgcctcagcctcccaagtagctgggattacaggcgcctgccaccatgcccagctaatttttatatttttagtagagatgggattttgccatgttggccatgctggtctccgactcctgacctcaggtgatccacccacctcagcctcacaaagtgctgggattataggcgtgagccaccacccctagcctgagt

SEQ ID NO: 169175 - DNA, 601 bp, Human
attagcagcaactgtgactttgttgccaatagatgttttttcctatatccatatttaaagattgtttcttgaagcaacatatagttaggtcttgcttttttatattgcctttgaattggaatgtttagacaatttgcatttaaggtaatgatgtgatttcctttcaattctaccatcttgccttttgccttgtatttgtcccatttttttctttgcttttttttgcttatttgtttgcatttttcatactttctttttgattgagttgaatttttttttttttttttgacatggagtctcrctctgttgcccagggtggagtgcagtggcataatcttggctcactgcaacctctgtctcctgggtttaagcaattctcctgcctcagcctcccaagtagctgggattacaggcgcctgccaccatgcccagctaatttttatatttttagtagagatgggattttgccatgttggccatgctggtctccgactcctgacctcaggtgatccacccacctcagcctcacaaagtgctgggattataggcgtgagccaccacccctagcctgagttgaattttgtttgttttttagtggttg

SEQ ID NO: 169176 - DNA, 601 bp, Human
tcctgggtttaagcaattctcctgcctcagcctcccaagtagctgggattacaggcgcctgccaccatgcccagctaatttttatatttttagtagagatgggattttgccatgttggccatgctggtctccgactcctgacctcaggtgatccacccacctcagcctcacaaagtgctgggattataggcgtgagccaccacccctagcctgagttgaattttgtttgttttttagtggttgctctgggacttacaatatacttctttaacatatgagaatttactttcaaaacatactrtattacttcatatataatctaaggaccttaagtattctatttctctctcttctactattgtaatatattttacttctacatgtaaaccctgtgattgttaccatttttgatttaagtggtgaaattacttttgtggctgggtgtgctggctcatgcctgtaatcccagcactttgggaggccaaggtgggaggagcctttgagcccaggagtttgagaccagcctaggtaacatagtgagactctgtgtctacaaaaaaaattagaaacattagccaagtgtggtggtgcactcctgtag

SEQ ID NO: 169177 - DNA, 601 bp, Human
ttttttctttctttcttttttttttttttgagacggagtcttgctctgttgcccaggctgcagtgctgtggtgcaatctcggctcactgtaagcactgcctcccaggttcaagcgattctcctgcttccgcctcccaagtagctgagacgacaggctcacaccaccacgcccagctaattttttgtactttagtagagacggggtttcgccgtgttgcccaggctggttgcgaactcctgagctcaggcaatttgcccaccttggcctccgaaagtgctgggattacagacgtgagccacygtgcctggccaaagtctgtatattttaactttgtttctatctaaattttttccctctggcttcttgtaagattttctggttttgacagcttttcaggaatttgattattgtgcctcgttgtggttttctttgtgtttatactccttcaggaggggggctcattgagttacttggatgtgtagatgggtttttgtttttgtttttttttttttgttttttttttgtttttggtttttgagacagggtctcactctatcgcccaggcaggagtgcagtgggacaatcacagatcactgcaac

SEQ ID NO: 169178 - DNA, 601 bp, Human
tttttgaatactgtaagttcttcttggttcttattattatgtgtgccattttcttcctcatttttttctttaaatttttgagcgtatttataatagccgttttagagtcctcattggctaatttcatcatctcgtttctgggatggtttcagctgatttatttcactctggtttcaggtccctttttttttgagacgcagtctcgctctgtcgcccaggctggagtgcagtggcgcgatctcagctcactgcaagctccgtctcccgggttcacaccgttctcctgcctcagcctcccaastagctgggaccacaggcacccgccacccgccaccacgcccggctaattttttgtacatttagtagagatggggtttcaccatggtagccaggatggtctcgatctcctgacctcgtgatccacccgcctcgacctcccaaagtgctgggattacaggcgtgagccactgcgcccggcctcaggtcacattttctttcttcacatttctattaattttttattggatgctggacattgttaattttatatggttgagtggtggaattttttttttctgcttcttttaaagaattttggact

SEQ ID NO: 169179 - DNA, 601 bp, Human
atcatctcgtttctgggatggtttcagctgatttatttcactctggtttcaggtccctttttttttgagacgcagtctcgctctgtcgcccaggctggagtgcagtggcgcgatctcagctcactgcaagctccgtctcccgggttcacaccgttctcctgcctcagcctcccaagtagctgggaccacaggcacccgccacccgccaccacgcccggctaattttttgtacatttagtagagatggggtttcaccatggtagccaggatggtctcgatctcctgacctcgtgatccaccygcctcgacctcccaaagtgctgggattacaggcgtgagccactgcgcccggcctcaggtcacattttctttcttcacatttctattaattttttattggatgctggacattgttaattttatatggttgagtggtggaattttttttttctgcttcttttaaagaattttggactttgttcagacaagtggttgagttacacgtggatcaactccatccttttgagccttgttttaagctttgttaggaagcatctagaatatcatttactctagagcttatttagctttgctactaaga

SEQ ID NO: 169180 - DNA, 601 bp, Human
ttagcttccacttctctggcccacttccaagctctgcttgagttctttctcccttcaccacagtctgaaaaatgcctctaggcagaaagccagggcagtgttaggtctcacttcatttcttttgcatctcagaaatcacagtcctacactgcttattatccaatatctaaaaagagttttatatttttttgttcactgttctggctgttattgtgggttgaaaagtctgtttctagttattccaccgtggccactgaaaattatttcctgtttttataccttttaagataatcatggagayaaaaaataaagtttacgttccttttattttctctggctatttgggccttatggcgtatattgctaataactgcctatagtgtttagcaatttcatctgatctcctgttcacatctttaattattttcaagatgacattttaaatggttcagctataatacaataatgaacaaaatagtatagaattactgtaggatattttaagcaaataaaatagcatgtacattatattaaagctcatgagtgaatgtttttaaacagtacataagttgtttaaatgatagctttgcaaagaattggg

SEQ ID NO: 169181 - DNA, 601 bp, Human
ccacagtctgaaaaatgcctctaggcagaaagccagggcagtgttaggtctcacttcatttcttttgcatctcagaaatcacagtcctacactgcttattatccaatatctaaaaagagttttatatttttttgttcactgttctggctgttattgtgggttgaaaagtctgtttctagttattccaccgtggccactgaaaattatttcctgtttttataccttttaagataatcatggagataaaaaataaagtttacgttccttttattttctctggctatttgggccttatggcgtrtattgctaataactgcctatagtgtttagcaatttcatctgatctcctgttcacatctttaattattttcaagatgacattttaaatggttcagctataatacaataatgaacaaaatagtatagaattactgtaggatattttaagcaaataaaatagcatgtacattatattaaagctcatgagtgaatgtttttaaacagtacataagttgtttaaatgatagctttgcaaagaattgggtttatcattgtagtcataaggttatcaactgttggatttaatcatcttgttttctaa

SEQ ID NO: 169182 - DNA, 601 bp, Human
aaatatctgaaagtaatcctataaacttatgttaaaatctgtatggattttgccatgtagcttctgttgtccctttgatagtcttacaaggaaaaaaacaaaacaaactcctatgtttgatgcagtagtgtacattattagactgttagcatgtttcttaatctttgatttttttgtttgtttttcagatcgtcagtatttaaacagatcacatcatgcgtgagtacaagctagtggtccttggttcaggaggcgttgggaagtctgctctggtaagttagccacctaactgtaactgatwaatataatacaagaagaattttgacatttccttgctttcagacttctagatgccaaagagaaaaggtggcattattatatatctgatatctgtcccacaaaggacaggaaatcatttaataaccacagatgtatatagttttataacattggctcatttattcttatatttaccaaatatttattggctatcttatatgtcaagcaccagtgttgatgatgcagagaggagtaagattgttctctttttaaggaatttacattgtattgggggaaactgattattacagattctagtggg

SEQ ID NO: 169183 - DNA, 601 bp, Human
agcatgtttcttaatctttgatttttttgtttgtttttcagatcgtcagtatttaaacagatcacatcatgcgtgagtacaagctagtggtccttggttcaggaggcgttgggaagtctgctctggtaagttagccacctaactgtaactgattaatataatacaagaagaattttgacatttccttgctttcagacttctagatgccaaagagaaaaggtggcattattatatatctgatatctgtcccacaaaggacaggaaatcatttaataaccacagatgtatatagttttataayattggctcatttattcttatatttaccaaatatttattggctatcttatatgtcaagcaccagtgttgatgatgcagagaggagtaagattgttctctttttaaggaatttacattgtattgggggaaactgattattacagattctagtgggataattcctcacctgcttccaccctagacttagatggaatgaaggtcattttttgtgttcatgctgtttttatttagtacatagttactgagtttctatagtgtcagattctagggtcacaacagtgaatgaaaacagtcatagttt

SEQ ID NO: 169184 - DNA, 601 bp, Human
ttttagaattggagatagtaaagcatatttgtatgctgggggcaattcctctccactggagaggaaaataaggatacaggagagggaaagaggagatgatccagtacaaaaacctgaggaataaaattataatctatgtgaatgaatgaatgagatgtccctgaaaattaagacagaggataagattcagaggagtagtcaaacattacttttagtaagaaagaaatgagaaacgttggattgttttgcatttttgcaagtcttattaatgtctggcttatagaaggcacatgggctcttwtgcctgcttctgtatccagtctctttcaatagcacatgttctataccctttggaagattccactgtaaacttatgagagaagaagaagagtacctcttagaatacatcttagtattgttaggaagatagtttgaccttagggagcctctgccttggaccatattttgagactctctgctctagcctaaagcatattaggaagctgtattagactgcctttttttttttttttaaatcttgaatcagcatcttgccctggagtgcagtggcgtgatcatggctcactgcatcttcaacctc

SEQ ID NO: 169185 - DNA, 601 bp, Human
ggagttttcctttaattttttaatatttctctttttttttcccccagacagttcagtttgttcagggaatttttgttgaaaaatatgacccaacgatagaagattcctacagaaaggtaaaatgtgaaacttgtacacacatgcttacaagtagttccttatgatgttaaaatttgatctgtagatttgctttttgaaaatagttttgagaaataatacaaatattgtgcatctgtttttaaaagtttcatcaagacagaacatttcttaacagaatactactttgatattcagagctctrtgttctgttactgattagtgacttgttccttaatgtggacattttcctggtggggaatgttgccacatatgaaaaaattgcatataaatagtaggtgtgttttcaacttactcttttgttaccaacaattaagaccacctttatgcttgaagttatccagtgactgaacatttttatttttgtttagttttataagtttaaagatatctttagactaccaaaaaattagagtctgtgtaatactataattgggttatatgccatacatttgtcaaaacccatagaatgtaccatgccaaa

SEQ ID NO: 169186 - DNA, 601 bp, Human
gtcttgacaaaaaatattctgtagaagaccagccagagttgtggaaaattttcagtattttctatgtcaaatatattgggtggggtggaggttataaaaggctagtagccaagaatattttttaaaaagattaaactttaataggaaaggattgcttttgaagacatttttagaatttacctttaatagtgctgtaacttttgttgaattaatttgttagttcatgaaggactactagtagagcagtttcattgtcttcaaattggaaacagaattatgctctagatacatcaagaaactrtagtcctaattgattattcactgaacattcccagttacaaattttgcagattatcacacttgtcccataagtggtggggtggatgagtttgtggtctgaccagtggtgcccctcatcaatgtctgatctgacacagaagcagagtttaaaatagtctttaggttagcacatttatttttagaagacagtgttgctctactgaaatttccccaaagtaagttgctagttaaagctttaactgcaaagcaagatctgtacctaaaattctaagggactaacttttcttaatcccttctttat

SEQ ID NO: 169187 - DNA, 601 bp, Human
gaattatgctctagatacatcaagaaactatagtcctaattgattattcactgaacattcccagttacaaattttgcagattatcacacttgtcccataagtggtggggtggatgagtttgtggtctgaccagtggtgcccctcatcaatgtctgatctgacacagaagcagagtttaaaatagtctttaggttagcacatttatttttagaagacagtgttgctctactgaaatttccccaaagtaagttgctagttaaagctttaactgcaaagcaagatctgtacctaaaattctaarggactaacttttcttaatcccttctttattaaaacagttttccacacagttgatagttgatactttcattagaccaaccttcttttcttttataagaccaatgggtaaatagaactcagtgtataaaatttcacctttcacatagagcttttctagaaaagtgcctttttcttgaggcactgttttagctcattgctgtttattttagtactcctgtgtttcttttatgtcttaaactcagattttactgtgtatttaattttctgcatattttagtaaaattttaacaacttgaacatg

SEQ ID NO: 169188 - DNA, 601 bp, Human
ttgttcgttgaagttttccttaaatttcaaaatatgacttttgccttttctaataacaaataagaatcgttacagaggtcagaaaatatctaaactcagcattaaccatcttggcttctgtaatatgaatagactgtacttgagaccgctgttctttattgtggtaccaagtttacccccagccattacagcatactgctggagacaggctttgtatttgttaatagttactttgatggaagaggtgggaagaaaacagaatgagattttgatgttactctttaaccttttttttttttttgcccccacagcaagttgaagtcgattgccaacagtgtatgctcgaaatcctggatactgcagggacagtaaggatgttttctctttttttgatagattttaatttgtgagcaggttttgtcatctgagtaggttttgtcatccagataattctgagtaaaagtaatcattctgattaagaagaaattctctgaacatagggattcttaagtatatgaaatcaactctgatgtagttcatgctcacatatcacaaagttcacctgtaataatctgtgtgttgggtttcttcctacattgag

SEQ ID NO: 169189 - DNA, 601 bp, Human
ggattatgctgtcagtgattttttaaaatttattttaaatttagagctttagttaatatttgtatttctatgggtttaaataagaccttgtctcttggcaccatagtcattaatttttataattttttcttttcactagcattttgacatctcaaggggctggtgacagatacatgttttctgaggaaggcaaaaatcttcctcagaagatttagaattattttgagcctcctttttctaatctttaaatgagtataatgatgttagtacatcataaggtgtttgtgataagcaaatgagwtaataattataaatcattaggcataatgtctgttacacagtatggaattgtgtatttgcttttattcttcttcattaataccatcacctttataatttttattaataactgatggtttccagttatactgccacataaaatacatacattaagcaatctttgcttttctttgtttatttttctccatgcacatagacttgacacattaggcaattcttagctttaaaatggatgggttcgttttttgttttgcttaagagacgaggtcttgctctgtcacctaggctagggtgtagtggt

SEQ ID NO: 169190 - DNA, 601 bp, Human
aatttagagctttagttaatatttgtatttctatgggtttaaataagaccttgtctcttggcaccatagtcattaatttttataattttttcttttcactagcattttgacatctcaaggggctggtgacagatacatgttttctgaggaaggcaaaaatcttcctcagaagatttagaattattttgagcctcctttttctaatctttaaatgagtataatgatgttagtacatcataaggtgtttgtgataagcaaatgagttaataattataaatcattaggcataatgtctgttacrcagtatggaattgtgtatttgcttttattcttcttcattaataccatcacctttataatttttattaataactgatggtttccagttatactgccacataaaatacatacattaagcaatctttgcttttctttgtttatttttctccatgcacatagacttgacacattaggcaattcttagctttaaaatggatgggttcgttttttgttttgcttaagagacgaggtcttgctctgtcacctaggctagggtgtagtggtgcaatcatagttcaccgcagtctcctgggctcaaaca

SEQ ID NO: 169191 - DNA, 601 bp, Human
ttagcttctgaatcagcagaattcccctttgtttccagagaccctaatagctaaaatgaatactttctgctttttttttttttaaatcacatccacagtgtacgggcattcttctttctctgtccagattgtaagaaggaagttctctatcacagagatctttactttgtgctatccaatatcgtgtctgtctcccatctagcactcaacacgctgtgttataaggcctatttgcttgtttgtgtccccagtaccttgcataaaaccttacaaacagctgcataatcttgtctcaaaatcrctccttacactttgaagatttttgctttctctctttcacatacactgattcaatcagaattcttagtgattttactatccatatagaatctatatggatattataaatgatttactaccctggcttggcctgtcatttccttgatgtccatcctacctttaaggcattcataccatggttttactctaggctatgtgattaccaataagtataatacctctctaatctaatttccaagcatcttatcctccattactcactacttttttctttatccatctcacttcctctttttttttt

SEQ ID NO: 169192 - DNA, 601 bp, Human
atctttactttgtgctatccaatatcgtgtctgtctcccatctagcactcaacacgctgtgttataaggcctatttgcttgtttgtgtccccagtaccttgcataaaaccttacaaacagctgcataatcttgtctcaaaatcactccttacactttgaagatttttgctttctctctttcacatacactgattcaatcagaattcttagtgattttactatccatatagaatctatatggatattataaatgatttactaccctggcttggcctgtcatttccttgatgtccatcctacmtttaaggcattcataccatggttttactctaggctatgtgattaccaataagtataatacctctctaatctaatttccaagcatcttatcctccattactcactacttttttctttatccatctcacttcctcttttttttttttttttgaaacagggtctctctctgtcacccaggctggagtgcagtggtgtgaacacagatcactgcagcttcaacctcccagggtcaagaaatcctcccaccataacctcctgaggagctggtgctactgcaggtgcataccaccacacctagctt

SEQ ID NO: 169193 - DNA, 601 bp, Human
cataccatggttttactctaggctatgtgattaccaataagtataatacctctctaatctaatttccaagcatcttatcctccattactcactacttttttctttatccatctcacttcctcttttttttttttttttgaaacagggtctctctctgtcacccaggctggagtgcagtggtgtgaacacagatcactgcagcttcaacctcccagggtcaagaaatcctcccaccataacctcctgaggagctggtgctactgcaggtgcataccaccacacctagctttttttttttttwaattttttgtagagacagggtctcactatattgtccaagctggtcttgaactggactcaagggatcctcctgtctttggcctcccaaagtgctgggataacaggtgtgagccactgcacccaggccatctcatttcctttagtgcccttcaacttcgttacaacctgtagtccatttatcctaacatctttttattatcccttatatcttcaaccccctctgcatatagcttcaggtccacggtccatcatttataattctcttgaatatatcctcaactcccttgacttttcagcagcc

SEQ ID NO: 169194 - DNA, 601 bp, Human
acacagtaaccatcataattccatttaaatgtaagtcagatcatgttttcctcagcttaaattatgcattaaactcagagtaaaagcccaggtctttattacatttccctgaaaggtccaaatgagaatcctctctctttgtcccttctctggcccccactgctatactcacccactaggtaacaatgtttcaatgaatccagcctccttacagcttctcatacactttagacatgtttccctttggggcctttgcatttgctctttcctgtgcttggggtagtcttcctccacataaccrtagagcttattccctcacctccctcacatggttgctcaaatgttacccgtgaggccttccctgagcatagtcttttaaaatataactttatattcctaccctcaaaataaactcccaacctttacttttctctataacatttattaccatcttgcatacttgatttttgtctgtctccatgtatactcctccagggcagaaatttttgcctctcatgatcactaacatatccatagggctacaactatgtcagtggatatttgttgtgaatggatgaaacttgtagaatgtccttaagaa

SEQ ID NO: 169195 - DNA, 601 bp, Human
tggattttcagaactcaggttgcctgtatgtttattcttttgatttaataagaagcagagaccatgatctctagagaacatcatagaaatagtgttgctagtatttgtagcacttaacatttgtaagtaaactcatttattatataaacatttggacagtggcagaatttaattggttaccatagtggtgcaattctggaatatgcaaactttatcaatgaaaaatccaggaaacttccagtttttacatctttcccagaaaatacactggcagcagtataggaagctcagccatgttccygtggcacaccttagacgaatttgaagctggggaaatggctgagtggtagcatagctaactccctggaatacaagaaagagtacatcagccagggtagaacaaccagaactattttagatgtagtagacaaaatagaggtagtggtcatggggaacaaggaagccaaggcacaacaagcttaagaaactttgtggatttatcttttacgtttaatgcatccagaggtaaaaagatccaaactgtatagttatttaatataaagacccaagacatacacatttttaatattctgccatatgt

SEQ ID NO: 169196 - DNA, 601 bp, Human
tgaggacatatgtgataaagtactcattgtgctataggttaaaaagtgcagtagaggaaaaagaggagccaaagaatacttcatagaagtgggacctgagttgagctttgaaaggtgatggttgtgtcagaaacagtgttcaaagaacattattaagatccatagtggtgtgtttttatttctaaaattccattggtataattcacacatcacagtctacctcccgggctcaagtgatcttcccacctcaaccccctgagtagttgggactacaggtgtgtgccaccctgcctggctgatwgtttttgaattttttagtagagaccaggtctcactatgttacccaggcttgtctcaggctcctgagctcaagcagtcctcctacctcagcctccctgggattacaggcatgaaccattgtgcctggccaggattatattcttaaaataatttggcatatctatgtagtaggatctcttccatttttttttttttttttgtctcttccttcttccttcgcctcttcccctcaacatatacttttcgttagtatttgatgaagcttgcggtcccaactaatgcatttcagttggtggcagat

SEQ ID NO: 169197 - DNA, 601 bp, Human
taattcacacatcacagtctacctcccgggctcaagtgatcttcccacctcaaccccctgagtagttgggactacaggtgtgtgccaccctgcctggctgattgtttttgaattttttagtagagaccaggtctcactatgttacccaggcttgtctcaggctcctgagctcaagcagtcctcctacctcagcctccctgggattacaggcatgaaccattgtgcctggccaggattatattcttaaaataatttggcatatctatgtagtaggatctcttccatttttttttttttttttgtctcttccttcttccttcgcctcttcccctcaacatatacttttcgttagtatttgatgaagcttgcggtcccaactaatgcatttcagttggtggcagataattgcttatttatttttttaaaaggctaagtaatgagtatgttattgttcattttacgtttttttcttcccacaggttccaatgattttggttggcaataaatgtgacctggaagatgagcgagtagttggcaaagagcagggccagaatttagcaagacagtggtgtaactgtgcctttttagaatcttctgcaaa

SEQ ID NO: 169198 - DNA, 601 bp, Human
cactccactatcttgaaaacagctgtggacaagaatacttagcaaataagctgcatgcctgggtgtaaagggccaacagtttactagtttactgggcccctaaaaatttagagcaatttccaactgtccccaccagtcaaccttaaatagttcccttgcttttgttaaccttaacataagccttttaaaaaaataaaaacaacagagtgggcttctttcctgccgttgcttttgccatttgtagcattacaggtaatcagtcagaattcagatcacttaactacataggtgagagtgagaktgggttaagttatgagtcctctgtttttgctattctctctggcctgtggttctgctggccactttttcttgactaatattatgcttatagactatttgacttttaaaaatgaccaggttactttaaacacctggcaggtaaaaaaaaattaagcttgcttcaacttctgtattttacagataatcaagaatgccaaagcttgtttttttatgtgaaaccatttttaacaagtacataaaaacaagaaatttataaattgtatttattcagcaaatatttattgactattgtgtgtctggc

SEQ ID NO: 169199 - DNA, 601 bp, Human
agtgtatgtatcctcagatcaaagacattgtcttacacaaccacagcacaatgattagaatcctaaaaattgatgacacagtctgtgtttggtatatattcagattttaccagttgtccctgtaatgctccttaaagccagtccattttttaatatactgcaaagaattatttattccagattagtatcaataagggacttctgtgatatttgtttttattccaaatcattagtaagtgttgtatttcatagcaaagcttatctgtttcatgttttaatactttggcatcagaattaaaayagtctgcttttatgagataagtagcattgtatttttgtctttgatactttgcacttttcatccaaaaatgaatccacaagatgtattaacaaacattatttgggctgggcacagtggctcacacctaaaatcttagcactttgggaggctgaggcagccagatcacttgacctcagatgtttgagaccagcctggacaacattgcaaaacccttgtctgtacgaaaaatacaaaaattagctgggtgtcgtggtgcacgctgtagctcccagccgttcgggaggctgagatggaaggatc

SEQ ID NO: 169200 - DNA, 601 bp, Human
ctgctttctaccctgattgaaagtcagcagagccttctaacaaacctgactttaaaagaaagaagcagaatgcagatctaagaccagaatagtacttaccagaattgttttgtggaacaaagtctcaaaaactggtggagtaagtactttttttcttgtttttacttagatattttatgacctggtcagacagataaataggaaaacaccagtggaaaagaagaagcctaaaaagaaatcatgtctgctgctctaggcccatagtcagcagcagctctgagccaggtaagatgctaaaagyagaacaagtgcctttctcatgctcctattttggctttttccagactttagctacttcccatttcatctgttatggtatttctaagcttctgtaacttgtaaatgtgatatataacttgtaggtacgtcatctgttggataacttgccctctccccttgagattctaagctctctgacagcagggaccatttctgttttttcttgccactgtgtccccagtgcttgatacagagttgggttttaaaaaatagtagttgaatgaatagaacgccttcctagatgactcccaaattcattctt

SEQ ID NO: 169201 - DNA, 601 bp, Human
atgaatagaacgccttcctagatgactcccaaattcattcttaattgaagtgaaacagtagttgctctgaaaaagtttaagtgcacatttggtgaattatcccaaagtgacatacccgtatataacaacaagagtcacccttccccaaattaaattaaaactctgccctgatttctaactccatggattagttttgcctctctttgaactttacataaacaaaaacgtagtgtatttcctgtgtctggcttcttgcactccaaaatatgtttttgagaattatttatgttaaatgtatcartagttcatttttattgcatgacagtactggcagtatgtttatgtattcttctgttggtgttcatttaagttctttctttgggggaattagtatgaataattctgtgcacattcctatatgtctttgtgcacatgtacatgcatttctgttgggtatatatctaagaatggaatggccagatcatatactatacatatggacagctttagtagatactgctaaaaagtttttcaaagtggctgtaccagtttacacaccctgcaacggtttttgagttctacattctccccaaaattgata

SEQ ID NO: 169202 - DNA, 601 bp, Human
gtgtaattttggtagttatttccctctctggtatgagtcaacttctttcaaataaaggttttctatttgggcttctaagtattagttgactttaccattttagtttccactaagtgaccccattggaaagaaatttatgacagcatttaagctgactctcaagtgagaaaccaggatctatggggacttttttctttaatttgtattgtatttaaatcccctgaaggtttctacttaatcagttctataaataataccataaaagattattttcatggagtggatttattacataatttgrtgcttattacatgattattactaaacttggtctccagttggagtaaactggtcccactggaaagttggttacactaactcttgtaagtctcttggtccatttagtagattatcccttaagagctcccaattaactactgtgtgcttccttagagatatgaatctctctattaagggaaacacctgagtaattgtagttccttttttaaatgaaggtacatagaggaaaaatgggcagaaaggagaaaagggcctagggattatctctggtagtcagatttagaaaagacagcatctggct

SEQ ID NO: 169203 - DNA, 601 bp, Human
ctggccctaatttaatttccagttctcacaaaatatccttttagcttatgttaaaggaaaaggtgccatctcctggcctattacgatttttaaaattcatttatacacacccaacaatgtgacagtcccttgtgagttttaccttagagaagataaatcttgacctagatctggaataagactttagtcttgcttgcataaattcttagactctgatgtgtgataaagtttacttaataagtcatccaagatctctgtggatgtttgataataccaaataataggtgacttagcaatcagrctgctttgcatacattttagtgtgattgtagatttgaagtgccatgttgttcctgtacttttaaaagtactgagatacaggatagatttaaatagaaattataaacgtttttagtaagagtacatgaactctgaggccaccttatctagtccatagcctttaggcaaaattgtattgaatcatgttaatctcctttttatatgtcccagttttaaagacatctgagagaaattcatcatgtggattattttacctgattcttgtctgttgacaataagactaactttgattcttctgctc

SEQ ID NO: 169204 - DNA, 601 bp, Human
ctgagatacaggatagatttaaatagaaattataaacgtttttagtaagagtacatgaactctgaggccaccttatctagtccatagcctttaggcaaaattgtattgaatcatgttaatctcctttttatatgtcccagttttaaagacatctgagagaaattcatcatgtggattattttacctgattcttgtctgttgacaataagactaactttgattcttctgctcttgactatggggattagctctttctgtatcatcccttgccttaacctgtattagaaatggtaattctaayatataatcataaaatgcttgaataaagaatatcttatggaaagtttatggaggcaggtgtgtccttcagtaaaaaaggaaagtaaaaataagatggtaatgagatagaataaaaatatcattgtcttcctttgtacagacaggattgtcagatgtaatgggaaacactataattgagtataactaagtataactgaggataattcaagttgatcagttatagactcctcttgtaaacttctatttttgattttttaaaacatttttaaagggaatttaaaatagcactgttactgtagct

SEQ ID NO: 169205 - DNA, 601 bp, Human
aggccaccttatctagtccatagcctttaggcaaaattgtattgaatcatgttaatctcctttttatatgtcccagttttaaagacatctgagagaaattcatcatgtggattattttacctgattcttgtctgttgacaataagactaactttgattcttctgctcttgactatggggattagctctttctgtatcatcccttgccttaacctgtattagaaatggtaattctaatatataatcataaaatgcttgaataaagaatatcttatggaaagtttatggaggcaggtgtgtcyttcagtaaaaaaggaaagtaaaaataagatggtaatgagatagaataaaaatatcattgtcttcctttgtacagacaggattgtcagatgtaatgggaaacactataattgagtataactaagtataactgaggataattcaagttgatcagttatagactcctcttgtaaacttctatttttgattttttaaaacatttttaaagggaatttaaaatagcactgttactgtagctgtttagcataatttagttctcaagttatgatcagctaaaatcattatttttttattttattgaa

SEQ ID NO: 169206 - DNA, 601 bp, Human; identical to SEQ ID NO: 104848

SEQ ID NO: 169207 - DNA, 601 bp, Human; identical to SEQ ID NO: 104849

SEQ ID NO: 169208 - DNA, 601 bp, Human; identical to SEQ ID NO: 104850

SEQ ID NO: 169209 - DNA, 601 bp, Human; identical to SEQ ID NO: 104851

SEQ ID NO: 169210 - DNA, 601 bp, Human; identical to SEQ ID NO: 104852

SEQ ID NO: 169211 - DNA, 601 bp, Human; identical to SEQ ID NO: 104853

SEQ ID NO: 169212 - DNA, 601 bp, Human; identical to SEQ ID NO: 29450

SEQ ID NO: 169213 - DNA, 601 bp, Human; identical to SEQ ID NO: 29451

SEQ ID NO: 169214 - DNA, 601 bp, Human; identical to SEQ ID NO: 29452

SEQ ID NO: 169215 - DNA, 601 bp, Human; identical to SEQ ID NO: 104848

SEQ ID NO: 169216 - DNA, 601 bp, Human; identical to SEQ ID NO: 104849

SEQ ID NO: 169217 - DNA, 601 bp, Human; identical to SEQ ID NO: 104850

SEQ ID NO: 169218 - DNA, 601 bp, Human; identical to SEQ ID NO: 104851

SEQ ID NO: 169219 - DNA, 601 bp, Human; identical to SEQ ID NO: 104852

SEQ ID NO: 169220 - DNA, 601 bp, Human; identical to SEQ ID NO: 104853

SEQ ID NO: 169221 - DNA, 601 bp, Human; identical to SEQ ID NO: 29450

SEQ ID NO: 169222 - DNA, 601 bp, Human; identical to SEQ ID NO: 29451

SEQ ID NO: 169223 - DNA, 601 bp, Human; identical to SEQ ID NO: 29452

SEQ ID NO: 169224 - DNA, 601 bp, Human
cgggtaattgtattccagcgagtcgacggctccttggttcgtcaccctccgtggctccagactgtgggaatcggagccgctggaggacggcaggccgtggaaggaggcggctcggttagggctctggtccagcggcaggcatggggccggcacggcgtggctggaggcacctgaactgtggaagtccgggaggttccccggtcgctgcgggccgaagctctcaggcccctggctctccgccatgtgctcatagccctcggcgaagggcggctggctgcccaggcctccggctgcgccgccrtagccgagcaggcgacccccgtgcaggcacgaggccccggggtccgggccaccgaagttgcccccaaagtgggggtgatgctggtggggatgatgacttcccgggtggccgtggtgaggctgctggccgccaaagaagccgtgcacaggctgcgcttgcagcccccctgcgtgcaactccgagtggccgcgcgcgtggaagccgtagggctccatgttcatgcccaagatcgggggttcgcccagcgcgctcatagcaggatccacagggccagggggccccccagtgtggaaagccggg

SEQ ID NO: 169225 - DNA, 601 bp, Human
gcggcgcctgctgctcgaaggtgcccagacgcccggcgcccgtgctgccgccttcgcgctcaaagttcggctgggccaagccgcccaccgggccgccatgcaccaggccgccctggcccacgtccccggggtggcctagctgagccaggttgggctggcgcagccgctgctgctgattccgcgacgccatctgcttaatcatgagggccgcgttttggcgctgctgctgctgctgctgttgctgttgctgttgctgctgctgctgctgctgttgctgctgctgctgctgctgctgctgctcttgcagggactggtggtccggggccggatgctgcaggggcggccccgaagggaagctgtcgggcacaggcggtgtgaactcgccgggtaggcctgggtaggcggaaggggagaggtgattatccagagcgccgttgtgcatgctgccgttccacgaagcgcagcggtccactcccgcgctgcccggaaagtcgaagcgcggcctcttggccacgttcatgtaggggggcgcgtcgaaatgctgcagccgctggttgggcgcctgctgcggaggaggatgctgcatgctgaaaacaggctc

SEQ ID NO: 169226 - DNA, 601 bp, Human
ctacctgcccccccgccccaagtctgccctatgtctaaagaaattccatgttcaaatcttgcctgcctaggattgctcagtgctgttactgtgttctgactgcaacactgagagaagcatgaaattccaaaaatttctctggcatcactgtaaaaatatcatacttccaaaaagggcaggattgcttgcagagtgtgtaccgagactgctcccatttcaatgtatgtgaaagagtacttcaagactgccctgggtttcaagatagagctaccaggggaaaggaggtttggcaaagataaaygtattacagaatacggttaattcaacttttgaaaattgtaaggggcaggaggggagaaaacgtactttttccaacttaatatgcattatctataatctatcattatctctcctctctgtgttgaaattcttccgtagccacacacctattacaaagataggtggatgaagactatactttcagggatcatttctatagtgtgttacaaagataggcggatgattttgcaaactctttttaaatccatataattctcaccaatttaattgatgtttgaataggcccaaactcaggctgggt

SEQ ID NO: 169227 - DNA, 601 bp, Human
aactatgcagattgtttttgagacatgcaggataaaaacaagacctggttctcttgtgggtatctttgaagtccccaactttccaaagatcttctatagcaatgggtcccaaatacgcctccgccaaggggtctccctgtttccctaaactatttcccaacacaccttgcatctcccaaaccaaataccagcataggtaagtcaaactgtagcccaagaaaccgagatagacagaaggagcaaaatcctaggagcaaacattttgggggagtccaagattttccacagagagatcaaagakgggaataagatggaagcttctgggcacatagttgatcctataaactccaggggaagtagggcaaggtgagttcgctggactcagagctttcaagatgagaacacgaaaacgtgatttccctcaacaatgtgagtttatatggggatgtttattggggaattttttctccctttttggacaagtccattccatggaagatgttccttctgggacattcacagagagccagcatgttattacaaatgctctaagacctccaaactgctagattcagttgccttatgtttaaagggcatttgg

SEQ ID NO: 169228 - DNA, 601 bp, Human
aaaaactacttttaaatcctcacaattgaatgcatcaacgggccacttagttctcatgagtcaggctgctcgaagagcgagcaggaaaaacaaagctgcaagggtgcctcagcaccaaagttagtccacgtttcctccaaagacatgaccatggccatatacttctgagtaactatgcagattgtttttgagacatgcaggataaaaacaagacctggttctcttgtgggtatctttgaagtccccaactttccaaagatcttctatagcaatgggtcccaaatacgcctccgccaagggktctccctgtttccctaaactatttcccaacacaccttgcatctcccaaaccaaataccagcataggtaagtcaaactgtagcccaagaaaccgagatagacagaaggagcaaaatcctaggagcaaacattttgggggagtccaagattttccacagagagatcaaagatgggaataagatggaagcttctgggcacatagttgatcctataaactccaggggaagtagggcaaggtgagttcgctggactcagagctttcaagatgagaacacgaaaacgtgatttccctcaacaatgt

SEQ ID NO: 169229 - DNA, 601 bp, Human
cgagtgctcaactcccagtcaattaagaattaatgctgggaaactctcagggtcggagaaccaaggcaccagaaggaagcccgtgttctttggccgtctccaaggttctgggaggctgggtttgctcaacgactgggctttttctccctcctcctggacgagtgatggtgaaaggcgccactcgcctcctcttcctgtcctgaggaggtggtgggaacctagactactggtggccattattctatgccaggcaatccgggcccattaatgcccgtgcgcacacacacacacacacacacaattctaatcccagcaaaatgcttcacaggcgctgagcacaaaataaatgcttattaactaaactgacccaaaatagtgaaatgtacaagtaaattaatcatgcctttcccggaggcctaacaggattacaaattcggcaaaaattgaccgcatggagatcaatacgcgtctacttcaaactgaacgaggccaaaactttgcatgagcttcttcttgggggagaaaattatttattcatttcttattaagacttctcaggcctgtgtggtatgtgtgcacgtgcacgtgcgtgtgtgcacgc

SEQ ID NO: 169230 - DNA, 601 bp, Human
gatcacccagctcggaagaatcaaaacgccagggctgaaacccacagcaaccatctgacaggctatggtgctactgcggcttccccaaggtcaagaattctctcctgcacgatgtccacctccacaagaggaagggaacaagggttgccatcaccaaccaccaaccaggggatgtacgtcgtgctgcttttttttttttttttcttgagacagagtcttgctctgttgcccaggctggagtgcagtggtgtgatcttggctcactgcaacctccacctccagagttcaagcaattctcctrcctcagcctcctgagtagctgggattacagacacccaccacaccccactcatttttgtatttttagtagagatgggattttaccatgttggccatgctggtctcgaactcctgacctcaggtgatccacttgcctcagcttcccaaagtgctgggattacaggcctgagacaccgtgcccggccctgtcatggtgctttttaaaaaggcttggaaacctctagtttaagacccagttctggtctgcacgaggcttagccagataaaatcaaatcctagctctcaggtgagggcattaagg

SEQ ID NO: 169231 - DNA, 601 bp, Human
gtttctgccatctcagaaagggccagaacatagggaagggaaacagacattttctcagacaccttgggctcagatgaagcaccgttcaatgcacatctactatgtgccgtcagatcccagcctgtctgtgctccacaccctcccctggctcccggccacactttagaatggactccaaactgctaatctgaccgtgcctacaagccccgagcagtcgggcccctgcctgcctgaactgtctctcccctctcaccagcaatgcctttttcctaaaataggcccactccccgtcctgccttargacctgccctcactgtccccttgcccaacccacttcctgcagagcttgatacagctggctccagggtgccggagcccattgttaaatattcaggaattttgcaatccggctgacagctgacatcactttggtggcttgaaattaggagtatttacaccacgggaatcagcagatgctgcatatcagagcatttatttttctctccccctaccccagagagccaggtgtttaaaagtagaatcaccagaacactagtggctggctcctcgtcatcactcagggattctacttcactgtcac

SEQ ID NO: 169232 - DNA, 601 bp, Human
ggtgacggccatgaggaggcaagacacagagttggtttttatctccagcatctgttggtaggaaatacagctcctcatctccgtgcccataagtggttctaagcacgggctcagaaaggcctggatatgaatccacactgcacccctgggcaggtcacttggcctctctgggactcagttttctcatctgtaaaatggggcttggcatgatgggtgtttaataactgtagcttgttaggattcctttgccactcagggagttgggcaggaatgcaaaagaaaagctgccagaaagtgaacrccaggcctgggtcacccaggggcccaggcctccacacctcctcgggctggccccagctgggcctgtgccttcctgtcggggtgacctctgcaaggcctggagaacaatgcctgggggaaggaggaaacagagtctccctggaccaggacataaattgtggcctgcccagctcagggagccactgacatgccccatgccctcccacctgtggtaggctgaacccttaccttaggaccccagcaccctgtcctaggggacagcctaacttgccctaacctatggcccaggggctccaaacca

SEQ ID NO: 169233 - DNA, 601 bp, Human
cccgtttaacccaaaagacagatgaggaaactgaggcccggggcagtaaggagatcagtccagtggaaggccacaggcctggcttcctgcactgtcctcctccccgaggtctgggacgtaaaatctgactccaatgcctagccatcaggtgactaatggaggaaatgtgagcatcctcgtgtagcccaccacagtcaggtgggccctgatgtctgtaacaagcctcactcgggtaggacagtggctgaagcccagaccacagcggcccaggcaaatgcaacctacgaaagcagaagctggytaagaccagtgttctcaaggataagggaggaagaaatgaggtgggcggggctgggacaaggaattcccatacagcggcatcccttccttccctacccacccctgcagagatgggggtgaagatccctgaccccgaaccagccccatctgggtccatcccggtccctctgcaggaaatcctcatcacccctcctacacctcaggggccaaaggcagcagggtgccagggtgaccatgatgaatgctgtctctggatggggtcctcaccccctaggcctgggaccaggataggatgcactcc

SEQ ID NO: 169234 - DNA, 601 bp, Human
ataccctggaggctgaggtgggaggatcgcgtgagcccaggagttggaggctgcagtgagctatgatggtgcccctgcactccagcctaagtgacagagctagaccttgtttctaaaaaaaaaaaaaaagagagagagaaaaaaaaaataaaagtccagcccagcactgtggctcatgcctgtaatcccagcactttggaaggccaaggtgggcagatcacttgaggtcaggagttcaagaccagcctggccaacatggtgaaaccgtgtctctactaaaaatacacacacacacacacaaaaaatattagctgggcgtggtggcgcatgcctgtaatgctagctaccagggaggctgaggcaagagaaccgcttgaacccagaaggcggaggatgcaatgagccgagatcacgccactgcactccagcctgggccacacaagtgagactgcatctccaaaaaaaaaaaagaaagaaagaaaagaaaaattctacagggtacatcatttttatcctgagtcagtgacccaggctgatgacaaagcagtgggaacagctaccagggattcctacccaccaggcacagcttttaagggctaca

SEQ ID NO: 169235 - DNA, 601 bp, Human
tctggctgggtgcagcatctcacgcctgtaatcctagcactttgggaggctgaggagggaggatcgtttgagaccaggagttcaagagcagcctgggcaacacagcaagaccccatctctatgaaaacataaaacattagccaggtgtggtggcacacacctgtagtcctagataccctggaggctgaggtgggaggatcgcgtgagcccaggagttggaggctgcagtgagctatgatggtgcccctgcactccagcctaagtgacagagctagaccttgtttctaaaaaaaaaaaaaaagagagagagaaaaaaaaaataaaagtccagcccagcactgtggctcatgcctgtaatcccagcactttggaaggccaaggtgggcagatcacttgaggtcaggagttcaagaccagcctggccaacatggtgaaaccgtgtctctactaaaaatacacacacacacacacacaaaatattagctgggcgtggtggcgcatgcctgtaatgctagctaccagggaggctgaggcaagagaaccgcttgaacccagaaggcggaggatgcaatgagccgagatcacgccactgcactccagc

SEQ ID NO: 169236 - DNA, 601 bp, Human
gtctcgaggacgcgctgtagttaaagccaaggctgataaggaatttatcaaatgagatttacacagggaaaccctaattaagaggttagtctccagtttaattgccttcaaacctaggcaggcaggcccaggcagatggattttcagtctgacctcattaaaaaataataataatcaaatagaatacagagcacaatccaaagtctaccacagggctaagaagggcggaggctggggggtggctctgaaagggcgggcctggcctgacctagaatctgccggtcacctcggcttggctgtktttcccccaccctctccctctttctcctctcttgaaattcagtggttctggcctccccactttttgaggttttttttttcctcccctagccccatctcgccttgaagctggcatgctggaatataaattggaagcatacatgccccccctcacccgccccaactcgggcggacgccacataccagacaaaacgactgcaggcctggtcatctggggttaagaatggtttttgtttttggcaaagaatgtggaagagcccaaaggaactggccaggacgattgttccagaaatgaaaggga

SEQ ID NO: 169237 - DNA, 601 bp, Human
ggttcttggtacgcaggaatcgagggttcagaactgggaaagatgggcctcgcgtccactccaacctattagcagctggggaactcagcacatcaccaccccttcgaggcctcgttttccccatctgtaaatggggctatctcctgggatgctgacgaggttatagcagtgcataccgccgtggcccagcctgccctgtgtgaccacatgcatatgagtggcatcttgctcctggtccggaacacacccacaggtgctcaggacgtgctgatggaaccaaaactcccgcttcacactctcmtaggtgatgctgctatgactgccctgtcccaccccagatgtgatttgtagcttaaaatcctgaaaaaggagtccaggtgccagagtcccctccgactctaatgaagagaggggaaagaagtgcccagtatccttgaacccagaggcagggcctgggccccaaagggttaagctcagctccgctctctccccgaatggaatggcaccgacagcagctgaggctgcccctctgctccctgccgcctgaagcctgacccctgacatttctactcccagccgcacttgcatttaaaaaagggaa

SEQ ID NO: 169238 - DNA, 601 bp, Human
acacagccccaggtcggaggtccaccccacgggtcagactagggcagggcctcctgctttcagctcccactgggaacccccaccctcctggctatccacggaggtgttgattatcacatggggtttcttccctcagagacttccttggtacctacatttttttcctccaatattaggaataaatgataataataccaattaatgtgcactgaagtttcccaggtgcaggtcattgctggtgagtctttctgcgcatgaacgggtttcgtgcccgcagaaccccagggggttgacactgccwtcatcctcatttcacagatgaggaaactgaggcttagacatagcaacagtcgtgacaattccataagggccctgtgtgccaggggcagctctgccaggtaccaacctaagccactggcagactagaccccctgtcaccctgacaatacccaggccagctataccccctcctgagccccccatatcacagaccatccagcttgcatagcccctgggcaactccacaggtgatggggagccggtaggtgggaggccccagttctgtgctcttgttcctgcttccaggggctggtgatgtctc

SEQ ID NO: 169239 - DNA, 601 bp, Human
caggcgtgagccaccgcgcccggccttgatcctttgatgtacatgagtatctctcgccacccccacggtgccctctcagtggtaggggctcaggggcagacacagagcaaacggccccctggacaaacctgcagctgccaaatgcttcacctcccgtgtgcccagattccccccaactctgcagagaaatgatcccactttccattattctaataataatccctgaggtctaaagagctctctgggagaatgcaaaacacgtctgggcagatcgcttcctctatacttcaccgtcgtgaayggggatattccagacagggcaacagaggcctggccagcaagatagattctaaggccactgcccagttaaaggcagagccatgaagcaaatctccctcccctcgccctgaagacttgaggtccacgctcatcccaccaactgaagaagctggcatttcctccccaccagagggagcacagagaggtgaagcaacttgcccagggccacacagccccaggtcggaggtccaccccacgggtcagactagggcagggcctcctgctttcagctcccactgggaacccccaccctcctggctat

SEQ ID NO: 169240 - DNA, 601 bp, Human
ctcctgaactcaggtgatccacctgccttgcctcccaaagtgttgggattacaggcgtgagccaccgcgcccggccttgatcctttgatgtacatgagtatctctcgccacccccacggtgccctctcagtggtaggggctcaggggcagacacagagcaaacggccccctggacaaacctgcagctgccaaatgcttcacctcccgtgtgcccagattccccccaactctgcagagaaatgatcccactttccattattctaataataatccctgaggtctaaagagctctctgggagamtgcaaaacacgtctgggcagatcgcttcctctatacttcaccgtcgtgaacggggatattccagacagggcaacagaggcctggccagcaagatagattctaaggccactgcccagttaaaggcagagccatgaagcaaatctccctcccctcgccctgaagacttgaggtccacgctcatcccaccaactgaagaagctggcatttcctccccaccagagggagcacagagaggtgaagcaacttgcccagggccacacagccccaggtcggaggtccaccccacgggtcagactaggg

SEQ ID NO: 169241 - DNA, 601 bp, Human
atagagtctagcatttaagtagtgccgactgtatgcctctgagcagtgctccacagcttgacatcacttaaccaaccccaagacaaccctgcaggtgcagacgtctgtggggcaccaggagagtggtgtgctggtgagagcctgggtgaagccctgctaggctacttcctagctccatgatctctcacgcagctgcgcccctttgggcctcagtttcctcacctgtcaaatgggaataagaatagtaaactgttcccagtggtttccagccgccaataagctagcaagacaacacactcaycagggtttggtacttagcaattgctccatggatgctgctgtcactatcaccattgccatcatcatcatcatcatcatcatcatcatcataatcaagcagtgtggctggcagctgggggctagcagcctagtgcctgcactaggcccagtttgaggctggggtgggggagaatcaggagaagaatttggggaaggcctagctttctcggcctccccaaggaggccccatacacagaacctctgagccaagaagcacaaacaaggccccgaacaggccgggaagcccaggccgcccctcccc

SEQ ID NO: 169242 - DNA, 601 bp, Human
ttgcaagtaatatttaattttgtcagggataattacatgaaatcaatccggcttctacctggaagcacttcgttaccatttgcctttcgagggagttggggtggaaatagagcagttagagtgtggggaggagggagacggtcatgaaacttggacttaacaggcaacaagtgtgacgaagtacagtcgtcaagtcatgatagagtctagcatttaagtagtgccgactgtatgcctctgagcagtgctccacagcttgacatcacttaaccaaccccaagacaaccctgcaggtgcagaygtctgtggggcaccaggagagtggtgtgctggtgagagcctgggtgaagccctgctaggctacttcctagctccatgatctctcacgcagctgcgcccctttgggcctcagtttcctcacctgtcaaatgggaataagaatagtaaactgttcccagtggtttccagccgccaataagctagcaagacaacacactcaccagggtttggtacttagcaattgctccatggatgctgctgtcactatcaccattgccatcatcatcatcatcatcatcatcatcatcataatcaagcagtg

SEQ ID NO: 169243 - DNA, 601 bp, Human
ttccagagaggttgttggacccgacacatgtcaggccactcacctgctggaaaaatcaatcccagtactatttgctgaggcttctcggttataaaataaggagggacgaaaggggctgttatgtgtgtcctcctgcccggccctccctagtcctccctgtcttggggagaaatcgctgctgtgggtttaagtcctggcgacagggcattctcgggcagagcacacacagctgccaacagactcagccctcagcccagcaggggctgggccaactcagccctttttcaccccactgcctcgytgtgtctcagcagagaaattgcccaagactaattgcaagtaatatttaattttgtcagggataattacatgaaatcaatccggcttctacctggaagcacttcgttaccatttgcctttcgagggagttggggtggaaatagagcagttagagtgtggggaggagggagacggtcatgaaacttggacttaacaggcaacaagtgtgacgaagtacagtcgtcaagtcatgatagagtctagcatttaagtagtgccgactgtatgcctctgagcagtgctccacagcttgacatcactt

SEQ ID NO: 169244 - DNA, 601 bp, Human
agatagctcccacaagcctcagccaccaggcagggcaaatgctgatcaggtgtaacctggattttagaaccactgaaaggatgatggagagagattcttgtcaccccagagtcacagtccatagacagttggcggtttgaaaggcagccatttccaggttgaaacactgaggctcagggaagagaggactgaggtggctcccagtccagtgcattttccaacacataaatttctggagaggactctgaggccctcttgggcagagaatcatgtggattcaggatccacctctgccttgtcmcagctgtgtgactttggacaaggcactttccctctctgggcctcagtctccctgcaatggaagtaatagtcctgacttgatcaaagaacacacgaagagtttacagatacaagcataaactgaaaaaggaatgattatcacctgaacttcacagtacaaacctggttattttattttattttattttatttttagagacaggttctcaccttgtcaccctggctggagagcagtggcgcaatcacagcttactctagtctcaacctcccagacccaagcaatcccccacctcaaccttcc

SEQ ID NO: 169245 - DNA, 601 bp, Human
acctagagaacacagtccaagcttcatcttacaaccttccctcccaaatcctttccggccagcacagcagatagctcccacaagcctcagccaccaggcagggcaaatgctgatcaggtgtaacctggattttagaaccactgaaaggatgatggagagagattcttgtcaccccagagtcacagtccatagacagttggcggtttgaaaggcagccatttccaggttgaaacactgaggctcagggaagagaggactgaggtggctcccagtccagtgcattttccaacacataaatttstggagaggactctgaggccctcttgggcagagaatcatgtggattcaggatccacctctgccttgtcccagctgtgtgactttggacaaggcactttccctctctgggcctcagtctccctgcaatggaagtaatagtcctgacttgatcaaagaacacacgaagagtttacagatacaagcataaactgaaaaaggaatgattatcacctgaacttcacagtacaaacctggttattttattttattttattttatttttagagacaggttctcaccttgtcaccctggctggagagca

SEQ ID NO: 169246 - DNA, 601 bp, Human
acctaccgggcagggctgccaggagaatgacatatgatattaccaataacataattaccgctagtacctatcacatgttcattcttttaaactcaataattcctcatgtaaccctggaggaagcatctattctcctagtcccatttctcagataaagacgctgctagggtcagcccactacagcacacaagtcaaaactggcccactccctgtttttgtaaataaagttttattggaacacagccttgctcatttgtttacattttgtttatggctgttttcctagagttgcatcagattstaagcattgggcagagttctccagagaaatggttaaacaaatatctgggcacctcatgacccagtcaaggtaacacataaaattaaccatcacagtatataacccacaaacctaaaatatttgctatagattgggccctttgcagagaaagtgtgctgacccttgaacctgaggctcagagaggtgatgtcacttgtccaagttcgcataagaggaggttgcaagccaggcacccagtaggtgctcagtccatgctcctgatctatgaagattcgtgctgtcacttttagggagtcagaa

SEQ ID NO: 169247 - DNA, 601 bp, Human
atgagatcttagacctaccgggcagggctgccaggagaatgacatatgatattaccaataacataattaccgctagtacctatcacatgttcattcttttaaactcaataattcctcatgtaaccctggaggaagcatctattctcctagtcccatttctcagataaagacgctgctagggtcagcccactacagcacacaagtcaaaactggcccactccctgtttttgtaaataaagttttattggaacacagccttgctcatttgtttacattttgtttatggctgttttcctagagktgcatcagattgtaagcattgggcagagttctccagagaaatggttaaacaaatatctgggcacctcatgacccagtcaaggtaacacataaaattaaccatcacagtatataacccacaaacctaaaatatttgctatagattgggccctttgcagagaaagtgtgctgacccttgaacctgaggctcagagaggtgatgtcacttgtccaagttcgcataagaggaggttgcaagccaggcacccagtaggtgctcagtccatgctcctgatctatgaagattcgtgctgtcactttt

SEQ ID NO: 169248 - DNA, 601 bp, Human
tgccagcaatggggagccaaggaaggcttctgagcagagaaggagcatcgagaatccatcaaaattaataaaggggcttgcacctcatccatctaaccttgccgtagaacacctgacttagaaacatagccccttattgagaaccaagtcccttgtattctccaactctaagcaaggtgagggaaaagagtcccactcccatgggaacggtaccttgagaaagcttgggtctcactgggctggccaggtgcccaaggcagcttctaagtcagatgcctctaacttggggccccaagaaatycagcttagttcctcattccagccctgccacatctcagatggtgacctctacaaggggctccacctgtgcctctacttcccctctgcacaatggatgtgatcatcatgctctgtgcattacatcaccaagtcctctctgaggctacaggtagggaatcagaagcctgagaggaatggggactcgtgccaggtcatccaacagtgagcagaagggctgagggcaagtcacttaatctgtctgtgtcttggtttccccatctgtgaaatgagatcttagacctaccgggcagggctgccagga

SEQ ID NO: 169249 - DNA, 601 bp, Human
tatgggagagatattccggtaaacatgaacctgcaaaatagagcaggagctccaccagagcaaaaggcaggcccatgttgtgagatctgaggggagaactggggatcctggaagacttcacagaggaggcggtgtgcaagtagggggttaagcaagctttgcaggaagaggaggcgagaggagcacgccaaacccaggcgtgactccttccaaagcaagagactggcccagggaccctgatttagggatgggtgtgaaacgagggaagaggaggctgcaaaattcaagtgaggtcagtcayggagacccctggaagaagttagaccgtgttcctgccagcaatggggagccaaggaaggcttctgagcagagaaggagcatcgagaatccatcaaaattaataaaggggcttgcacctcatccatctaaccttgccgtagaacacctgacttagaaacatagccccttattgagaaccaagtcccttgtattctccaactctaagcaaggtgagggaaaagagtcccactcccatgggaacggtaccttgagaaagcttgggtctcactgggctggccaggtgcccaaggcagcttctaag

SEQ ID NO: 169250 - DNA, 601 bp, Human
ccatccctgccactgttgggttgtgtgaccctggatcagccactttgatgcctccactgcctcctctgaaaaatgggtttggtcattccttccttgcaaagaaggggatgaattggtacccaaccgacggtcaaagtcctgctaccattatcaattccccaagcctgggcctagggcagcctagaggaagggagtcctcgtgaggccactaacaacgtggcaatgagctgatcacagccacatgtgtgcctgcagccatgtgctgggcactgagctcagagaggtgaacccaacacaggtyccaccaccttccagagctcccaccctatgggagagatattccggtaaacatgaacctgcaaaatagagcaggagctccaccagagcaaaaggcaggcccatgttgtgagatctgaggggagaactggggatcctggaagacttcacagaggaggcggtgtgcaagtagggggttaagcaagctttgcaggaagaggaggcgagaggagcacgccaaacccaggcgtgactccttccaaagcaagagactggcccagggaccctgatttagggatgggtgtgaaacgagggaagaggaggc

SEQ ID NO: 169251 - DNA, 601 bp, Human
cataggggtcagttgtgcacagtcacgcactttggagacagaggcctgagtttgaaatccatccctgccactgttgggttgtgtgaccctggatcagccactttgatgcctccactgcctcctctgaaaaatgggtttggtcattccttccttgcaaagaaggggatgaattggtacccaaccgacggtcaaagtcctgctaccattatcaattccccaagcctgggcctagggcagcctagaggaagggagtcctcgtgaggccactaacaacgtggcaatgagctgatcacagccacaygtgtgcctgcagccatgtgctgggcactgagctcagagaggtgaacccaacacaggttccaccaccttccagagctcccaccctatgggagagatattccggtaaacatgaacctgcaaaatagagcaggagctccaccagagcaaaaggcaggcccatgttgtgagatctgaggggagaactggggatcctggaagacttcacagaggaggcggtgtgcaagtagggggttaagcaagctttgcaggaagaggaggcgagaggagcacgccaaacccaggcgtgactccttccaaagca

SEQ ID NO: 169252 - DNA, 601 bp, Human
cgccggggaagggctttgcataggggtcagttgtgcacagtcacgcactttggagacagaggcctgagtttgaaatccatccctgccactgttgggttgtgtgaccctggatcagccactttgatgcctccactgcctcctctgaaaaatgggtttggtcattccttccttgcaaagaaggggatgaattggtacccaaccgacggtcaaagtcctgctaccattatcaattccccaagcctgggcctagggcagcctagaggaagggagtcctcgtgaggccactaacaacgtggcaatragctgatcacagccacatgtgtgcctgcagccatgtgctgggcactgagctcagagaggtgaacccaacacaggttccaccaccttccagagctcccaccctatgggagagatattccggtaaacatgaacctgcaaaatagagcaggagctccaccagagcaaaaggcaggcccatgttgtgagatctgaggggagaactggggatcctggaagacttcacagaggaggcggtgtgcaagtagggggttaagcaagctttgcaggaagaggaggcgagaggagcacgccaaacccaggc

SEQ ID NO: 169253 - DNA, 601 bp, Human
tagaccctatactgagtggcctgggcaggatgctgtacctctctgagccccagcatgctcgcacagaaactggagcaactaaacaccagggctgacacctcactgaactcctagcactctgcctggcaagtggtaagtcattcaacaaataatgatttttatctataataaaaaaaaaaagtaaacaaatagaggccgagtgcggtggctcatgactgtaattccaacactttgggaagccgaggcaggaggattgcttgagcccaggagttcaagaccatcctaggcaacataacaggaygctgtctcaaaaaataaaaataaaaaataaaacattagccaagcatggtggtgtgtgcctatggtctcagctacttggtaggatcacttgaaactgggatttcgaggctgcagtgagctgtgatggtgccattgcactctggcccgggtgacagagcaagaccttatctcaaaaaaacaaaacaaaacaaaacaaaacaaatatacattcacatttatttggaattagagcctcattgcttccagcccattggaggaaacatgaggttcagtgcaagtctggattttaaaaaaacacatt

SEQ ID NO: 169254 - DNA, 601 bp, Human
taggagggaaggcctgggggcaatacaagcaaagtgcttagcacagtgccaggggctgacttcaccccataaatagtagctgccattctggaaagactctcaaatataataatagtatttgctggtaataccggtaatgctggtaatagtattaccattaagtactattattatatttgagagtctctccagccctgtctccagcacagccctccccctctctgttttcttgccttcttgcccaagattcacccacatagtgttagaccctatactgagtggcctgggcaggatgctgtayctctctgagccccagcatgctcgcacagaaactggagcaactaaacaccagggctgacacctcactgaactcctagcactctgcctggcaagtggtaagtcattcaacaaataatgatttttatctataataaaaaaaaaaagtaaacaaatagaggccgagtgcggtggctcatgactgtaattccaacactttgggaagccgaggcaggaggattgcttgagcccaggagttcaagaccatcctaggcaacataacaggacgctgtctcaaaaaataaaaataaaaaataaaacatta

SEQ ID NO: 169255 - DNA, 601 bp, Human
tgactccaacacccagagggagagatggcccgacacactagcccattttacagcagaggacactgagcctcaaggaggcgatgccacaggcgcagggtcacacagccagccatccgcagagccaaggtcacacccagagacgtctgatgtcacagtgtgtggtttttatcaaagttgcatgaaaaagggaaacatcattggccaaagtgactggcacgacctctcccaccccaccaccacccccaatttctctcttgcaagcattctcctcctttcaatctgtctcgttctcgctctctcyctttctctctctctctccctcatgtcttgctcttattcaccctccctctgtccattatccatcctctctctctccctctctcttattcttcctctttctgcccctccatccgtatctccctccctctctccttctccccctccctcttattctctagttcttcttatttctctctctctttctctctctctctctcacacacactttttgggggaaaaaaaaaaaaacccaaggctcacagatgggatgagaacttcccagggtgacacagaagctgaggacaaaaccggacagcccccg

SEQ ID NO: 169256 - DNA, 601 bp, Human
ccctgtctctaaaaaaaataaagaaagaaagattttacatttgatataggcaagagtctggggcaggagcctaagcaaaggccactgagacatcttgacctgagctcagggaaccacacccacaaccccaaggatggggaccaagagatagtggccaacagcctgcgtgacactctaggcatcccaccggggccacgcagagcccgaggcaggcccaggggactagccactccttggcccagccctatgcctgtgtcccctgccccttctctgccctcccatcaatgacaacttccatcartagtgtcaccgtggcaatcgagaaaaggaaaagggaaagcagaccactgtctctatgcgagtcggctccagggcgtgaccgtgaacatgacctgcaggctcagtcggtcacagtgaatgactccaacacccagagggagagatggcccgacacactagcccattttacagcagaggacactgagcctcaaggaggcgatgccacaggcgcagggtcacacagccagccatccgcagagccaaggtcacacccagagacgtctgatgtcacagtgtgtggtttttatcaaagttgcatgaa

SEQ ID NO: 169257 - DNA, 601 bp, Human
tgcctgtagtctcaactacttgggaggctgaggcaggagaatcgcttgaacccagaaggcagagcttgcagtgagccgagatcacaccattgcactccagcctgggccacagagcaagactccgtctcaaagaaaaaaaaaaattaaccagacatggtggtgcatgctggtagtcccagctgcttgggaggctggtgcaggaggatctattgagcccaggagattgaggctgcagtgagctgggatcatgccactgcactccagccagagtgacagagcaagaccctgtctctaaaaaaaataaagaaagaaagattttacatttgatataggcaagagtctggggcaggagcctaagcaaaggccactgagacatcttgacctgagctcagggaaccacacccacaaccccaaggatggggaccaagagatagtggccaacagcctgcgtgacactctaggcatcccaccggggccacgcagagcccgaggcaggcccaggggactagccactccttggcccagccctatgcctgtgtcccctgccccttctctgccctcccatcaatgacaacttccatcaatagtgtcaccgtggcaa

SEQ ID NO: 169258 - DNA, 601 bp, Human
ggtgagccacgtgctcaggcgtcgtgagccgggcggaggtggctgccacctcccacgccaggcaaagggctgcctcggtggttctcccagccacggttccaccactgagccccagggaaggagacttctgacccagccacctcctgccccgctgcctacctgagggaaagccaggggtattcgggaagaaggacagagcccaacaactgcccatatcaagggctccctgggtactccgggctaggtgctcacctcttctctagtacgggaggagtaagagaacctaccttgcaggctgctrggaggattaagtgagatgacagctggaaagccttcagcataaggtgagccctttgtcaaaaaaagggtagctgctctgacacttatcattcttttgttgttgttgtttttctttttcttttagagatagagtctcgctctgtcatccaggctggagtgcagtggcacaatcatagctcactgcaacctcaacctcctgggctcaagcaatcctcccacctcatcctcccaagtagctgggactatgggtgtgcactaccacactcggctaattttttaaaatttattttgtagagatgag

SEQ ID NO: 169259 - DNA, 601 bp, Human
gagctgagacagacacccctgctctttctcctcccaaaagcactcctcagcttttcttcatggcacaaatcctcgctgatcttccggcctcttcctactaccccgtcacccctgccctgaacaccacagcacttcatttggtcatcatactgcagaggttcagtctgccccctgctcaccccgctgcgatcacgagacccacgttggattctgtcttccaaacttctccatccacaatggagacagtcagttccattaagggaaggagagaaccaggagcaggtgccaaaaaaagcaattrcgtgaataactcaactcactccgtttctcttacagggttcaacaatgatagtggccaccattcgtggagcaaggaacttttgtacatcacttcagctctcagaacctcggttctaggaaatgggggaaataataggaccggccgtgatggaggcagttaggagaattaagtgaaatgatccatgcaaaacgcttagcacgtggggcgctcctgccaacgctggctatgagtacagcctgtcaatgttgttggccagcctgcaggtgacagtggggacctgcagggctgggcccggggagg

SEQ ID NO: 169260 - DNA, 601 bp, Human
tcaggcagcacagggggccgagggcaggggcctctggttcttggggactgatgggcatgcctgcccagcaaggaaagactgcaggacagtttttaaggacagctatggccagaaagaaccacctcacactccatgcccagggtcaaggcccagagctgagacagacacccctgctctttctcctcccaaaagcactcctcagcttttcttcatggcacaaatcctcgctgatcttccggcctcttcctactaccccgtcacccctgccctgaacaccacagcacttcatttggtcatcatrctgcagaggttcagtctgccccctgctcaccccgctgcgatcacgagacccacgttggattctgtcttccaaacttctccatccacaatggagacagtcagttccattaagggaaggagagaaccaggagcaggtgccaaaaaaagcaattgcgtgaataactcaactcactccgtttctcttacagggttcaacaatgatagtggccaccattcgtggagcaaggaacttttgtacatcacttcagctctcagaacctcggttctaggaaatgggggaaataataggaccggccgtgat

SEQ ID NO: 169261 - DNA, 601 bp, Human
gaacccatgcttgccttgttcccagcgacccctccaccctaccctgcttaatatctccaaaggaattttattccaagcactgcaagatctggactggggtggggtgagggaagtagtacctgccacagagagagagaaagagagaaaatctgaaagggggttatttcccccactttgcacaaattatctcaaggaatgaacgtagcaatgcttgagcccactttacagatgaggaaacaaactccgagggatgaagctccttgccaaaggagagataaactctttgctctggggctgcaarcacccagaaagtgaaagaaaattcctgagcaacacaccgggcagaggaagctgggtctgccaagtgatgggtaagacagacccaaatggccaaattttcgaaagacgctttcatccccaagttacagccataagcgtgccgtgcactaacgccagaaaccattgctgttcttattaggggtggatttaatgagggcatcccaggcacacaactgaacacttctgtgtattatctaagcccatcacccagcaagcccatcagtgggggtgccccttctccccaccccagcagggccaccct

SEQ ID NO: 169262 - DNA, 601 bp, Human
tgccctcaatcctctgtgcaagcccagccaagggccctgtgccaggcaggagtcaccggcccgccctgccctctgggattaagcaggaggcctcccccaggagctgagccacagcctgcagagaaaatcctcccagagggatgggcccaggcagctgaggacaggccatgactaactgggcttggggcccccaccctggagccccagagacactcagctttgggacctgcatgctgggaggagccggagctgggcagaaaggagacttccttggccccttccctcattcatgcaactaacmtgcctttattgaggaccttctatatgccaggcatggtacaaaccctatggatctagcatggaataggacagacactatccccaccctcctcctggagctgatggtgaggccaggaaacagtgtctctttgtgaccaaagcacggtcactttgaagtcacagccccactactgtgtggccaaggctctaccatgttccctctctggacctcagtttccccatgggtgaaatggggatgatgtcatctcccctggggccttgtaatggcctggcacacagacagtcccccaaacagtgctgc

SEQ ID NO: 169263 - DNA, 601 bp, Human
tagacacgcttgaggagaaaggagcctgacaaccattcacatcttagtataaattagaccaaagcagggaatttgcaggacttctcatttacggctaccacatgaccactggctctgtcctgagacctgccatatgtcaatgaagagtctcattattctcatttcctagactctgactttagagtatgtccaaggtcacacagcctggaagggacagaaagctgggtttgaatatgggctgatgttgaatttctgcctcagtagtagtgagaaaagctgaaattgggggtggggggctctrctccagctgagggagcacacccagatactgaactccatgaccggcctgccctcaatcctctgtgcaagcccagccaagggccctgtgccaggcaggagtcaccggcccgccctgccctctgggattaagcaggaggcctcccccaggagctgagccacagcctgcagagaaaatcctcccagagggatgggcccaggcagctgaggacaggccatgactaactgggcttggggcccccaccctggagccccagagacactcagctttgggacctgcatgctgggaggagccggagctggg

SEQ ID NO: 169264 - DNA, 601 bp, Human
gaaaaagaataaaaaagaaagcaactcttgtcttattatgaaataacaatacttggacatacagcagcatgaaaacaaaacaaggaaagaggtcatctaaaaaatgtatgccaagattaccgaaacatggggagtatctagaggaaaaaggcttaagcaaaagtttgctaactgcagaagggttaacactggtaacatactgtggcagacaagtttcttttttaaaaaaacttttgaggttccccccctttaaattaaccctttccggtccatatgccactaagcaggtaccaacctagagaaaaaaaaaaaactcatccactcagcaatagtggccctttcaaattaacagaggggtggggtaaggttgagggggaaggaaacagacagggggagaggaagggcctggtagaggaggggatctttcttgtcattcaagttagggcagccacgaatgtcccaaatctgttggagatgtcagaatgcagggaccgccaggtgggcacggaggctcgagccttggcgtcacccacgtcgtctgtgcagtggacagacaggcactgcaagtggctgccaggctgggatgctgaggccttgtttg

SEQ ID NO: 169265 - DNA, 601 bp, Human
aacagttctggttctgttagcctggcttgtagcaggaagaagatgtgatatggaaacacttgctttttcttaacctcccttgactctgtttcacaaagatagaggggcagagaactgaactggcaaaaattaaaaattgaaaaaaaaaagtaattgaaagttggcttgcaaatttttaacaaagttagagaatcaaggttctctggggtttctgataagagtgatagaactattccggttcagtgggccccagacttcgtggttgctattttttaaatactggttaaaaaaaatgaatacwgataataagaccacttttactatttttgctccatggacctcatattttgacatatgtctgaatacctgatcagcatgacatagccagctaactttaggaagacctggtaagatcccagtggaaaaagcaaaagtattttcattcctagtctgggctcgttacagttaaatgtatctttaggctttttgaaatattagacatagctggcttttgaggaccactggaattcactgcttggattgtccttacaaaattaaatactccacatgtctgaacaaaatgtatctagatgtttttatg

SEQ ID NO: 169266 - DNA, 601 bp, Human
taacatagagttggagaaatgttaaaaaattattggtgttttcctgatatttgacttagaggtttctgctggcatcatatagttggaaacaacaaaacaggtgaactgaaagcctttcactatcaaaatactgaatttaattttatggtcattttgggtgatacagatcatgctgttgtatgtcattcgtagaggtataataccatttttttttttttgagacggagtttcactcttgttgcccaggctggagtgcaatggcgcgatctcggctctctgcaacctctgcctcccgggtttragcaattcttctgcctcagcctcccgagtagctgggattacaggcatgtgccaccatgctcggctaattttgtatttttagtagagatggggtttctccatgttggtcaggctggtcttaaactcccgacctcaggtgatccgcccacctcggcctcccaaagtgctgggattacaggcgtgagccaccatgctcggccataaccccattatttcttcagattcattcagagagttagaaagaattaaggcattttttacaaaatgatgagagttacagagaagctgaggaaaaatagct

SEQ ID NO: 169267 - DNA, 601 bp, Human
agacttgtatttattaaatattgactattttaaataatattacaaaatataagtaagatatggagaataatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccrtaagttctagaggtgtgtgtgtgtgtatatgtatatatgtatatagagagagatatatatgttttttgtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgttattttgtaaatcctgggaagagtatcagagttgaaatcccttcaattt

SEQ ID NO: 169268 - DNA, 601 bp, Human
aatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccgtaagttctagaggtgtgtgtgtgtgtatatgtatatatgtatatagagagagatatatatgttttttrtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgttattttgtaaatcctgggaagagtatcagagttgaaatcccttcaatttaacgtccctataaaaaagaaatccagaacctactgcctaagacctcggtgcttctccagtgttgtaat

SEQ ID NO: 169269 - DNA, 601 bp, Human
gtgtatacccagcccgattttcatatacttcctaaggacctactgaatgccaggtactgggtatataaagacaaatggaggatctccagatcagttgagggcattcatgcgttcatccagcaaatatttgctgagtcttgaccatgtgctaaaccagaggtccccagcctttttggcgtcagagactggttttgtggaagacaatttttcaaccaacgggagagttggggggaatgatggtttcgggatgaaactgttccaccttagattattaccaggcattagattctcataaggagtrcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagc

SEQ ID NO: 169270 - DNA, 601 bp, Human
tgtatacccagcccgattttcatatacttcctaaggacctactgaatgccaggtactgggtatataaagacaaatggaggatctccagatcagttgagggcattcatgcgttcatccagcaaatatttgctgagtcttgaccatgtgctaaaccagaggtccccagcctttttggcgtcagagactggttttgtggaagacaatttttcaaccaacgggagagttggggggaatgatggtttcgggatgaaactgttccaccttagattattaccaggcattagattctcataaggagtgygcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagca

SEQ ID NO: 169271 - DNA, 601 bp, Human
tattcccagcacaaagaaagaataaatgtttgacatgatggatatactgattgcccttatttgatcattacacattgtatgcatgtattgaaatgttaccctgtatcccataaatatatacaatttttatgtatcaaccaaaaataaaaagaaaaatgttcataggaatattgaataggaaataagattgaaagtataccaaattatttaggaaaaaaccattacttacatttaagtagaaatgtgtcaacataaaggagactataaaaaaataggccaggcacagtggctcactcctgtratcccagcattttgggaggccgaggcgggcagatcacctgaggtcaggagtttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcgtctaaaaaacaaaaccaacggaaataatggttgggtgtagtggctca

SEQ ID NO: 169272 - DNA, 601 bp, Human
tgcccttatttgatcattacacattgtatgcatgtattgaaatgttaccctgtatcccataaatatatacaatttttatgtatcaaccaaaaataaaaagaaaaatgttcataggaatattgaataggaaataagattgaaagtataccaaattatttaggaaaaaaccattacttacatttaagtagaaatgtgtcaacataaaggagactataaaaaaataggccaggcacagtggctcactcctgtgatcccagcattttgggaggccgaggcgggcagatcacctgaggtcaggagyttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcgtctaaaaaacaaaaccaacggaaataatggttgggtgtagtggctcatgcctgtaatccctacactttgggaggctgaggcgggtgaatcacttgagg

SEQ ID NO: 169273 - DNA, 601 bp, Human
tagaaatgtgtcaacataaaggagactataaaaaaataggccaggcacagtggctcactcctgtgatcccagcattttgggaggccgaggcgggcagatcacctgaggtcaggagtttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctggggkacaagagcgaaacttcgtctaaaaaacaaaaccaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccag

SEQ ID NO: 169274 - DNA, 601 bp, Human
aaaggagactataaaaaaataggccaggcacagtggctcactcctgtgatcccagcattttgggaggccgaggcgggcagatcacctgaggtcaggagtttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcrtctaaaaaacaaaaccaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtga

SEQ ID NO: 169275 - DNA, 601 bp, Human
ccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcgtctaaaaaacaaaaccaacggaaataatggttgggtgtagtggctcatgcctgtaatccctacactttgggaggctgaggcgggtgaatcacttgaggtcaggartttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccccaaaaaaaaaaaaaaaaaaaaagaaaagaaaataataatggtgtgaggatgtggccaaaagttgcttttcatcatatatttttttaattta

SEQ ID NO: 169276 - DNA, 601 bp, Human
accaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccmcaaaaaaaaaaaaaaaaaaaaagaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttac

SEQ ID NO: 169277 - DNA, 601 bp, Human
ccaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatccccccmaaaaaaaaaaaaaaaaaaaaagaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttact

SEQ ID NO: 169278 - DNA, 601 bp, Human
caacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccccmaaaaaaaaaaaaaaaaaaaagaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttactt

SEQ ID NO: 169279 - DNA, 601 bp, Human
tgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccccaaaaaaaaaaaaaaaaaaaaggaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttacttgctagtgaaacaaagtcagc

SEQ ID NO: 169280 - DNA, 601 bp, Human
ttattactgggactagaatccaggctttgcaactcttgatttaggactttttctgctgcgcaatcttggcttcccactgagtttgaaatggaattgtattatgctgcagtgttaataattgaaagaggctttttaaaaattgtactaatgcatttttttttttttcattttaagaggagaatttccaagggcctttagaggtatgctggaatgagatttcactaaaatattttatttttatgaatgctaattttaatcatttaaaaggaaatgatgatcgttcagtactgcattttgtcasaagatttttttcttcctacctctgcaaggctgacataaaggaaaagcggaagactttcatcgagtatttatgggactgatgaaataatgcatctgttggcagctaattgcaggtctttctaggaatagcaaacatgtgacaggtcttgccccagcggagatgcctccatttcactttaaaacatggatttggtattcttttcacttagaaattctggctatgcctttttttctcccttctgtggatgtatagaccgttcggctgcatcagacactgtattgaacatcagggttgatttaa

SEQ ID NO: 169281 - DNA, 601 bp, Human
ttatttttatgaatgctaattttaatcatttaaaaggaaatgatgatcgttcagtactgcattttgtcacaagatttttttcttcctacctctgcaaggctgacataaaggaaaagcggaagactttcatcgagtatttatgggactgatgaaataatgcatctgttggcagctaattgcaggtctttctaggaatagcaaacatgtgacaggtcttgccccagcggagatgcctccatttcactttaaaacatggatttggtattcttttcacttagaaattctggctatgccttttttyctcccttctgtggatgtatagaccgttcggctgcatcagacactgtattgaacatcagggttgatttaactcattgttgctcagctgtggctatgctttggaatcacctggggagcttttacaaaactactgatgcccaggctctactccaggtgaatccattacacaatctctggagggtgggttctgggcaatgggatgttaaaggcacacacgggcatgcccatgtgtaagtcaggcacacgtacaaatgcttcgtgaggtcatcttaaattgcagccggggttgagaaccttgagc

SEQ ID NO: 169282 - DNA, 601 bp, Human
gtgggactggcttagtctgtcagactggctgtctgtctgctcatggtctttattcataattaaaaatgaatttcaggccaggtgcattggctcacgcctgttaattccaacagtttgggagaccaaggtgggaggatcacatgaggtcaggagttcaagaccagcctgggcaacatggcaaaaccccgtttctactaaaaatacaaaaagtagctgggcatggtggcacacacctgtcatcccagcttcttgggtggctgaggcacaagaatcacttgaacccaggaggcagaggttgcartgagtcgagagcacactccatcctgggtgacagagtgagaccctgtctcaaaaaaaaaaaaaaaagcaaaagcagtcttttgtgtctcacaaagaacttcagataacatcagtaaaataatcataatagctagtggggacttactgtctgccagctatattctaagtcctttgtgtttattaattcatttaatcctgacaataacttgatgagggaggtggtattattacccttttgaacagatgcgaaaatgtaagcacagagatagatgttaaataacttacttaaagtcacacaaca

SEQ ID NO: 169283 - DNA, 601 bp, Human
aagtgccaagttgacaattcctggaaatgttcatgttctatttatgctcagcaccatagcagacagggtggcaataccattaccaaaataataccgccgagatgtactaagtgacaaatgagaggcttctggttttataacctaaatacaagactttaaaagcatctcccaattctaccatttgttgataaggtctgtgggtgctgagtagtaatggtgaagttgctgtggagaattatagatcaagtagagcgtatctgcagtgacttgtcctgttgctagaactatagaaggttagagytggaagggatcttagaaacactttatagatgaggaaacgaagggatatccaagtctaacagcatgcatatgggttcttctgttcaaatagtagaacttcatgtaacataaaaataggaatttctctgaaatatattgggtagttcacaactttgaaggaatgataaaggtttcagggcttaataagggcaggaatgaggcaacagtgggggatctcaggccatcagatggtcatcttcaatcaagtttctacactgtaccttccttccagattcagactattggccaaacttgggtcctg

SEQ ID NO: 169284 - DNA, 601 bp, Human
ctggaaaacaaatgatagccctttaagggaggaggttgctttacctcttcttcatacagcaaggcccaggttgagggccaaaggtggtagataaaacgctggagagcagttttggagcagcataggtctccttaaacttttccaaaatcagaatgtattgggggagaaaaatggattgagaatgtagatgtaaagaggaggtttagaaagagaatttgaattgggtactggcctaagggctttagatatataaactcactttattatcataatagccctttgaggtaggcactactgttaycatttgcatttcacagatgaggagactaaggtgttagataaattgctcaaggtcacacagtttggcagtagcagagctgaggttcaaacactgacagtctggctcacagtctgtgcttctaatcactagggtcctgtctctatcggtctactaccagttcttagatctgattggagtcacatggcttagatgacctgacctgggctagctgcagcttctttattttctgacccttgcttgcctcaggtctcacacatagccggcattttcattatgtgtatgtcagtctcttttttaaca

SEQ ID NO: 169285 - DNA, 601 bp, Human
ataaactcactttattatcataatagccctttgaggtaggcactactgttatcatttgcatttcacagatgaggagactaaggtgttagataaattgctcaaggtcacacagtttggcagtagcagagctgaggttcaaacactgacagtctggctcacagtctgtgcttctaatcactagggtcctgtctctatcggtctactaccagttcttagatctgattggagtcacatggcttagatgacctgacctgggctagctgcagcttctttattttctgacccttgcttgcctcaggtmtcacacatagccggcattttcattatgtgtatgtcagtctcttttttaacagttaccaaattttaaaaaatacaaaagaaaatgaaagatgttttctaagaaatatgattaggtaaaataaaggttttgaatgtgattgatgtggacatttttgttcatttagtttttaaacatatctcttccctttcaatctctttattattaattagtcatgtgctacgggcaaatgtgacttttcaggcctttcatatttgtttgagcccttttattccatcatgtgccagtcacaattcattcagg

SEQ ID NO: 169286 - DNA, 601 bp, Human
aaaatgcaatagagagtatcaacagcagaattaatcaagcagaagaaagaatctgtaaacttgaagacattatttaaaattacagttggaggagaaaaagaatgaaaaggaatgaagaaagctcatgggatttatgagacagcatcaaaagaacaaacatttgaataataggagttaaggcagaggaagagagataaagtggtagaaagctgttttaaagaaatattagcagaaaactttccaaatctggggaaagatataatatccaggtacaggaaggtcaaagtctctaattagattmaatccaaacaagactacactaagccttattataattaaactgtcaaaaaacaaagacaaagagaagaccctgacagcagcaagagaaaagaagcaaataacatataagacaatttcaataagcctagtagtacatttctcagcagaaactttataggccaggagagagtaggatgatatgttcaaaatgttgatggaaaaaaaaaattgctaacaatgaatagtgtagccggcaaaaccgttctttagaagtgaaggagagaatgatactttcccagataaagctgagaaagtttatcac

SEQ ID NO: 169287 - DNA, 601 bp, Human
taggggaaatgctctatgacattggtctgggcaatggattttttggatatgaccccaaaagcacaagcaacaaatacaatagacaaatgggataaacaaaagcttctgcacaggaaacaacagagtaaagaagtaacctatggaatgggagaaattatttgcaaaccatatatatgataaggaattaatgtccaaaatacaccaggaactgtaaaaactcaatagcaagaaaacaacccaattaaaaaatgggcggccagcgcagtggttcatgcgtgtaatcccagcactttgggaggcygaggtgggtggcttgtctgaggtcaagagttcaagagcagcctggccaacatggtgaaaccctgtctctactaataatacaaaaattagtggtggcactcgcctgtattcccagctacttgggaggctgaggcaggagaatcacttgaaaccaggaggcggaagttgcagtgagccaagattgagattgtgccactgcactccagccttggtaacaagagcaaaactccgtctcaaaataaataaataaatgggcaaaggatgggaacagacatttctcaaaagacatacaaatggccaa

SEQ ID NO: 169288 - DNA, 601 bp, Human
tctatgacattggtctgggcaatggattttttggatatgaccccaaaagcacaagcaacaaatacaatagacaaatgggataaacaaaagcttctgcacaggaaacaacagagtaaagaagtaacctatggaatgggagaaattatttgcaaaccatatatatgataaggaattaatgtccaaaatacaccaggaactgtaaaaactcaatagcaagaaaacaacccaattaaaaaatgggcggccagcgcagtggttcatgcgtgtaatcccagcactttgggaggccgaggtgggtggmttgtctgaggtcaagagttcaagagcagcctggccaacatggtgaaaccctgtctctactaataatacaaaaattagtggtggcactcgcctgtattcccagctacttgggaggctgaggcaggagaatcacttgaaaccaggaggcggaagttgcagtgagccaagattgagattgtgccactgcactccagccttggtaacaagagcaaaactccgtctcaaaataaataaataaatgggcaaaggatgggaacagacatttctcaaaagacatacaaatggccaacaggtatatgaa

SEQ ID NO: 169289 - DNA, 601 bp, Human
aaaccaggaggcggaagttgcagtgagccaagattgagattgtgccactgcactccagccttggtaacaagagcaaaactccgtctcaaaataaataaataaatgggcaaaggatgggaacagacatttctcaaaagacatacaaatggccaacaggtatatgaaaaaatgatcaacatcgcaaatcaccagggaaatggaaattaaaattataatgagatataacctcatacctattagaattctaggtgcttattaaaaatatgaaaggtaacaagtactggcatggatgtggagaaartggaacctttgcatacttggtgagaatgtgaatcagtatagtcattatggaaaacagtatggaggttcctcaaaaaatttaaaatagaactctgtgtcttagcaatcccactactgggtatatatccagaagaagtggagtcagtatatcaaagagatagctacactttcatgttcactgcagcattatttacaatagccaagatacagaatcaacctgagtgtccatcaacagatgaatggataaagaaaatatagcatatatacataatgaaatactattcagtttttaaaaagaaat

SEQ ID NO: 169290 - DNA, 601 bp, Human
tgccactgcactccagccttggtaacaagagcaaaactccgtctcaaaataaataaataaatgggcaaaggatgggaacagacatttctcaaaagacatacaaatggccaacaggtatatgaaaaaatgatcaacatcgcaaatcaccagggaaatggaaattaaaattataatgagatataacctcatacctattagaattctaggtgcttattaaaaatatgaaaggtaacaagtactggcatggatgtggagaaagtggaacctttgcatacttggtgagaatgtgaatcagtatagycattatggaaaacagtatggaggttcctcaaaaaatttaaaatagaactctgtgtcttagcaatcccactactgggtatatatccagaagaagtggagtcagtatatcaaagagatagctacactttcatgttcactgcagcattatttacaatagccaagatacagaatcaacctgagtgtccatcaacagatgaatggataaagaaaatatagcatatatacataatgaaatactattcagtttttaaaaagaaataccgtcatttgtgacaacatggatgaacctaggtgatattat

SEQ ID NO: 169291 - DNA, 601 bp, Human
aatacaagtgaaaatatagtaggacaaccatttacatagcacttaccttgtattaggtattataagtaatctagagattatttaaaatatatgggaggatgtatgcaggttatatggaaatattattatcattttatatcagggacttgagcatccatggattttggtatcttgggtggtagtgggggcctgtagtccccctgcagatactgacaaatgactgtagactgtattgcattcttgaaaatcacctgagtaaatctgacatgttttcttcacaaaaagtgataagtgtatgagrtaatgcatattttaatcatctctatttagccatcctgcaatgaccatcctgctatggtcccaatgtctcccagaattcaacttaatccccattgtggtggtattaaggggtggtaatagggggtggtattaaggggtgaagtaattaagtcataggggctttaccctcatgaatagattagtgcctgactaaagggctggagggaactcgcttaggctcttgttgccctttggcattctgctgcgggaggacacagtgttaacctcttctgccacgtgaagatgcagcaagactgccctc

SEQ ID NO: 169292 - DNA, 601 bp, Human
agtaggacaaccatttacatagcacttaccttgtattaggtattataagtaatctagagattatttaaaatatatgggaggatgtatgcaggttatatggaaatattattatcattttatatcagggacttgagcatccatggattttggtatcttgggtggtagtgggggcctgtagtccccctgcagatactgacaaatgactgtagactgtattgcattcttgaaaatcacctgagtaaatctgacatgttttcttcacaaaaagtgataagtgtatgagataatgcatattttaatyatctctatttagccatcctgcaatgaccatcctgctatggtcccaatgtctcccagaattcaacttaatccccattgtggtggtattaaggggtggtaatagggggtggtattaaggggtgaagtaattaagtcataggggctttaccctcatgaatagattagtgcctgactaaagggctggagggaactcgcttaggctcttgttgccctttggcattctgctgcgggaggacacagtgttaacctcttctgccacgtgaagatgcagcaagactgccctcaccagacaccaaatgct

SEQ ID NO: 169293 - DNA, 601 bp, Human
tttttttcagtgtcttctgtttgtatgcttttaagtttctaaatcttttctcttcattgtttttccccaaattgttggactctgagtaagcttctgccagtgtcattttaaaatatatttatatccttcagatgctaaaaatagtttgtgcacttttaaatggttgaaaaagaaaagaagattacatgatgtttgaaaatcacatgaaatgcaaatttcagtgtctataaataaagttttattggaacacagccatgcttatttgttaacacgttgtctctggctgctttcacaatacacsagcagggcagagtcaggtagctgcaacagagaccttatggtccacaaaacctaaaatgtttactatctggccctttacagaaaaagcctaccacccctggtatagagtgagaaaggccagaaaccagaaaaaaaacctgtggcttttcccaaaaaagctttggtttttttcttatgaccggaatcagctttatttgcctttctttacttggtgcctaactgagtgctggattaaagcaaatgcttagttctaaaattgttttgagagtcaaaactggggaggcctttcttcagggtaaac

SEQ ID NO: 169294 - DNA, 601 bp, Human
aaattgtacataagagaaaaagaattagataaaccaaacagataaaacccttttgtgctctgcacattcacacgaggatttagtttcagcttatcctgtgtatttactcatggtttagtctcaagatttttaagtattggcatgatgagataatgttagcatttgaatactaaccacagaaagcattaagcaaggtctgcagtcatgaagcatttgccttttgttcccatccattaggtatttaatgtattttttacatccccccaccttgtctttgttttcacctcctttgaaggaaatmttttgtcattgagactcaaacgttctgatgagtaatgctacgccagggtatgaatttcttcccattccctgagatagccattgtactattaatatttctgtctgttgtttagaagtgtagcctgtattaggttctcaatcccctaaggaatataacattttaagtgctcgtagagtgctgtgggctctaaaaggtatcaaaagcattccatcagaaatagaagctagagagcccttgtccttcaaggagtttgaagtctgtatggtaagagaggggtaacatgcatacgaattctgaaca

SEQ ID NO: 169295 - DNA, 601 bp, Human
ttttctttgaacctccacagatttttgtgatgatctttctccatgttttaacatagataccggtaaacttatctaacgcttccctagctccctctcaccatcgaatgccatccccttgagttaagtcagggactatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgtyggatgatcttgatatctaggctttgaatctgggcttggcagggtaggtgcatgagccctgaatataagggagctggcctagggagagaaaaaaaaccatcacttcaactcctgtcttccagggtgttgacttcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctagg

SEQ ID NO: 169296 - DNA, 601 bp, Human
actatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgtcggatgatcttgatatctaggctttgaatctgggcttggcagggtaggtgcatgagccctgaatataagggagctggcctagggagagaaaaaaaaccatcacttcaactcctgtcttccagggtgttgacwtcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctaggtggtatctgaatgtggcattacgagatataatgctctaaactctgcaatttctcttgtaagacggaaacaattcaacctgttctttgactccttttctgggttttcttggctccaggcttcttagaacact

SEQ ID NO: 169297 - DNA, 601 bp, Human
aattttggcagtctcccttggttctgtgttcttgggcaagtttactttctttttctttttcttttttttttttttttgagacagggtctggttctgttgcccaggcttgagtgcagcagcgtgatcttggctcactgcaacctctgcctcaagcattgctcaagcaaccctcccacttcaacctcccagttagctgggactacaggcgcatgccaccacacctggctaatttttgtatttttttgtagagacgaggttttaccatgttgtccaggctggtgtagaacttctgagctcaagygatctgcccacctcagcctcccaaagtgctgggattacaggcaggaaccaccatacccagcctctttttttaaaaaataattttttactttgaaataatttaagacaagaagttgcaaaaatagtactgagagatcccaggtacctttcactcagcttcccccaatgataatatcttacatgatcatagcacattgttaaaagcaggaaattgacattggtgcaatactagtaattcaagaacagaccttattggaataggttttacatgcaatctgtttttagtgtgtgtagttctgtg

SEQ ID NO: 169298 - DNA, 601 bp, Human
aaagataagttttctgtgctctagggacagtctcctgtctgccttgaacacattagacagatgaccttaatgatcggaagagatgcattggaaatacattcctttccctcatcagcagtgcttttgcattagcattgagcagggtttgactttcttggtgatacagaaggtgcaagaagcttagtatcatgtggtttgacatttaatcagacttgctttccttgttaacctaaaggccttcctcttctttggaatttaatgtgtcagtaatggctcctagagctggaacagatggagctgytgatgttctcacttaaacgaaaaaaaacatgatttatatcctcagcttcatttcttaaattcttgttgaactttcatttgattgtcagagccacataaccagaatgtcactaaatttgctttcgcggcattaccatctacttttgctttttaagcagttttggaaatgtgatgtagtataggaacatgagtacatgtttttaaacatgtattattcggagttaatgattcactgctgctgaaggagtagtttctgtgtgaaggcaatggttatttttttcattaaatattctcatcagaa

SEQ ID NO: 169299 - DNA, 601 bp, Human
aaaagtggcatgaatataatctcaaaatatctagaaagatgtcagtcctctgagtcattgtgcaaactagtttgttgagagagttcaaaggcatcatggatcttaacagctagaaaagattctaagagattacatcatcattatcaccttctggaaagatttattgagcatctgttaggtgccaggccctgggaatacagaagagaatatgactgattcttgccgttgagacatagttgaggacatagaattgatacacaagagatgaatagaaatccatggaatatagactaactggtarataaaagtacaggtgataagagcacaagaaggagaagtaatcaatagaggcttagctaggggctgggaaaggctgtagggactttccgtcactccgaaaacatgaagtccaaagtggtggccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgct

SEQ ID NO: 169300 - DNA, 601 bp, Human
atggatcttaacagctagaaaagattctaagagattacatcatcattatcaccttctggaaagatttattgagcatctgttaggtgccaggccctgggaatacagaagagaatatgactgattcttgccgttgagacatagttgaggacatagaattgatacacaagagatgaatagaaatccatggaatatagactaactggtaaataaaagtacaggtgataagagcacaagaaggagaagtaatcaatagaggcttagctaggggctgggaaaggctgtagggactttccgtcactcygaaaacatgaagtccaaagtggtggccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgctttctcacttccatcagatctctggtcaactgtgctctccaccagccttctctgaccactctatctacttcctgttcatcaacacatttatctcca

SEQ ID NO: 169301 - DNA, 601 bp, Human
gattctaagagattacatcatcattatcaccttctggaaagatttattgagcatctgttaggtgccaggccctgggaatacagaagagaatatgactgattcttgccgttgagacatagttgaggacatagaattgatacacaagagatgaatagaaatccatggaatatagactaactggtaaataaaagtacaggtgataagagcacaagaaggagaagtaatcaatagaggcttagctaggggctgggaaaggctgtagggactttccgtcactccgaaaacatgaagtccaaagtgktggccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgctttctcacttccatcagatctctggtcaactgtgctctccaccagccttctctgaccactctatctacttcctgttcatcaacacatttatctccatgaagccagggcattgtctgcc

SEQ ID NO: 169302 - DNA, 601 bp, Human
gccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgctttctcacttccatcagatctctggtcaactgtgctctccaccagccttctctgaccactctatctacttcctgttcatcaacacatttatctccatgaagccagggcattgtctgccttrttaattattgtatcctgagcacctagagtagtgcctggcatcattggtgcccaacaaaatatggttgaatgtatgaatgagtaaatgaatgcagaatcttgaaacagggtgtgctttttgggctgatagaacaaagtagtgtaaactgggtagcttataaacaatagaaatttaattcccacagttctagaagctgggaagtccaagatcaaggcaccagcagattaggtgtctggtgagggcccatttcctggttcatagacggtaccttgttgtgtcttcacatggtaggagggtcaa

SEQ ID NO: 169303 - DNA, 601 bp, Human
ctctccaccagccttctctgaccactctatctacttcctgttcatcaacacatttatctccatgaagccagggcattgtctgccttattaattattgtatcctgagcacctagagtagtgcctggcatcattggtgcccaacaaaatatggttgaatgtatgaatgagtaaatgaatgcagaatcttgaaacagggtgtgctttttgggctgatagaacaaagtagtgtaaactgggtagcttataaacaatagaaatttaattcccacagttctagaagctgggaagtccaagatcaagscaccagcagattaggtgtctggtgagggcccatttcctggttcatagacggtaccttgttgtgtcttcacatggtaggagggtcaagatagctctctcgggcttcttttatatgggtaccaatcttgttcatgaaggctctgccaaaggtaagatttagcaaagtggagaatagatgatattgctggatgcctgcaaggcagagtgaaagagaagcagaaagttacataatatattcatagatcatgtgcatcagctctctgacaccaggggtccttattttacaactctgagtcctgca

SEQ ID NO: 169304 - DNA, 601 bp, Human
tttctcctgctcatatttctgtctggaatatccagctttttgtattgacctgttgaaattccacatgaatgttccaaaatatagtgacttaaaaccacagtttattatttctcacaatttggtgtgttggctgggttcagctgagtggttttctgttccatgtggtggtgtctgctagcatcactaatacagcagatgttttcagtttcagaacttggctggactagaatgcccaagaaagctttactctcatgtttcctgttggctgtgcactagagttccttagttttcctccataatrtctcatttcccctggtatctagaccagccaccttacagcatggtggctgggttccaagtgtgagaataaggaagcttttacttcattttccttttccttttttttttttttttttgagacggagtcttgctctgttgcccaggctggagtgcagtggcacaatcttggctcactgcaacctctgcctcctgggttcaagcgattctccttcctcagcctccctagtagctgagattacaggtgcacaccaccacaccggctaaattctgtatttttagtagagatggggtttcaccatgt

SEQ ID NO: 169305 - DNA, 601 bp, Human
aatttggtgtgttggctgggttcagctgagtggttttctgttccatgtggtggtgtctgctagcatcactaatacagcagatgttttcagtttcagaacttggctggactagaatgcccaagaaagctttactctcatgtttcctgttggctgtgcactagagttccttagttttcctccataatatctcatttcccctggtatctagaccagccaccttacagcatggtggctgggttccaagtgtgagaataaggaagcttttacttcattttccttttccttttttttttttttttttgagacggagtcttgctctgttgcccaggctggagtgcagtggcacaatcttggctcactgcaacctctgcctcctgggttcaagcgattctccttcctcagcctccctagtagctgagattacaggtgcacaccaccacaccggctaaattctgtatttttagtagagatggggtttcaccatgttggccaggctggtctcgaactcttgacctcaggtgatccacccaccttggcctcccaaagggctgggattacaggcgtgaaccaccatgcctggccagcttctatttctcttgaa

SEQ ID NO: 169306 - DNA, 601 bp, Human
cctgttggctgtgcactagagttccttagttttcctccataatatctcatttcccctggtatctagaccagccaccttacagcatggtggctgggttccaagtgtgagaataaggaagcttttacttcattttccttttccttttttttttttttttttgagacggagtcttgctctgttgcccaggctggagtgcagtggcacaatcttggctcactgcaacctctgcctcctgggttcaagcgattctccttcctcagcctccctagtagctgagattacaggtgcacaccaccacacyggctaaattctgtatttttagtagagatggggtttcaccatgttggccaggctggtctcgaactcttgacctcaggtgatccacccaccttggcctcccaaagggctgggattacaggcgtgaaccaccatgcctggccagcttctatttctcttgaagcctagatctagaactggcacatcagtttcatcacatcctattggtcaaaatgagtcacaaggccagcccaaattcaaagggaggggaagtaaatgccccttcttgatgggatagttgggatgcgcagacagggataggaag

SEQ ID NO: 169307 - DNA, 601 bp, Human
tacctgaaattgtcctgcttagttatatgctagtttattgtctttcacttattgctagtgtcagccttttgcaagcaaggacagcatttacatatcttttttacagctcatccgtattcctagtgtgttgtcatacacagtaggtccttgacaagtactcgtaaagtcaataaatgaaaggcaggaatatttattttgaacaggccagaaaaaacattagtaacattaaattaaagcttgcgaaagttgaatggattgtaaaagattgtttagttgttcaaaatgggttttggatttttgrtccagaagcattctgttccaggacactgaaagaacccagggataattcattgttaatttttatttttatggaattttgaagagtgagaaattgttggaattatgaagacaggtaaatgacattctgattttcgagagtgaggaatgtgggcttaaaaactgtagactaggagctttatgctacttgtgggcagaattctagaatgggttattaaaaggatgatttgtgaatgcttaggacagtgttgtttagtgggaaagtggagcacccttagagaaaagaggcctggagaaatgaatt

SEQ ID NO: 169308 - DNA, 601 bp, Human
ttgtattgttattgtttatttaaaaaatattttcaattcaaggttggctgaatctgcatatacagaacctggggatacagagggctgactatatcatacacattagatttcaaagacttagtatgaaaaaataatgtaaatatctcatgatttattttgaatatctgttgaaatgatatttttgatatattgggttacataaaatatattaaaattaatttcatctggcttttcctttttaaaacgtggctactagacaatttaaaattatatatgtgactggcattcattagaacttgayacctctctcaggaggaaaggtggaaggaactggtggatatcactgtgcagatgaggtgatatgacagctgccttcagctctttggatggctctcattcgtaaaagagattctttctgttctgtgtttctcaaaaggtcgaacgaagacatagaaaaagcaagttaatgtaagatagacccttctaaaatagttgtccaaagaaaatataggctccttctagagataatgaattccttgtcactatacataattcaagaagaggctaaatagctgcttaatgaggttgtttagagggagat

SEQ ID NO: 169309 - DNA, 601 bp, Human
acgcctctctctatctctgataacctttcttgctctgtagtttgctatgtctgaaattactgtagctactcccacttgcttttgattattgttagtgtggtatagctttctccaaccatttaaatctacatatgtctttatatttaaagtggactttttgtagaccacatatgattgggttttgttttttgatctaccttgacaattcctgtttttcaattagtgtgtttagaccattggcatttgaggtgattgttagttgggtatatagttggatacctaccatatttgttattgtgtyttatttgttgcccttgttttttgtttctatttttatcttccacacttttttgccttttatggtttattatttagtattaaatcattttacattattccattttctcttttgtaacatataaagtatacttgtttttaaaaattatttgtagaaatgaagtctcaactgtgttgcccaggcaggtctcaaactcatgggctcaaacagtcttcccatcttggcctcccaaagtgctgggattaacagatgtgagccaccatgctcctttttttgtttttttaaacttttttaaagtggttt

SEQ ID NO: 169310 - DNA, 601 bp, Human
gaaatgaagtctcaactgtgttgcccaggcaggtctcaaactcatgggctcaaacagtcttcccatcttggcctcccaaagtgctgggattaacagatgtgagccaccatgctcctttttttgtttttttaaacttttttaaagtggtttccctagaagtttgctgtatatatttacaactcatccaagaccaatttcaaataactctgtactaatacatgggcagtgtatttcattataataatgaaatattcctaatttctccctcctgtcttatgctgtcattcatttcacttatacrttagtgtatataactatatgtgtatgcacatacacaaacacacacacatatatatatacacacacagccctccatatatgtgggctttgcctccatggagtcaaccaactgtggatcagaatatttgaaaaataagggataattgcatctgtactgcacatgtacagatgtttttctcttgtcattattttctaaacaatacagtataacaactatttgcatagtattaggtattataagtaatctagagatgatttaaagtacataagatgatgtatgtagattaaaagcaaataatgc

SEQ ID NO: 169311 - DNA, 601 bp, Human
ataaggcacattggatataattgttactgttttgtattttttagcatagttttagatgttttattttgctacaaaggaattttgagcagaagattgtgacatatatctgtaaagaacagacttattattattattattatcattattattattattttgagatggagtctcgctctgttgcccaggctggagtgcagtggcgcgatctcggctcactgcaagctccgcctcccgggttcacgccattctcctgcctcagcctcgcaagtagctgggacttcaggcacccgccaccacgctyggctaattttttgtatttttagtagaggcggggtttcatcgtgttagccaggatggtctcgatctcctgacctcgtgattcgcctgccttggcctcccaaagtgctgggattacaggcgtgagccaccacgcccggcccagacttattattttttatgttcatccccctgttaattatctttcactcacaatattccctttgcttttcctttttaccagtggtccagtatgggtatcagtggaacaatatatgtcttaagaataaagcaattttaaaccaccatgactagtagcagtgtt

SEQ ID NO: 169312 - DNA, 601 bp, Human
ccagctaatttttgtattttgattagagatggagtttcaccatatgggccaggctggcctcgaactcctgacctcaggtgatccacctgccttggcctcccaaagtgctgggattataggcataagccccagcacctggccaatagtttagttttttaatgactccctcaactttgttaggtctgtttatttgagagcatgtatttatttggggccataaatgtatttttacatttacctattttatttatctcaggtcttgctttttacattagagaaggaagctttactagtactctasttggaggggtacatctctttatcaggaaaggatcttattcagatatatacatacatacattgtatttatttataaatacaataataacactgaagtataaagaaccacaatttattacttttttcctcattttttttttctgctgtggagcttaccagctagaattctggttttggtagcaggaaagaacaagtggcaactttgtgaattgtggcatttgagattagacggatatacaagatggtgtactacagcactctaacagaagggaatagcactgttgtcaaagacattggaagg

SEQ ID NO: 169313 - DNA, 601 bp, Human
ccaatagtttagttttttaatgactccctcaactttgttaggtctgtttatttgagagcatgtatttatttggggccataaatgtatttttacatttacctattttatttatctcaggtcttgctttttacattagagaaggaagctttactagtactctacttggaggggtacatctctttatcaggaaaggatcttattcagatatatacatacatacattgtatttatttataaatacaataataacactgaagtataaagaaccacaatttattacttttttcctcatttttttttkctgctgtggagcttaccagctagaattctggttttggtagcaggaaagaacaagtggcaactttgtgaattgtggcatttgagattagacggatatacaagatggtgtactacagcactctaacagaagggaatagcactgttgtcaaagacattggaaggtctcttgtaactgaaagagccctctttggcatttggccgtctcagtttcacgataacaagacgaagcaggaaccttgaaattgctcctctttgtattccattcctggataattaccatctatactcagatttcgaaagg

SEQ ID NO: 169314 - DNA, 601 bp, Human
aagtataaagaaccacaatttattacttttttcctcattttttttttctgctgtggagcttaccagctagaattctggttttggtagcaggaaagaacaagtggcaactttgtgaattgtggcatttgagattagacggatatacaagatggtgtactacagcactctaacagaagggaatagcactgttgtcaaagacattggaaggtctcttgtaactgaaagagccctctttggcatttggccgtctcagtttcacgataacaagacgaagcaggaaccttgaaattgctcctctttrtattccattcctggataattaccatctatactcagatttcgaaaggtccttttattttatgattgcatctttcagcaacaactattattatcctattatgcaatttgccttatttatgatgctcaggtgggaaaacgttcagactccacaattgaaaagatcgccctgattgagcattttgtggtgcttttgcttgttttgctgttgaacaaacaagagttcaagacaggtgaattttttccagatgtgcatttgaataattggacagatccctgtggtctcttcagtaataacacaagt

SEQ ID NO: 169315 - DNA, 601 bp, Human
tagaattctggttttggtagcaggaaagaacaagtggcaactttgtgaattgtggcatttgagattagacggatatacaagatggtgtactacagcactctaacagaagggaatagcactgttgtcaaagacattggaaggtctcttgtaactgaaagagccctctttggcatttggccgtctcagtttcacgataacaagacgaagcaggaaccttgaaattgctcctctttgtattccattcctggataattaccatctatactcagatttcgaaaggtccttttattttatgattgcrtctttcagcaacaactattattatcctattatgcaatttgccttatttatgatgctcaggtgggaaaacgttcagactccacaattgaaaagatcgccctgattgagcattttgtggtgcttttgcttgttttgctgttgaacaaacaagagttcaagacaggtgaattttttccagatgtgcatttgaataattggacagatccctgtggtctcttcagtaataacacaagtgactgcttattgtcgccttcttcctccatgcctggcttcctgtggtcactctgcaaagggctctgta

SEQ ID NO: 169316 - DNA, 601 bp, Human
agatgtgcatttgaataattggacagatccctgtggtctcttcagtaataacacaagtgactgcttattgtcgccttcttcctccatgcctggcttcctgtggtcactctgcaaagggctctgtagttgcaagatgactccacagttaatattgagctcatgaggagtaaatagttcatccaagctgggaatctctgagcttcattaggtctgcttatttgggtaccagaacctgtcactatccaggagacacacagcagatcagctttcacttgctttgttaccattttaggcatgaaayagaacgattttctcccagaacatgatgtccctgtgaagtaataagtgatagcactttatgggctttaaggaatctagagccaggccagttagcaactgaagctgtagtaactcagctggacactgatgtccttttcctgaagttatatgagcagaggcatgtaagggaaatgtggctcggtgacccacagtgctcagtgcccagttcagtgacaggcagccaggagagctgagccatggagaggccagcaagccaaagggatttgctgccatgctgtgacatggaaggcagggtgcactc

SEQ ID NO: 169317 - DNA, 601 bp, Human
cttcagtaataacacaagtgactgcttattgtcgccttcttcctccatgcctggcttcctgtggtcactctgcaaagggctctgtagttgcaagatgactccacagttaatattgagctcatgaggagtaaatagttcatccaagctgggaatctctgagcttcattaggtctgcttatttgggtaccagaacctgtcactatccaggagacacacagcagatcagctttcacttgctttgttaccattttaggcatgaaatagaacgattttctcccagaacatgatgtccctgtgaagyaataagtgatagcactttatgggctttaaggaatctagagccaggccagttagcaactgaagctgtagtaactcagctggacactgatgtccttttcctgaagttatatgagcagaggcatgtaagggaaatgtggctcggtgacccacagtgctcagtgcccagttcagtgacaggcagccaggagagctgagccatggagaggccagcaagccaaagggatttgctgccatgctgtgacatggaaggcagggtgcactcagcactgtattgatgacgttcttaagtctgaaggactta

SEQ ID NO: 169318 - DNA, 601 bp, Human
cacgtttggctcctttcttccacaaggcattctacccttccacggaaacaattatagcagcatggaaacaattacagcagctatctataattgataatcagaactaatgaaatatggtagcacaggcatgaatagagttgaaattatcagagtgattataaaatacataggaataaacttaacagaaattgggcaagacctttatgaagaactcttccaaacttaactaaggcacataaaagaacacttgaataaatagagaaacatgttcattggtgaaacgagtcaatgtagtaaataygtcaatatcactttttgtccatattaacctaaaatttaatacagttccagcataagctgtaatgttatttttattctatgaaatttgataaaatacggtaaagttcagaaaaacattgcctgagactagtgaagaatgaaaaagaggggaaaattttatctcatcaagtattaaaacataaaatatagtaaatataaacaaaatggtagacaaactaagaaattggaagccagtataatctggataccaaaacttgacaaaggcactacaagaaaaagttatagccttaagcatagatgc

SEQ ID NO: 169319 - DNA, 601 bp, Human
atcagaactaatgaaatatggtagcacaggcatgaatagagttgaaattatcagagtgattataaaatacataggaataaacttaacagaaattgggcaagacctttatgaagaactcttccaaacttaactaaggcacataaaagaacacttgaataaatagagaaacatgttcattggtgaaacgagtcaatgtagtaaatacgtcaatatcactttttgtccatattaacctaaaatttaatacagttccagcataagctgtaatgttatttttattctatgaaatttgataaaatayggtaaagttcagaaaaacattgcctgagactagtgaagaatgaaaaagaggggaaaattttatctcatcaagtattaaaacataaaatatagtaaatataaacaaaatggtagacaaactaagaaattggaagccagtataatctggataccaaaacttgacaaaggcactacaagaaaaagttatagccttaagcatagatgcaaaaatcatcaacaatatattaacaaatggaatccagcaaaacagaaaaaggataatatatcattaccaaatgggatttatcctggaaatacaagg

SEQ ID NO: 169320 - DNA, 601 bp, Human
ggcaatatgtattgaaagctacattctttgatacagtctttctacttctaagaatttgtctgaaaggactaatttgataagtgcttatatgtaaacagtgttcatttcagtattgtttataaaagcaaaatgttgaaagaaacttgtccatcagtgaaagatgggttaaatgagttatgagagaattgaagatgtagagctatatttattatttaaacattgaccttcatttacttttttttttttttttttaatggagctttgccctgtcactctggctggagtgcagtggcacaatctyggctcactgcaacctccacctcccgggttcaagctattctcccacctcagcctcccaagtagctggaattacaggcacatgccaccacatctggctaatttttatatttttagtagagacggggtttcaccatgttggccaggctggtctccaactcctgacctctcaactgatctgcctgccttggcctcccaaagtgctgggattataggtgtgagccactgcacccggctgaccctcatttgctattggatggaaaaataaaataaaacaaagcatgttgcaaaacagttttgtggt

SEQ ID NO: 169321 - DNA, 601 bp, Human
gagtatgtaggtacttcctgtacttatattttactttttgaaagttggcacaggcatgtgctcacacatacattatttcccacatgttagtccaagaattgccaggcttctatttcaatgactgtgtttaaagtaatagtttgccagcgacttggtttacatatccaatcagtgtgaaagttatgtatccttctccatagatacaaggaagtcctctttgcccaatcagtagatcaagaaggcgaacaccttcttaattacaaatgaggttttaaaaagttggcttaacaaatatagctaygtttgcttaacaaatatagccatatagcttaacgagtatagctaaggagacctacctgaggattcttctggtttagaaaagaattatttctgatagggagacaatcatgttgggtgtattttaaaatgcttgatataatcttcaaaatttattatgaaacagtgaaatctggccgagtgtggtggctcacgcctgtaatcccagcactttgggaggctgaggcaggcagatcacctgaggtcgggagttcgagaccagattgaccaacatggagaaactccatctctactaaaaatataa

SEQ ID NO: 169322 - DNA, 601 bp, Human
ctggccgagtgtggtggctcacgcctgtaatcccagcactttgggaggctgaggcaggcagatcacctgaggtcgggagttcgagaccagattgaccaacatggagaaactccatctctactaaaaatataaaattagccaggcatggtgatgggtgcctgtaatcccagctacttgggaggctgaggcaggagaatcgcttgaacgcaggaggtggaggttgcggtgagccgagatggcaccattgcactccagcctgggcgacaagagtgaaattccgtctcaagaaaaaaaaaaaaaagaaagaaagaaacagtgaaatctagtattttatatgacatgagcaatttgcacagtgactttgaacattatcctgaccatcaaagaacattatttaataagaattgtggactaagtaactttagtgtgcattttcagtgtctctaaagatttgggcgcagagttatgagctccatttggttgaactggtagttttagaaacagatttttaaattacttaccaaatgtaaaaggaaaacacttgtattgaaaacactggttgcagatcgttctaaaggccatttgggacaacagaacaagg

SEQ ID NO: 169323 - DNA, 601 bp, Human
gctacttgggaggctgaggcaggagaatcgcttgaacgcaggaggtggaggttgcggtgagccgagatggcaccattgcactccagcctgggcgacaagagtgaaattccgtctcaagaaaaaaaaaaaaaagaaagaaagaaacagtgaaatctagtattttatatgacatgagcaatttgcacagtgactttgaacattatcctgaccatcaaagaacattatttaataagaattgtggactaagtaactttagtgtgcattttcagtgtctctaaagatttgggcgcagagttatgarctccatttggttgaactggtagttttagaaacagatttttaaattacttaccaaatgtaaaaggaaaacacttgtattgaaaacactggttgcagatcgttctaaaggccatttgggacaacagaacaaggcaacatctcagagaaaatggttagtaatgggctcttagagatggtgtcttaatgcagtagttattttgaattatctttaaaatggttttttgaccctgttcttctgttttgacattctcctttgaaggcatacaagttatactgatgatatttgaatagtggaactctt

SEQ ID NO: 169324 - DNA, 601 bp, Human
agaggattaaatgacataatttttgtaaagagcataactgcctggcagattaaatgttcagtaagtggttgctcttttttcataagtagtccaatttcttttagaagattttcataataatatgtagtgtaatggaaagaatgcacactgtcttgtctaatagacccagatttgaacactggttctgcccttaacaacctcctaaccttgggcaaatcattctgctctgtgcctcaattttcttccccaagaaatggagtcataatgctgacctttttaggggttgtaaggatttgaagtratataggctaagtgtcaaactctatgcctggaggaaagtcagtattcaatgaatggttactatcattattgttataaagctaataaatatcaaagaacatgttaaggcttttaatatttttcctcttctcttttttatctttagttgtaattctttaagaaattgggtacacatagctaagactgtgcagtataagaaaagtgttaataagttatataaaaatgtattctaatactacatttggtaaacaaagaataagaatctgtaggtagggattatatgagtggagaaggatgtgta

SEQ ID NO: 169325 - DNA, 601 bp, Human
gctcttttttcataagtagtccaatttcttttagaagattttcataataatatgtagtgtaatggaaagaatgcacactgtcttgtctaatagacccagatttgaacactggttctgcccttaacaacctcctaaccttgggcaaatcattctgctctgtgcctcaattttcttccccaagaaatggagtcataatgctgacctttttaggggttgtaaggatttgaagtgatataggctaagtgtcaaactctatgcctggaggaaagtcagtattcaatgaatggttactatcattatkgttataaagctaataaatatcaaagaacatgttaaggcttttaatatttttcctcttctcttttttatctttagttgtaattctttaagaaattgggtacacatagctaagactgtgcagtataagaaaagtgttaataagttatataaaaatgtattctaatactacatttggtaaacaaagaataagaatctgtaggtagggattatatgagtggagaaggatgtgtacttagggcttggctttggggtgcgtgtcagagactagtgtatgaggaagaagaagcaggaaaaggcagtg

SEQ ID NO: 169326 - DNA, 601 bp, Human
ccttctgagaagctgttactacaggcatgcgctaccacaccctgctaaatttttatattttttgaggagacagggttttgccatgttgcccaggctggtctcaaactcctgggctcaggccatctgtctacctcagcctcccaaggtgctcggattacaggcgtgagccacctgcctggcctgtccatccttttttcccttcctccctccttcccttcctttctttttttcccttcttgtcttcctccctcactttcttttatccagccatccgtctgttcatcagtccatccatctgtcyatccatcccatccatccgtccatccatccatccatccgtccatccatcttctaggtcctaggtatagtagtaaaatagtcaaagtcccttccctcaaggagcttacattttagagattcaaagcattttcaaatgtattatttcatttgctttttaaaacaagtatgtgaattttgaattttttagtattttcatttgctagatgaggaaacaaaaatattttgagattaaatgacttacttgggataataatgctatgaataaaacccattattttttatttagaactcttttatctat

SEQ ID NO: 169327 - DNA, 601 bp, Human
tatgtgatacaaaatatgcaaggcactggagatacaaatacaattatttcctcaaggaactttgagttgagcaaacatggtactgtctggtgagaccagacatatgagcaaacatagtacttctctggtgagaccacatagagaaatgtacaaggggtagaggaggcagtgatgactactggtctgggatagttgagggaaggtggcataggctgcctattgaagaataaattagagtttgctatgtgaacaaggttgcagagggaatagtatatggaaaaacagggagatgtggacccawatattttgtgcagagatgtccaagtacttagatattactatattgcaagtatgaagaaagctttttttgagatctgacaatgccaaggtaggttatggactctctttggagtccccaaaataaaaataaaacattcacatctgctaaagatagcttgaatggtatttttgctaaaggcagagtcatatactgtatgtgccagataaaagtcaatgtctattatgtaaacattgagattacattaattaatttaaaagaaaggattcaaacttagtactaatctgcatctggagaactaat

SEQ ID NO: 169328 - DNA, 601 bp, Human
tgcaagtatgaagaaagctttttttgagatctgacaatgccaaggtaggttatggactctctttggagtccccaaaataaaaataaaacattcacatctgctaaagatagcttgaatggtatttttgctaaaggcagagtcatatactgtatgtgccagataaaagtcaatgtctattatgtaaacattgagattacattaattaatttaaaagaaaggattcaaacttagtactaatctgcatctggagaactaatctggtatgtgttattttcaagtcacccaactaaagcagtctgtkgtatggaactctgctccctcttagtcaaacaaatgcaaccataaaaagcagtgcaaattcagtgtcaccttttctccatgggattgggtggtttcttttggagcagagagagtttccagagaatcaatatagtagccagaagaaaagtggagggtggccttaccttgtccactccgtgctgcctgagggtgaaatggaacctcggatgttgtacacctttaaattgtccatgttgcctgtttcatagccttcccgggccagggagctgtgtagtcagtttatagttctaagaaccagagc

SEQ ID NO: 169329 - DNA, 601 bp, Human
gggtcagaagcttggcacaggatggctctcctggcttctgtgcccagggccttcacaaggctgaagtaaagggagcagcaggcctggacttgtacctgtaggccttccaggggagaatccacttccaggctcactggcagaatttagttccatgtggtagttgtactgggggcccagttgcctttcttggagagcactaactgctggctgttaccaagggtcttctagaggttgcccatctacatcttcaaaggcagccacagtgtgcagaatttgctttagatttccctgccttcccctmatgtgtttctcttctacttttaaagggcatgtgattacagtggcccaactggataatccaggctaatctcgctagtcaacttattagtaaccttaatcacacttgcagtgtcccttcatagcagtacctagttaagtgcatgattgaataactgggtaatgggacttctcgggagagatctttgacattctgcttaccatacccctctgggtaccactttgttgtgatggtaacctcataagcagccatttaaaagagattttaagcatcttaattttgaaaattttgcaaggtaaaatt

SEQ ID NO: 169330 - DNA, 601 bp, Human
attctaatattccaatatgctcctcagcacacagagtggtccaagaagattggccattctttccggaagttggacttccctgaagattatgtgggaatgggacgtggaacctgataattttttttgcagaatgaaaacttttatcatgaagaatttttctttattgcatacttttatacagttaggccccaacccgggaattagtggtattccaaaagttcctttttaagttgcttgtttgaaattaagaatgtatttccctccaaaaatgatgttggctacaatctaatttcagacttgsgatgaacccaaggttcaaagaggttaaatctgaataaatacagttctacaattctgtattcaaagccattgagaccagattttgctgaatttggatttttttttttttttgaagaaggaaagaaggataatattgtgcatgtaccagtcatatagcagtgtggtctggagcaggatcctataatcaagcacattaatatttctgcagtgaaactgatgaatattcacacgcagtggataaataaaaactataaatagcctcatgtcagttcaggtcaggtttgtcaccaaatgaattcag

SEQ ID NO: 169331 - DNA, 601 bp, Human
ctgataattttttttgcagaatgaaaacttttatcatgaagaatttttctttattgcatacttttatacagttaggccccaacccgggaattagtggtattccaaaagttcctttttaagttgcttgtttgaaattaagaatgtatttccctccaaaaatgatgttggctacaatctaatttcagacttgcgatgaacccaaggttcaaagaggttaaatctgaataaatacagttctacaattctgtattcaaagccattgagaccagattttgctgaatttggatttttttttttttttgaagaaggaaagaaggataatattgtgcatgtaccagtcatatagcagtgtggtctggagcaggatcctataatcaagcacattaatatttctgcagtgaaactgatgaatattcacacgcagtggataaataaaaactataaatagcctcatgtcagttcaggtcaggtttgtcaccaaatgaattcaggccaaatgagttcaggtcaggtcaggttttgctgccaaatgaattataaaaaaaaaagaatggttttcaccacttttggggtttcagattagtggatctttattacactt

SEQ ID NO: 169332 - DNA, 601 bp, Human
gacctcgtgatctgcctgccttggccttccaaggtgctaggattacaggcgtgagccaccactcctggcctaatttttccttcccttttaatgctagggcaaggagcatggcagtggtgtcaggtggccttacacttccctcttctcccactctttccttcagactacctgtaaagacactggagggtgctgaaataacaccgcttttaaaggtagttagaccacagtctcagtcttggctctgccctctggctgtgggaccttaagtggtttgctcagcttgtaaagtggagaaaaaaawatatatatatatgaaatactttatgtaatattatatatcatatggtaagtatacgtttatataaattggagctatgcatatatctttgagtggcatcccagaatggtagagaagattcagtgcagtgttaggtgatagtccctaccacagaatgcgagttcagtagatggtaatatccttcatcattgtttgttgtcccctctcgcaccttccagaaatcctttccttgtctccctgaactctggctgagaagcagggagccacagtgcagctgtgaaggggaggaaacaggcttcttct

SEQ ID NO: 169333 - DNA, 601 bp, Human
agaaaaaaatatatatatatatgaaatactttatgtaatattatatatcatatggtaagtatacgtttatataaattggagctatgcatatatctttgagtggcatcccagaatggtagagaagattcagtgcagtgttaggtgatagtccctaccacagaatgcgagttcagtagatggtaatatccttcatcattgtttgttgtcccctctcgcaccttccagaaatcctttccttgtctccctgaactctggctgagaagcagggagccacagtgcagctgtgaaggggaggaaacargcttcttctttttttggttttgttttattttatttgagatggagtttcactcttgttgcccaggctggagcgcaatggtgcaatctcagctcacggcaacctccgcctcctgggttcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggca

SEQ ID NO: 169334 - DNA, 601 bp, Human
ttcagtgcagtgttaggtgatagtccctaccacagaatgcgagttcagtagatggtaatatccttcatcattgtttgttgtcccctctcgcaccttccagaaatcctttccttgtctccctgaactctggctgagaagcagggagccacagtgcagctgtgaaggggaggaaacaggcttcttctttttttggttttgttttattttatttgagatggagtttcactcttgttgcccaggctggagcgcaatggtgcaatctcagctcacggcaacctccgcctcctgggttcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggcatgacccactgcgcccagccaggaacaagattcttaagcgttgagtatggcaaggcatactggggaagtgatctgcaaaagcatgaaagccccaaagtgtgggtgtttgtatctggtctgactgag

SEQ ID NO: 169335 - DNA, 601 bp, Human
tgcaatctcagctcacggcaacctccgcctcctgggttcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggcatgacccactgcgcccagccaggaacaagattcttaagcgttgagtatggcaaggcatactggggaagtgatctgcaaaagcatgaaagccccaaagtgtgggtgtttgtatctggtctgactgagggatccagtcccccttcgggacctgcttttggctttggtaaatcctaagacttagaggtttctggaagaaagactaatctgcagtctcttctgggagttgattggaaacaggtatctttggggcttacccagagctgttcacagatgtgagggctgatagtgccttgccttatcccatggccagggcctagcaggagtagcagtaagccctccaagaagccactagaaattgcacagctattctaggattgaca

SEQ ID NO: 169336 - DNA, 601 bp, Human
tcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggcatgacccactgcgcccagccaggaacaagattcttaagcgttgagtatggcaaggcatactggggaagtgatctgcaaaagcatgaaagccccaaagtgtgggtgtttgtatctggyctgactgagggatccagtcccccttcgggacctgcttttggctttggtaaatcctaagacttagaggtttctggaagaaagactaatctgcagtctcttctgggagttgattggaaacaggtatctttggggcttacccagagctgttcacagatgtgagggctgatagtgccttgccttatcccatggccagggcctagcaggagtagcagtaagccctccaagaagccactagaaattgcacagctattctaggattgacatgggccctggctggtggtactatagctcttcatatta

SEQ ID NO: 169337 - DNA, 601 bp, Human
gccaagatggggaggagcttggtgtgttctgggacctgccagaaagtcatattgttggagcttcatgagcaaaggggagaggatccaggattgagccagaccttgctgagccttataagtcctggacaggagaatggattttattcaaacaagaagcccctgaaggtttttaggacagggacatagtttgcacagaagagtccactttgcctctctagtggatgtcatgctatattaaaaactggcagagtgctgggcttcttcagtgatactccagcctttcccttgtttttaactcacwtataaataattttaagtcacttttcctctttattttttaggttttctcttcaaatccaattaactatcatcattaattaaagaatatgtgagcagtcatgtctgtagtattgagcaattctcctgttatctgttttttgctttctattatgggttttatctatttatctcccaacacgcccatcatttgctgccagcactggcatgctttctcttttaagcttttctcttttcctccctgtttcagatttgtgatagactctttttgtgtttgtccatttatttcaagtccgttaggggc

SEQ ID NO: 169338 - DNA, 601 bp, Human
ttgcaatagaagcctaataaaggaagaatgtagaagtgtgcaatgtagaaaggaacttcgggcatataaatctgactccagaacctcagatccagcctctattctggctttttagtaggcgagttcttcaagggagagggaagtgtggttatcatggacaactgaatcggggctttattcacactaggagaaatgacccggaacttggtaataagatgaaagaatgatctttcagagtcgtagtagagcgttgtctaacaagacctaaggctcatctgattctgtagaggatgtgacttcrttttagatgttaacttagagaaaactgatatgatgcaaataatttctggcaggtagaaaagataactctaaaggttttgttttattgtcctatagaatattcacatactacataaaaaaataacaaaaaatacatacaaaaaattctaaattacatacaaaaaaacctacattttgtatgtaatttagaatcttattccagtatttttttttctaaaaccgactatatgtatcaatttcttagccaatttactgttttcattaatgaggtatatgtgtctttgccatgctcactatatat

SEQ ID NO: 169339 - DNA, 601 bp, Human
ctctttcttgtattgtggaaaaaataaaaactgtaaacttgagagacattccacaaatacaaatcttgcttcttttgcttaaaaaaattatgaacataattatagaaaaaagtagattctggttgtttaccataaagaattactactagaccaatagcaaaggaagttacaaagcacagatcacaaaaatctctccaatcacgtcaggaagttcagccctggatggtgtttgtttacctacagtgagggcagtctgtcaccagctgatgccctgttgagagcctcttgatctaaacaggargttcagtcaatcactattaactgaaacctacattaatatgtattattcctcattaaacactgttaagaaaatgaagattaatacatgctgtattttgaacagatgacacataaagacaaaaactaaggaagcaaaacatagtacctgttggtaaaaacttcccaatcactgcttaaacaaatcctagtactgacctcaatcagggttttaaatacttgactctaaatcctttatcttgggccaggcgtggtggctcatgcctgtaatcccagcactttggaaggcggaggcaggcggatc

SEQ ID NO: 169340 - DNA, 601 bp, Human
gaggaattttaatatgttgttttgtcaactactgaggctataggcccttttaggtcttcaggagaagtagaccagtaaaataaacactgtgtgtttaagctatgagagctcaggatccctgtggttagcagttatgaggcacttggacacatatttatactaagagttgtagcttttacttatcttgggtaaaagaaatactccaaacagttagaacaaaaaaatatatctgatggtaaaatggataatgtattagtccattttcatagtgctatgaagaaatactccagattgggtaatktataaagaaaaagagatttaatggactcacagttccacatggcagggggggcctcataatcatggcagaaggtgaaggaagagtgtattagtctgttttcatgctgctgataaagatatacctgaaactgggcaatttacaaaaggaagaggtttattggacttacagttttacatggctggggaggcctcacaatcacagtcgaaggtgaaaggcacatctcacatggtggcagacaagagaagagagcttgtgcagggaaactcccctttgtaaaaccatcagatcttgtgagactga

SEQ ID NO: 169341 - DNA, 601 bp, Human
gtcacgtcttacatggtggcaggcgagagagtgtgtgtaggtgaactaccctttatgaaaccatcagatcttgtgagacttattcacactatcaagagaatagcacaggaaaaacccacctccatgattcaattacctcccactgggtccctcccattacatgtgaggattataggagctaaaattcaagatgagacttgtgtgcggacacagccaaaccatatcattccacccctggcccctccaaatctcacgtcttcacatttcaaaaccaatcctgccttcccaacagtcccccaargtcttagctcatttcagtgttaacccaaaagtccacagtccaaagtctcatctgagacaaggcaagtcccttccgcttatgagcctgtaaaatcaaaagtaagttagttacttcctacatacaatggggtacaggcattcagtaaatacactcatcccaaatgggagaaattggcccaaacaaaggggctacaggctccatgcaagtttgaaatccagtagggcagtaattaaatcttaaagctctgaaataatctcctttgactccatgtctcacatccaggtcctgctggatgtaaga

SEQ ID NO: 169342 - DNA, 601 bp, Human
gtggtgggcttagaaggccacatgtcagcagagtcctgcatctcctctgcataggtttatatcaccttctaatttggaaaattttttaaatctctgttctagctttgtcatatgccctacatgacagtggaactaactaccctatgattttcacctcagccaggcttagtcttcaggttccaggtgttggttgtttaacagcatcacaaaacctagggctcccaacatatgaatacacaaacttacaaataagacaggcatttcagagcagaacatctggtgtttgtctgccccacaggcrtacctcctttaggtgtaattcattggaatcccagtcagccgatttaggagcctaagtgcattagctcatggccagtgcactgtagccacatactgtagtttcttcaggttgagtgatgcttattgatctgttagtttgctccgcagagcccctctctgccccaggtaacttactttctgatggtaatattttgatagaaagtaaataactttgtttcaataaaagaaaaagtagcatatgattattttaaagattaaggtacagattggatatttttggaaaatttgctgctttttaggc

SEQ ID NO: 169343 - DNA, 601 bp, Human
aggtttatatcaccttctaatttggaaaattttttaaatctctgttctagctttgtcatatgccctacatgacagtggaactaactaccctatgattttcacctcagccaggcttagtcttcaggttccaggtgttggttgtttaacagcatcacaaaacctagggctcccaacatatgaatacacaaacttacaaataagacaggcatttcagagcagaacatctggtgtttgtctgccccacaggcgtacctcctttaggtgtaattcattggaatcccagtcagccgatttaggagcytaagtgcattagctcatggccagtgcactgtagccacatactgtagtttcttcaggttgagtgatgcttattgatctgttagtttgctccgcagagcccctctctgccccaggtaacttactttctgatggtaatattttgatagaaagtaaataactttgtttcaataaaagaaaaagtagcatatgattattttaaagattaaggtacagattggatatttttggaaaatttgctgctttttaggcagatgaactgttaggtgggtgtgggccatgttctaagcccaactaaatccat

SEQ ID NO: 169344 - DNA, 601 bp, Human
attccccttactttgttgcactttttaaaaaagcactaataattatctaaaacactaaaaaatttatttatgttcattacttactgagtatttgccccttcatcctccaagtgagtggcacaggtcaggcatctttctcttttttgttcaccaatatatctgaaatgtgtgttacagtgcaaataataaatgttcaataaatacttgttagtgaatgttgggaatgactcaccataagttcagcgatattaagattagttaagccatgatccagtgaatatgtccatttttaggaaagcaycctcactaaaaggaataaaattttgttgtaagacttaggcccattactctggccctggtgaactggaccagaccacttgtaagccacacagggacctgccacaaagagagaggagataagacagagcctggatctctaaggtctagagcggagctggtttaagctgttttattccagggccttccttgttcactgctgcatcctcagcatccagaactgggcctgctgtgtagtagatgctcaataaatattttttgaatgaagaaaggcaaagtccttctaagcagtaggaagcctttc

SEQ ID NO: 169345 - DNA, 601 bp, Human
ggtagggaaaaaaaagtgcaggggagtgtcatcatctggtagatagtttaaaaaaattcctctggctttggagtaggaaaattgattgtagaggatccaggaggaatcagagaggctgttgaagaggctatggtagctgtccatgtgagggacaatggcttggacaagggtggcagtggtgcagatagaaaagggtggttggactcagcatacattggaagaagagggcacaggaccctgtgtcagatattttggtatattcctcctatcattagagtttagtcatgtgtattcacacccyacatttgtttcttctaagaaatgaagtctatccgttaaggaaatgtcagttaatcctcattgctgctgttatcatggttggatttgctccaaaaggtatgttaccatatatagaattaaaaccagtctctaccctgtggggaagtaatgcagatgttttgagattagagtttagaatctattccaaagatctgccagaacacatgtttaacaatgagcatgagagttttccccattgctattcttactatgttgtttatcaaacaaagataatttgggggcttgtgtagaaactccacaa

SEQ ID NO: 169346 - DNA, 601 bp, Human
ttaattttagatttggtagattttaatctgataccattttatattggtttatatctgaatgcttcattaagatcctgggtatacacagtttaacctcaagcatatagtcttattatattattttattataagaaacagaagtatggaaacttgaggctgggactgttcagagctaaatcttatgaaatgaaataagttcttgtaatcattttgcagccattatttgttgtgcttttgtggtattttgtctcttttgagctatcctcacaggtttccaggaattcaaggcctaagaaacatyctactaagaacttgaaataccaaggcatttaatttttggaagtgtagaatgttttattacttttgaagttttgaggaccagcaaaatagagaagtgtattgtgttacacaatttgctatgttataaatgtttacttttagtggacatgatgtaactagaatggaaaaaaacacagaaatagtaattgttgatataatcttgccttggaggtagcgatgggtgggggaatggggagtgggaacatagcatgagaggagaaaaaaatctgttaccaatttatggtaaaattattacagttaa

SEQ ID NO: 169347 - DNA, 601 bp, Human
tccagaaaaaaaagcaccaggaaatacaggaaaatatgtagctattaataaattccacagataggcagaagttgccaaaggaaaatgggagaacaacaaggactgttcattggacttccaggaatagaaattgttgggagtctactcttttcaaaataaactgacatggggctgaccaccttgtcagttactcccatctgatggtggggtgtggcaaacaagggcaaaggtattgtttggttttcaaggtcaggctgctaattgtataattggattaacccagcccgcagagacatggagrctaccagtcacttgttagcctgggtcccaaggtagaagcagcacaaaagtatggggaggatgttcagctgaaatggaaggaagaaagtaaagaggatagagaaaaaaatacagaaatgttagccaaaggagttataattaggagaaaaccattatcttattaatctctgtgtgattaattaattataaatgagttttctcttggaaaagagcgaagctacttagtatgacttgtggggagagtgtgtgtgaggagaagaaagtgtactttttctgcccaattatggaaggtcttaaacat

SEQ ID NO: 169348 - DNA, 601 bp, Human
actaccagtcacttgttagcctgggtcccaaggtagaagcagcacaaaagtatggggaggatgttcagctgaaatggaaggaagaaagtaaagaggatagagaaaaaaatacagaaatgttagccaaaggagttataattaggagaaaaccattatcttattaatctctgtgtgattaattaattataaatgagttttctcttggaaaagagcgaagctacttagtatgacttgtggggagagtgtgtgtgaggagaagaaagtgtactttttctgcccaattatggaaggtcttaaacaycagccatgtttttaggagtttgactaataaatccagaaggcttattatttattttatccaggcatgttttatttactatgagagatcttcttagttcttgcttttgttttgtaagaaaaatgagctaggttagcagtgtccgttttctgtttttagaaaataagatgtctgagatgttagaatcttcacatataatttgtcctaccccacagtcagcaatttcatatctactgctcacagtatgcccaatcagagcacagacaggtgtgtgatggtggcttctcagtaggaatttacatt

SEQ ID NO: 169349 - DNA, 601 bp, Human
ttcacagctcagtttcagggggctgcaagtcaagtcaatattttcttctttttttttttcatgtggataaactgcctccctcattttgagttttcgaatctgaaataatgagagtctaatgaataacaaatatatacctctttttcttcttttaattcttattagcattttggattcaagtctagaaattcctcttcatttttttttcttttttgtctaacatttcttttgaataaagagtattacctacttttaaatgcaaaaaatggaaaattgggaagacattgtcttcttgcttttygcagaggcaacatttttattagtgtgcatatgtgtaagtttggccccaggctgtgctcacaatccccaagcccctggcagaaggggactccagggtccccccatctcagggatgacatgtgggtcagtatagtgtcaggatggtgatgatccactggctctgaaaccacagaaatgttcatcagtgtctgctgccgcctacctgtggccttcttgttaaatgagagaaataaacccgatttcttttggttattctatcattcctgcagcccagaaacaaagagagggtatgactggttca

SEQ ID NO: 169350 - DNA, 601 bp, Human
tttggttattctatcattcctgcagcccagaaacaaagagagggtatgactggttcagggaattttattcagtctggtgggcagacagaatgtgaagagccagccagggtcccaagatgatgctggagccattagcacggcttacattttcaaaggtcttgtaaatcacattatggttttaggatgtttttcctgggcagttattttaatcaggggatcagacatgatcaacttttttttttttttttttttgcttaagaacgatcactctggctgctctgtgagcagtgaattggaagtracaagactaggggcagggagacctgtttggaggctatcgcactaaccctggtgagaggtggccatggcagagttgctggagggaagggggagaattctagaaatgtttagggatacaagagaacagggcttgatgtgggagatgagagagaaggaggactttagggtaacttcaacatttcttgtttgtgcagctggttggttggtggcgctttttggttgacaaagggtatacagaggatgatttcttagtcctcttattgatagattttaatacaataaagtcatctcgaagtttcag

SEQ ID NO: 169351 - DNA, 601 bp, Human
gggtaacttcaacatttcttgtttgtgcagctggttggttggtggcgctttttggttgacaaagggtatacagaggatgatttcttagtcctcttattgatagattttaatacaataaagtcatctcgaagtttcagatacatttcttcatgctctttctaggtttttctttcttttacatgtttcatgggtgggggagggtttaagagtctcaattgctctggaaattgaccttcctgctagggaagagatggtggtatccttatgacagttttcttccaaattgtggaacgctttgtgrtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctgtatcctctttatataaatgaaaggcatctatccagttttgaattatttggggaaaaaaatcccatggaggaatgaactcgagataattaaatttctccaattcagaaactctgaattttt

SEQ ID NO: 169352 - DNA, 601 bp, Human
tgtttcatgggtgggggagggtttaagagtctcaattgctctggaaattgaccttcctgctagggaagagatggtggtatccttatgacagttttcttccaaattgtggaacgctttgtggtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctktatcctctttatataaatgaaaggcatctatccagttttgaattatttggggaaaaaaatcccatggaggaatgaactcgagataattaaatttctccaattcagaaactctgaattttttttttttcttattaggaaagtggttgagatatggctgaatggaaatttaaaatcttgagcatggttatacatcagaaacgtaacatgtagtctaggtccattccagagagcaaaaaagactcaatatttttgacattattaatgaatagattgatgcatttgttatgcctgcagagaaac

SEQ ID NO: 169353 - DNA, 601 bp, Human
cttcctgctagggaagagatggtggtatccttatgacagttttcttccaaattgtggaacgctttgtggtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctgtatcctctttatataaatgaaaggcatctatccagttttgaattatttgggraaaaaaatcccatggaggaatgaactcgagataattaaatttctccaattcagaaactctgaattttttttttttcttattaggaaagtggttgagatatggctgaatggaaatttaaaatcttgagcatggttatacatcagaaacgtaacatgtagtctaggtccattccagagagcaaaaaagactcaatatttttgacattattaatgaatagattgatgcatttgttatgcctgcagagaaacattattttatcacgagttgcctgcagctcagagagtaaagggcttttggaag

SEQ ID NO: 169354 - DNA, 601 bp, Human
catgcattacaatggtatccacaatgcagctgtgtggggagaaggtaagcctctttattgagggtgagagggcatgaaccggctcctgggtgcgccctcctaggattgagttagagtttgcaatattaaaagcacaactccagtcacacctgtggatggtaacaagatgctagactgagcacgataggctatttctcatttttttttcctagtaaaatttatttgttctttgttctcatgtcttctgttagcattctttggaaaggcattagttagtgccacaggttttagaaaaaaactragggaaaaatactaaagctgagaatgttttattaagtttttttttttctgtgaattagtaaaagactgtcatgtatgattttagcagaataccttgatccagattgaggaactccaaccagtaatcctgggaggcataatttaagaaccgctaacagaagcattttgaaagtgattgaaattgacattccttaaaaaggtagtttattgccttctgaggaacatttgtttagctctttaaattattcatatttgaagggaaagcattctacaagaaatcttatttttgagatatagctgg

SEQ ID NO: 169355 - DNA, 601 bp, Human
aagatgtgttgattaaaggaatgaaactttcctatagggactctcaagagatagctggcctaacttagaatagaaatgtgtgtgccaaggactcgtggtttcaagaaacagatactcaagtgggtgtggacacatttccaggatgttctccctctcacatgtacccaaccagaccctcgggccttgtcctttctgtctggttctagggaaaaagcccattgcctgtgctttctaaaataataaatctcacattcacaaaggatctggtttctgcatgtttttctgcatgttccaagctccrgccatgtgcaagtgatattaacaaatttatttatgatttgttcgtatcctcctccttccagagattggttgaaatattaaactgttcatttctattcttcacttcctttaagccttaattggagccacttcttctattggataaacgccttccctggttggcctcgtttctctcaggtcccttgtttcactttgtgtttcctcagttgccagtaggctgtgctgtgatgctttgcatttatttggttatatcatgtatacatttattctgtgtcctctattagatactcttgtcgttttt

SEQ ID NO: 169356 - DNA, 601 bp, Human
caagagatagctggcctaacttagaatagaaatgtgtgtgccaaggactcgtggtttcaagaaacagatactcaagtgggtgtggacacatttccaggatgttctccctctcacatgtacccaaccagaccctcgggccttgtcctttctgtctggttctagggaaaaagcccattgcctgtgctttctaaaataataaatctcacattcacaaaggatctggtttctgcatgtttttctgcatgttccaagctccagccatgtgcaagtgatattaacaaatttatttatgatttgttcrtatcctcctccttccagagattggttgaaatattaaactgttcatttctattcttcacttcctttaagccttaattggagccacttcttctattggataaacgccttccctggttggcctcgtttctctcaggtcccttgtttcactttgtgtttcctcagttgccagtaggctgtgctgtgatgctttgcatttatttggttatatcatgtatacatttattctgtgtcctctattagatactcttgtcgttttttaagctaacattcattgaggtttattgtgtgtcaggtcctgtgt

SEQ ID NO: 169357 - DNA, 601 bp, Human
tatgcaggaaagattatgtggaattctagccagcaaatactcaagtcctcagtgttaaagttaaaataaaatgttttaggcagcaggtggtttttttttttttatgaatcctcactttcactagcttttgaaattaagcaattaacttctgatcctaaatgtgttagataagaatgcttctactctatatatctcaaaaaagaataacataatttgctaagcagcttttttcatgtaatatatcatgaacatgttttcaagccaataaatatagattaaaacattttctggcaatataacrtacatgcagaaaagtacacagatcctaagtgtacaactcagtttatgatcacaaagtgaacacatccatttactgccctctacttaggtcaagcaacaatattcccagtacccccagaagcctcccatggcctcctcctccccaccagagataatagctactttgaatctaacattataatgtttgttttggaactttacgtaaatgaaatgtctgtagtttttgatttttttacttactttactcaatatttgtttgtgagattcatccatgtttttcacatgtattatttgtttattc

SEQ ID NO: 169358 - DNA, 601 bp, Human
gcagcaggtggtttttttttttttatgaatcctcactttcactagcttttgaaattaagcaattaacttctgatcctaaatgtgttagataagaatgcttctactctatatatctcaaaaaagaataacataatttgctaagcagcttttttcatgtaatatatcatgaacatgttttcaagccaataaatatagattaaaacattttctggcaatataacgtacatgcagaaaagtacacagatcctaagtgtacaactcagtttatgatcacaaagtgaacacatccatttactgcccyctacttaggtcaagcaacaatattcccagtacccccagaagcctcccatggcctcctcctccccaccagagataatagctactttgaatctaacattataatgtttgttttggaactttacgtaaatgaaatgtctgtagtttttgatttttttacttactttactcaatatttgtttgtgagattcatccatgtttttcacatgtattatttgtttattcattctcattgcagtttattatttcatgtgaaagaagataccataatatttactcattctgttgtttttgttatatactt

SEQ ID NO: 169359 - DNA, 601 bp, Human
tttacttactttactcaatatttgtttgtgagattcatccatgtttttcacatgtattatttgtttattcattctcattgcagtttattatttcatgtgaaagaagataccataatatttactcattctgttgtttttgttatatactttatttatttttttttttggagacagggtcttactctgttgccaaagctggagtgcagtggcacaatctcagctcactgcaatcccacctcccaggttcaagtgatcctcccccaagttagccgcctgagtagctgggactacaggtatgcgycaccatgcctggctattatttttgcattttttgtagaggtggggtttctccacgttgcccaggctagtttcgaacttctgggctcaagtgatccactcgccccgccctcccaaaatgctgagattaaaggcatgagccaccactcttggcccaccattctattgttgatggccattggggttgtttccagttgcgggctattatgaaaaatgttgctatgaacattcttgtacatgtcttttggcatacgtgtgcagttttaaagttgttcatttgtttatatgccttaggaatggaatt

SEQ ID NO: 169360 - DNA, 601 bp, Human
cattctattgttgatggccattggggttgtttccagttgcgggctattatgaaaaatgttgctatgaacattcttgtacatgtcttttggcatacgtgtgcagttttaaagttgttcatttgtttatatgccttaggaatggaattggcaggtgataggatatgtgtatgttcagctttagggaatactgtgaaagtggttgcacaaatctacaatcccatcatcaatttatgtgagttactgttgttccttatctttggcaacacttggtttggtctgtcttaactggttttatccaaastggtaggcttgttatagtctcttgtgattttaatttgcattttcctgttggctaatgagcacattttcatatgtttattgaccatttggatgtcttttgggtgggcatgttgaagtatttgtttagtatttgtctcttgcctacttttccatagaactgtcagacattttctcatttatttgtacttatatattctagatgtaagttcctttgttggttatatgtgtcagcaatgtcttcttccactctgtggcttgcctttattgctctcttagtagggttaatggagcttcccaattt

SEQ ID NO: 169361 - DNA, 601 bp, Human
tattccccagtgagttctatcattttaaactctctcccagagttataataggttccactcttgtgaacctggagaataactcactgtattttccatttgaattttttaattactattgacagtgaactagttttcatctggccatttgtagttcttttgtgaatagccttttcatggcttttgctcagtgtttttatattttcctattacttaataattgctctttctataccacatataaccccttgtcacgtgtatttacaaaatatgtctgtgtgataaatgaattaaccagtatacktttgttactggagtggaactttacagaagagcacaaaaagaaaaccttgttaagcctgttggaaatgtgattattccctgaatgtttatgtcctttgcacatttaggaatatcatagcaataatgaacttagtagtagggacaatcagcaactaaatgaagtagaagacagataatataattgcatgggaagaacatagaaattagatccagaaaactgggttctagacatgacctcactgctctttacctccatgatcttgattaaaccatatattctctctgagtcttaatatcttca

SEQ ID NO: 169362 - DNA, 601 bp, Human
taggttccactcttgtgaacctggagaataactcactgtattttccatttgaattttttaattactattgacagtgaactagttttcatctggccatttgtagttcttttgtgaatagccttttcatggcttttgctcagtgtttttatattttcctattacttaataattgctctttctataccacatataaccccttgtcacgtgtatttacaaaatatgtctgtgtgataaatgaattaaccagtatacttttgttactggagtggaactttacagaagagcacaaaaagaaaaccttgttaagcctgttggaaatgtgattattccctgaatgtttatgtcctttgcacatttaggaatatcatagcaataatgaacttagtagtagggacaatcagcaactaaatgaagtagaagacagataatataattgcatgggaagaacatagaaattagatccagaaaactgggttctagacatgacctcactgctctttacctccatgatcttgattaaaccatatattctctctgagtcttaatatcttcatctgtatagtgggtgcacttatacttatttatcttccaggtctaagat

SEQ ID NO: 169363 - DNA, 601 bp, Human
ccttttatcttcctctgcaaagaaactctctcttctgacacctcatattggaagccggtcttcttatccccagaattaattaacatgcaaatacttgtctagagatatgggaacagtgctttttcaattagcatttaaatatcactcttaatgatgttagattgactcttttaagggaaaattaaaatagtatagtcatctctggattatttcctagagcatattattgatatttctgaagatatgggcttagtaggagcttttatcttctactgttcacagactgattgagtcagatccmgggttggactggacagcaaagcctggttctggccttcctttgcctctggtttcctagctaggcctgctgatcgtgccctgcactgcttctcagtagcaagtgtatttatgtaggagcggcacctgcaggaactgtttgcaactgggaagggtacccagaagcaaggagggaagtatagaggagctttggtagcaatcatctcccaaaaaataaagaagatgaactttggagttagagatgcataggttcaaatgttgcctgtgccactttgaagcagtatgatgttgagcaagttacttc

SEQ ID NO: 169364 - DNA, 601 bp, Human
tagaggagctttggtagcaatcatctcccaaaaaataaagaagatgaactttggagttagagatgcataggttcaaatgttgcctgtgccactttgaagcagtatgatgttgagcaagttacttcccttcactgagactcaatttcctcatctgtaaaatataaatagtaatatttaccagtcaggttgttaagagggttaaacatgacaatatatatgcaatatgtcttacgtaagtcagagtaggctctctgctgtaacaaagaactccagatctcagtggtttaacttaggttatgaygtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttcaccttctgccatgattgtgaagcctccccaccacatggaacggtaagtccattaaatgtcttttgtaaactgcccagtcttgggtatg

SEQ ID NO: 169365 - DNA, 601 bp, Human
atatatgcaatatgtcttacgtaagtcagagtaggctctctgctgtaacaaagaactccagatctcagtggtttaacttaggttatgatgtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttyaccttctgccatgattgtgaagcctccccaccacatggaacggtaagtccattaaatgtcttttgtaaactgcccagtcttgggtatgtctgtatcagcagtgtgaaacagactaatacaggttatttcctgctggaagaaagaggagggctttgcttcatgcagacattcagggacccagatatctttcatctagtggccttgtcattttctaaggccttggaaccctcattgaatcatctgtctctggctggcaggagacgggagagagtgaacatggattgtgcagaaggccaggct

SEQ ID NO: 169366 - DNA, 601 bp, Human
agggggatcgaatggaagttttatagttagtaagtggcagagcttggcttagtaccccaggcttgtctgacacctgtccttctcccatagcaccatagtgctttgctgagaatgtgggtaggagtcagaatcctatgatgctttccgtttggaggttagagtcagggttgccaggggtcgattatgaaacaggtgatgttcattttcagcatcattagctcctctttggtgtgtctcttctctccttggcattcattttctcacacccttcccagctgattcacagtagggtttcagaggratctaggacgtatttgtattattttaaaatatacattttaaattctaaagtatccttatagtaacaattcaagttgtacaaaaaggagataaaatgcaaagtgattttctctttctctaaaacctttaatcctcatctttaaaaaagtatcttttcagaaattttatatggacattcaggcacacacaatatatcctcttttatctgagagaacccatttaatatatgcattttctgtaatttgatatctttaattaatatatggaacagtctttcatacaattatatagttctacttta

SEQ ID NO: 169367 - DNA, 601 bp, Human
gggggatcgaatggaagttttatagttagtaagtggcagagcttggcttagtaccccaggcttgtctgacacctgtccttctcccatagcaccatagtgctttgctgagaatgtgggtaggagtcagaatcctatgatgctttccgtttggaggttagagtcagggttgccaggggtcgattatgaaacaggtgatgttcattttcagcatcattagctcctctttggtgtgtctcttctctccttggcattcattttctcacacccttcccagctgattcacagtagggtttcagagggmtctaggacgtatttgtattattttaaaatatacattttaaattctaaagtatccttatagtaacaattcaagttgtacaaaaaggagataaaatgcaaagtgattttctctttctctaaaacctttaatcctcatctttaaaaaagtatcttttcagaaattttatatggacattcaggcacacacaatatatcctcttttatctgagagaacccatttaatatatgcattttctgtaatttgatatctttaattaatatatggaacagtctttcatacaattatatagttctactttat

SEQ ID NO: 169368 - DNA, 601 bp, Human
cagaaaggcagtaccattttcattgtatccgcagggtatgtgaatgcctgtttcctaagcctttttctttttaaagaggacttgaagccagagaagaggagacaaagagcagagtgggtactaaaagtaagtggcggccaagagaaacagaaacacaggttcacacaaaaacttgtgcatagcagcattatttatagcagccaaacagtggaaacagcccactgttcatccagtactgaatggataaacaaaatggggcatatacatacaatggagtattattcagtaataaagactacartgtggataacctttgaaagcatgctgctaagtgaagtaagccagtcataagataccatgcatacttatgtgaaatatccatgtaggcaaatccatagagacagaaagaagatagtggttgcttagagcgggaggtggggatgatttgggaaatgactcctgatacgtaaagggtttctttctggcatgatgggaatgttctaaaattagattgtggtgatggttgcacaactctgaatatattaaaaaccactgaattgcatactttaaatgggtgaattttacaatatgtgaattttat

SEQ ID NO: 169369 - DNA, 601 bp, Human
ttgagacagagtctcactctgtcacccaggctggagtgcagtggtgcaatctcggcccactgcaacctccacctcctgggttcaagcgattctcctggcttagcctctggagtagctgggactacaggtgcccaccaccatgtctggctaatttttgtattttttggtagagagagtttcaccatgttggccaggctggtctcgaactcctgacctcaggtgatctgcccgccttagtctcccaaagtgctgggattacaggcatgagccaccgcgcctggcccaggaaccattttaagawcaaggaatttttgatgggcttggatattaagagaacatgtatagaagattgaaagacaagcacatgatcagggacaaattcagaagagtggcgtaaaccggtaagaaaatatctgcaaagcacaagttcatactgagctgaagctgaagagaatgttaaagacaacaagaaagctctctttaaagctatgttcataacaagaaaaacaagtaaaggctaagctcgttgcttggggcagatggaataatgttaaaatatgacgaaaaacagacctactcaactatttggcttctctttctc

SEQ ID NO: 169370 - DNA, 601 bp, Human
agattgaaagacaagcacatgatcagggacaaattcagaagagtggcgtaaaccggtaagaaaatatctgcaaagcacaagttcatactgagctgaagctgaagagaatgttaaagacaacaagaaagctctctttaaagctatgttcataacaagaaaaacaagtaaaggctaagctcgttgcttggggcagatggaataatgttaaaatatgacgaaaaacagacctactcaactatttggcttctctttctctattaaagacaatgatgttcaaactggaatgtgtaacataaacatrgttaaggataaactgaagcatgcacgatagataatgataataatagttgtgactacaatttcctgagtttctattcaggactgagtactgtaaaagagaatttagttgctttttaaagtacttactggcaggcgtgcgcggtagatattactgttatcaatcccatttacagatgagaaaaccgaggcacaggaagatttaatgacaaacctgaagttacacagtcggtaaatgatgggctgggattcagatcaaggtctgactaacttcaaagcctggctcttttcactggactccctg

SEQ ID NO: 169371 - DNA, 601 bp, Human
ttacactttcctctactttgttatgtatggaaaattcacataataaaaacagtcaagtgttctatttgagaggcagaattttggcagaaggcctgggttataacccaatttgtatagcctggggagagtcactgctactccctccttttttgcctctttcctttcctttttactttccttctatttcttaagaaatcatttgctgggccacattttcccccagggactgtcctggtaccatcagccttccaagttacaggtataggtattattattattattattattattattattattattattattttacagatgaggaaatcaaagcagagaagggactaagtttctcacccacaaatccaggtctgcctgtgtccaaaatctgagctcttttgttttattttatgctggctcccaggagtagtcctctgattttataatttttaagtttttttatttttaattttgtttatggataaattttaaacaatgagtaaattaagatagatcaagtggagtagcatttgtgttttttgcatgtgagaaagatgcaaggtatggttgttactgtaacaattacaaagatttcatcaaaggc

SEQ ID NO: 169372 - DNA, 601 bp, Human
acactttcctctactttgttatgtatggaaaattcacataataaaaacagtcaagtgttctatttgagaggcagaattttggcagaaggcctgggttataacccaatttgtatagcctggggagagtcactgctactccctccttttttgcctctttcctttcctttttactttccttctatttcttaagaaatcatttgctgggccacattttcccccagggactgtcctggtaccatcagccttccaagttacaggtataggtattattattattattattattattattattattatkattattttacagatgaggaaatcaaagcagagaagggactaagtttctcacccacaaatccaggtctgcctgtgtccaaaatctgagctcttttgttttattttatgctggctcccaggagtagtcctctgattttataatttttaagtttttttatttttaattttgtttatggataaattttaaacaatgagtaaattaagatagatcaagtggagtagcatttgtgttttttgcatgtgagaaagatgcaaggtatggttgttactgtaacaattacaaagatttcatcaaaggcaa

SEQ ID NO: 169373 - DNA, 601 bp, Human
ttgagaggcagaattttggcagaaggcctgggttataacccaatttgtatagcctggggagagtcactgctactccctccttttttgcctctttcctttcctttttactttccttctatttcttaagaaatcatttgctgggccacattttcccccagggactgtcctggtaccatcagccttccaagttacaggtataggtattattattattattattattattattattattattattattttacagatgaggaaatcaaagcagagaagggactaagtttctcacccacaaatccargtctgcctgtgtccaaaatctgagctcttttgttttattttatgctggctcccaggagtagtcctctgattttataatttttaagtttttttatttttaattttgtttatggataaattttaaacaatgagtaaattaagatagatcaagtggagtagcatttgtgttttttgcatgtgagaaagatgcaaggtatggttgttactgtaacaattacaaagatttcatcaaaggcaagcagtgataaaagcaaaatgtgtggcaactttcttcatattcagaaaagagtaaaagcctata

SEQ ID NO: 169374 - DNA, 601 bp, Human
aaaataacatttatttatgcttgttcttcaaaagcttatatttgataatcttttttgttagaagtcgaagcctgagaaaaatggctaatttcatttttcatgtgtttgtaaaatatttttaggactatcacaagaaattccctaaaaatgtcaaagcaaatgaacaagtgaaattctgcacatcccttgtgccactattttgtttacttactgaaaaaatgacattggcttttgtaaaacctgggtgtgctggtgggcatgtgcagatgtgtcgctgtcatctgtcatgtgtcatgctctsgatgtcagaaccagacatcagtcagggaagagagtgagtagcaagccacctcgccaaactcttgctgcagggtgcacggggttcacatcctctgcttagatttagtgcgactttccaaaacacctgcagtgcggtacttcatggctggtcccacgtaacaatttatgccctagagatgtctgactagatcttaggaaattatactaatggttctgacgttgtttccttcaagaatcgaggcgctaaatatagtcaagctgaatgacaaaattttactcacactcagggcatgtcagtgag

SEQ ID NO: 169375 - DNA, 601 bp, Human
cacggttaataaatggcagagctgggctctaaacccaggccgtctgacccctgagcctttcctcttctaaccactgtgcagtctccaagcaccagcagaatgaagtgagcacgtgctaatccacagctgtcatggtttggccctctgtgggctttcagagcaccttaaaaccctttgttctgtgtcagagctgtttttcagctttgcagatgtctgaagtcaagcagaagagatggagagtctgataaagcacacgtggcaaatctctggccgagttgatattagaacacagagtcccagrgtgatttactgtccagggggaaagccagttggcctggctaccttgcaagacggttaaaggacataagaatagatattcattcaagactgtcagaaagaaagtaggtcagcaatgaaataaaaacaaatgtcaaagaaacaccactttggtataaataaaaagtcgattcttcttaataaagagctgtctgttcttcattaattagaaaagtacagagcctgcttactttgagattccaaaacctcttcaggcacaactcgttattaatttgatcactttcctcaaaagaatgatattttg

SEQ ID NO: 169376 - DNA, 601 bp, Human
gttgccagtgagaatctgagtagcagagcagacaagaataaggacgtatgggatcgaggcctgtagcttgtgaccatgaacaagtcacgtgaccctttggccttaaattcaccataaagtcgtgtacttgatctcagtgattgtatcttacttcatcaaaatggtatgattctaaattcctgtgggatatacaggtaagacaggactggtggagcattaggtttggtttttcctttaaaagaaagtgttggggaggcagcagggaatagcaaaggtcacagactcaaaagcattaactgcmgggcctatgaagacacgaatgatgtaggtttgatataatggaggtacaaatccatgttttatgcaaaacctcatatttctaaactttggcaattcattcatgtttatcaaatcactgttttaggccccctttggctggccagtgggccctctgctttagacttctggaataaactccacagttgagagatgaaggacagacctggattctaacagacctaaatttgaaccttagctctgccctctaaggaatgtgtaaacgtatacatctgtatttaacttctcaaagcttcaagtttct

SEQ ID NO: 169377 - DNA, 601 bp, Human
ttgatgtcagggactggccaagagttgttcatcactaagtcagcctcatgggtggtggttaaactggctagagtaatttttcgttaaaaacgagccaggactgtaaagtagtatgacagggtttttttttttttttttttttttttaatatcacatcaactgattgtagagaaaaagatagttccaaaaaggcattctgcacattttttgccccaaaccagtatcactggaatatatttgtagctccctaacaggctaactttgaaataagtggtgctcacatgtgcatgtgttgtagtaygtctgctgaaccttgtacttaacctcttagcaaactcagtgtctttgttttttcctttgaaatgttgttttttcaagttcagggatagattttctccaagaaaatgaaacaaataagatccactctcaaaggaccttaatggaaagaaatacatgcttataccaagttctttaaaactatccaaactggaaaggattgcctcatagctgactgtgattattctgccatgatttagggacagataatttcctatcagcatgtttaacatgagaattaaagagttctgtagtgtggcctatt

SEQ ID NO: 169378 - DNA, 601 bp, Human
ctagagtaatttttcgttaaaaacgagccaggactgtaaagtagtatgacagggtttttttttttttttttttttttttaatatcacatcaactgattgtagagaaaaagatagttccaaaaaggcattctgcacattttttgccccaaaccagtatcactggaatatatttgtagctccctaacaggctaactttgaaataagtggtgctcacatgtgcatgtgttgtagtacgtctgctgaaccttgtacttaacctcttagcaaactcagtgtctttgttttttcctttgaaatgttrttttttcaagttcagggatagattttctccaagaaaatgaaacaaataagatccactctcaaaggaccttaatggaaagaaatacatgcttataccaagttctttaaaactatccaaactggaaaggattgcctcatagctgactgtgattattctgccatgatttagggacagataatttcctatcagcatgtttaacatgagaattaaagagttctgtagtgtggcctattgacctcatttgttcattccacaaacatcttttggagtccactgtatggcaggcattatcacttacca

SEQ ID NO: 169379 - DNA, 601 bp, Human
gccccaaaccagtatcactggaatatatttgtagctccctaacaggctaactttgaaataagtggtgctcacatgtgcatgtgttgtagtacgtctgctgaaccttgtacttaacctcttagcaaactcagtgtctttgttttttcctttgaaatgttgttttttcaagttcagggatagattttctccaagaaaatgaaacaaataagatccactctcaaaggaccttaatggaaagaaatacatgcttataccaagttctttaaaactatccaaactggaaaggattgcctcatagctractgtgattattctgccatgatttagggacagataatttcctatcagcatgtttaacatgagaattaaagagttctgtagtgtggcctattgacctcatttgttcattccacaaacatcttttggagtccactgtatggcaggcattatcacttaccatggtgaggatggtgaggccatgagcatgcttcacctaaggaagcctgatcttcaagaatgcaaactcactcaacaagaaacttgagagtaattaatagtagtgttggtaattatcctgtcttttccttgtaggattatttgg

SEQ ID NO: 169380 - DNA, 601 bp, Human
tgctgaaccttgtacttaacctcttagcaaactcagtgtctttgttttttcctttgaaatgttgttttttcaagttcagggatagattttctccaagaaaatgaaacaaataagatccactctcaaaggaccttaatggaaagaaatacatgcttataccaagttctttaaaactatccaaactggaaaggattgcctcatagctgactgtgattattctgccatgatttagggacagataatttcctatcagcatgtttaacatgagaattaaagagttctgtagtgtggcctattgacytcatttgttcattccacaaacatcttttggagtccactgtatggcaggcattatcacttaccatggtgaggatggtgaggccatgagcatgcttcacctaaggaagcctgatcttcaagaatgcaaactcactcaacaagaaacttgagagtaattaatagtagtgttggtaattatcctgtcttttccttgtaggattatttggaggttgtgaagtggtaagtctctttattgcatttgaaatatggctcatctcatgaccattggaatgtgtgtacgctctggaggaaacccatctct

SEQ ID NO: 169381 - DNA, 601 bp, Human
tgtgttcgtactgcctctgtaaatggaacacaagcctctcctaccctctggggagcttgtcacttagtacagttttttaggaactcctaagaagtttaagttctggccacaggtcccagagttaaggatgttgtcaactctgctactcatttgaaaaatgtcttgtggaacctatagccgcagaaagagctttgtttctctgggtgaaaacaacatacattatcatttctaataactttaatggatgctgctgctttcttctttttggcccccaagatactcagagataaacttgaaactyaactataggtggggggagggggaagggatagctttaggaaatatacctaatgctaaatgacgagttaatgggtgtagcacaccagcatggcacatgtatacatatgtaactaacctgcacattgtgcacatgtaccctaaaacttaaagtattatgataataataaaaaaaaaagaaactcaactaaagcatggtctgcatacttgtgtgtatattttcgctggtctcaaatttctatttatttatagttttctggcttacagtctatatttgtgtaatatttatatggttttatatggt

SEQ ID NO: 169382 - DNA, 601 bp, Human
tgtagtagttaataataatgtttacttcaaaattgctgagtaaatccaaatgttcacaccacaaaaatataagtacacgaggtgatggatatgttagttagttgagttagctagctaactaaccataggtataagcataggtataagcatataaaaataccacattttatcccctaaatagatacaattattatttatcagtaagaaataataatataacataaatactatattgtttcaaaatagagggaagaaaacatgcaaatagtcctaatggattttttttttttttttttttagkctccaggctggcttccagacaaggctgtatggtggcccagactggttgaattttttcacttaactttttgttgatctgccttaatttccaataactagagattctgataagaactttaagaataggaatacttctgagaatcttaagatgttattagccatatataagtaaccatacattttataaaagcatttttctcttcacaatagctggaagtggaacatcctagagaataactcatttttgaaaaatagaatgtcttaggggagaactggcctgctaagtattacaggggaggac

SEQ ID NO: 169383 - DNA, 601 bp, Human
ggggaggactcaggacaaaatcaagttatcagatacctggggcttagaaagcaaggagttagaaggtagaagaggcttacagaaaggaggaaagaagatgctggagaccctctttcatctattatagaacattttctatggctggcctgtattcagagaaggatacctatcttgctgctttctgcaccaaatagttccaagatccaaaattcaagctagtgctcttagtgaatagtttggttatattacgggttaaatgggttttcctataaagctagccaccatttatggtatttagatstaccacttaggaagatttcagtcatattcatgattttcaggttgtcctctctcagaaccctggtgtcataaactgtaatagttgtaggaattgttgtagtggatatagcagtaatattttctatggaaaaatatagaagttaatatatgccaggtactgtttcagttatggacactcatttaaatatatgaagtagatgctattataatccccaattacagacgaggaaactgagagacagaaaagttagataacctcccaaggtcatgtagctactaagtagcaaagccttgatttgaa

SEQ ID NO: 169384 - DNA, 601 bp, Human
tctcctgctaccatcccagtccgaacctctgacatctctcactggacttccatatcacctcctaatccatctctgcctctgtgtttgcccctggcagtccatggagagaccagccagagtggtctctttaaactgaagtgccactcccccacttaaactcacccattggcatcccatagcacttagaaggaaagccgaactcctttgtgatgtacctgctgcctatgtctgccccaccctgccaggactcactactgctgtcacacagatcccttttctgttcttcaaatataccaagtgsgagtcttacctcaaagcctttgcagttctcttctctctccctgctatacagatcaccataaggctggcttcctcttactacctaggtttcgtcttaagtcacctccctagagaggtttgacctgaccaccctatgtaaagtattcatataaccccaggccacactctatctcatagcccattttattttaatttatgtaaagcatttgtgtttatgtattatttttttgcccctacctataaagtccagaagagcagctaccttgtttgtcttgttcagtgctgtatccctggcacctag

SEQ ID NO: 169385 - DNA, 601 bp, Human
tataaagtccagaagagcagctaccttgtttgtcttgttcagtgctgtatccctggcacctagaacaatgtctggaacatatagaaggttaatgtttattgcatgaataaacaaatgaattactttgtttgtgatttaggatcaaggaacttttccccaaaggcgaatctgtgcagttttatcccacgcttcttccccatccctaagttcctgctcatctggactgtgtgcttgcaaactgtgtaaagacttgttcaacattcttaaataggttaaagaagtactgcactttgggctcttygtcattttcaagtcacattctatcctgggcaccatccggaggggtcttgtccagtttcctagtttctcagaaaggaatatttcatggctgctcgcacgtcctcttcccttacagtatttggactttacaccactcattggcagagccaaggcctaccccatctgagcaaagagcaacagagatctgttggctccattcactcctttgctctaagactcacttgtttcttcttatcttttcccaactatttttagttgtcaaattgctcctttctttccctttcccatctatttttctttt

SEQ ID NO: 169386 - DNA, 601 bp, Human
gatgcgttcattcacatcacagtcagtgcaggtagtgtagagacaacagtcatgggaaagggagcccaggaatgaaggaggccctgagaacatcatccctcaccaaaatgttaagacgggttttgggtttccagaagctatagagttggtggcagtttgagccaattttttcctacatcttgaagggcaataagaatcccacataatgtctgggccacatcttggtggtacctggtataactttgccaaaagaattttaaaaccaccgcaataggtaactcaactgctggtactgtatttwatgtgtgcttggtatgtttatatgtctttaattctattacaatttttttattgcacaaagaacattataacaatgcataattatatatcaatagcaatattaaaaataaagacaaaaggacacattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgattta

SEQ ID NO: 169387 - DNA, 601 bp, Human
taagacgggttttgggtttccagaagctatagagttggtggcagtttgagccaattttttcctacatcttgaagggcaataagaatcccacataatgtctgggccacatcttggtggtacctggtataactttgccaaaagaattttaaaaccaccgcaataggtaactcaactgctggtactgtattttatgtgtgcttggtatgtttatatgtctttaattctattacaatttttttattgcacaaagaacattataacaatgcataattatatatcaatagcaatattaaaaataaaracaaaaggacacattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttc

SEQ ID NO: 169388 - DNA, 601 bp, Human
gttttgggtttccagaagctatagagttggtggcagtttgagccaattttttcctacatcttgaagggcaataagaatcccacataatgtctgggccacatcttggtggtacctggtataactttgccaaaagaattttaaaaccaccgcaataggtaactcaactgctggtactgtattttatgtgtgcttggtatgtttatatgtctttaattctattacaatttttttattgcacaaagaacattataacaatgcataattatatatcaatagcaatattaaaaataaagacaaaagracacattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttctggcaaaa

SEQ ID NO: 169389 - DNA, 601 bp, Human
cattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttctggcaaaatccygctgctcctccttgatcctgtagttttctctgttttaacccttggaacatgatttataattcgtgggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacct

SEQ ID NO: 169390 - DNA, 601 bp, Human
gcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttctggcaaaatcccgctgctcctccttgatcctgtagttttctctgktttaacccttggaacatgatttataattcgtgggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacctttgtcagtcactcttgtaagaattttacatatg

SEQ ID NO: 169391 - DNA, 601 bp, Human
acccttggaacatgatttataattcgtgggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacctttgtcagtcactcttgtaagaattttacatatgttacrcttcactcagtccttataacaaccctatgagatagcaattatcagctcctccctcctctccattttaatcatgacctctcagaaacagagaggtcaagtgacttactcaaagtcacagctagtaggtggcagttagatctgaactcaaataggctccagagactgggctcttgaccattattcttcctttccaaggttggaagagactgagagacctcagctcctgaacacctggaactgccaagccacagctgttactattactgtactgttactaaagagccaaaccaaaccacatgg

SEQ ID NO: 169392 - DNA, 601 bp, Human
gggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacctttgtcagtcactcttgtaagaattttacatatgttacacttcactcagtccttataacaaccctrtgagatagcaattatcagctcctccctcctctccattttaatcatgacctctcagaaacagagaggtcaagtgacttactcaaagtcacagctagtaggtggcagttagatctgaactcaaataggctccagagactgggctcttgaccattattcttcctttccaaggttggaagagactgagagacctcagctcctgaacacctggaactgccaagccacagctgttactattactgtactgttactaaagagccaaaccaaaccacatggctggctcctttggcaagaacttcccct

SEQ ID NO: 169393 - DNA, 601 bp, Human
tggtgtaattcagtatgtgtgtgtgtcggggtagggactgggggtgtatagggtggatatagtatacgtcccagtcagtgttggaatgtccaagaagagtgctgttgcccaaatgcaggagaggatggatgttccagctcaagaagagagaaaattcacccttccttgcttttttgttctatttgggccctctacagactggatggtacccacctacattggcaagtgatatggtttgattctgtgtctccatccaaatctcatctcgaattgtaatccccatgtgttagggagggacctsgtgggagatgactggatcatggggacggttcccccatgttgttcttgtgataatgagtgagttctcacaagatctgatggtttaaaagtatggcacttactcctgctctctctctctctctctctggccactatggaagatctgccccttgcttcccctttgccttctgccatgattgtaagtttcctgacatgcatactgtgagtcaattaaacctcttttcttcataacttacccagtctcaggtagtatctttatagctgtgtgagaatggactaatacagtgagggtgatctttac

SEQ ID NO: 169394 - DNA, 601 bp, Human
cgccagctatctgggcaccccttaagcccagtcaagttgacacacaaaattaaccatcacatacactattaaagtggctgaatcatttattctggattagggtgattttatcattgtggtggtagttaatacacttttctgtttgctatatttcctgtaagctagtcgttgaatctagaggcttgattagattcaggttaaatatttcaggcaagaatatcttttattggtggtgctgtagactttcaaccataccacatcaggaggtacataaagcctgtcagtcccatgtgtaatgatyatagattgattggaggttttgacattttcaccttgatctttccattataaagttccttatcaacctttcacaatggtttaatgtttattgataactgccaaattccagtacttcatgaggtggaagcaaaatggtagtttcctaattcctacattcttctgcatttattagctggtattgatctctgaagaactttccctccttaactatttgattggccttagatgtagttcttaggccctattttattttatttttatctatttttttgagacgcagtctcactgtgttgcccaggct

SEQ ID NO: 169395 - DNA, 601 bp, Human
gtatccagtatgttgtcttttatacctcaccccctcccatccggccacaacaagtccccaaagtccattacatcattcttctgaatcctcatagcttagctcccacttataagtgagaacatacaatatttgttttccattcttgagttacttcacttagaataatggcctccagctccatccaagttgccacaaaagacattatttcattcctttttatggctgagtggtattccatggcatatatacaccgtgttttctttatccattcgttggttgatggccacttaggctggttccmtatctttgcacttgtgaattgtgctgctgtaaacatgcatgtgcatgtgtctttttcatatgacttcttttcctctgggtaggaacccagtagtgggattgctggattgaatggtacttctacttttagttctttaaggaatctctatacgttttccatagtggttttactaatttacattcccaccagcagggtaaaagtgtttccttttaaccacatccatgcccacatctattgttttttgacgttataattatgtcttaggctgtattttaaatcagggctctctgagcttgatct

SEQ ID NO: 169396 - DNA, 601 bp, Human
taatggcctccagctccatccaagttgccacaaaagacattatttcattcctttttatggctgagtggtattccatggcatatatacaccgtgttttctttatccattcgttggttgatggccacttaggctggttccctatctttgcacttgtgaattgtgctgctgtaaacatgcatgtgcatgtgtctttttcatatgacttcttttcctctgggtaggaacccagtagtgggattgctggattgaatggtacttctacttttagttctttaaggaatctctatacgttttccatagyggttttactaatttacattcccaccagcagggtaaaagtgtttccttttaaccacatccatgcccacatctattgttttttgacgttataattatgtcttaggctgtattttaaatcagggctctctgagcttgatctcatgtcagccatcatcatatcagtgtgaaaacagactagaaccaggtatcagtgatgcagcagccaggagaatttctgggccaggggccaggcaagctgcatatcccaatggccaactggtcatggctacttcctttttctcatctagtgcaagctcaagag

SEQ ID NO: 169397 - DNA, 601 bp, Human
accttttctctgggaggccatttgttttcctgtaatctgtagaagaaaccaaggtacttttgtgggtgcagcatctcagttactgggggagcttctcagtgtgagctctgaatgcttcaggatgtcttccaatagccagcctttcctctgtgtaaaaggtttctctggagtaatggagatagcatgtgtgcaagtaggcaggagctccccttagtgtcagcttgagagcaaggaagggagaggagagctatgcctctgaaacaataccattttgcccccaatgccagttttatttcagagrtaaaatgccatgcttcagagccatcaatgataattgtttgagattgatgacctttggaagctgacagaatactaacttctgggagaagactagagtagatcaggatgatttcttggtatactctcagctgtttcccaccatgtgtttcctcttctttctgatatacagccaaaatacatttcccagtctgccttgcagttaagggaaactgaggtctcgtcaatggaatatgaatagagaaatgtgtaccacttccaggcctggcccatgaaaacctcccatatgctctctctctttcat

SEQ ID NO: 169398 - DNA, 601 bp, Human
agaaagaggcccactcctctatcgtattcacctgccaagtattgtttgtgagcaagaaaaaaaatatctactgtagttgaggccatcttaaatacagtttctcttttaaagccattccacgtccaccatttggcattaagcgtctttaaaaaaaactgtgagtgccctgccttgccagtaagctgttagcaagtcttaactcgggagatctgtctctcctggcattctgagaagcagaagtctcaaattacttccagctgaaatggaaaagaaacaaaacaaaacagaaactcatctgtgrtaggcagactaatgtccctcccaccgagatgttcatgcctgagtccttagaacctgcaaatatgttacctccatggcaaaggggactttgcaggtgtgattaagggtactgatcttgagattgggagattattctggattatctagatgggcccaacctaatcacaagaaaacattggaaaagggaggaaaagagtggatcagaccgatgcgatgtgatgatttgacccactgttgctgtctttgaagatggtggcaaggccttggagctaaggaatacagtctctagaagctggaataa

SEQ ID NO: 169399 - DNA, 601 bp, Human
gatctgtctctcctggcattctgagaagcagaagtctcaaattacttccagctgaaatggaaaagaaacaaaacaaaacagaaactcatctgtggtaggcagactaatgtccctcccaccgagatgttcatgcctgagtccttagaacctgcaaatatgttacctccatggcaaaggggactttgcaggtgtgattaagggtactgatcttgagattgggagattattctggattatctagatgggcccaacctaatcacaagaaaacattggaaaagggaggaaaagagtggatcagacsgatgcgatgtgatgatttgacccactgttgctgtctttgaagatggtggcaaggccttggagctaaggaatacagtctctagaagctggaataaacaaggcaatgcaatccccttagagcctccaaaagggagcacaggtctcagaactgttaagataataaatttgtactgtttgaagtcattaacatttgtggccatttgtcatggcagtagtagaaaactaatacaccatcccatacaaaacacttaaatgaaaaaaaaaatacatacatctgtagagtaggcacatctgtaggttc

SEQ ID NO: 169400 - DNA, 601 bp, Human
agaaaactctaaagtaagaataaatggaaaatcattagaagaagtatagaaattactttgaaagggtatatacagtctaattcatttatttttattttagaaatttgaatgaattatttcaataaatgtatataaaagattttacattacgttatactcagtttttctttttctttatttttttgagccagtcctccgagcctgtttcctcaactgcccttttctcctacccagtacatcgagctgttcagtgaaaaagaacagtgttttgtgtgtataaataaataaataaataaataataataaaaataaacagctaactaacgtaggaaaccctccttctccttccccaacaagttgcctgaagaaatatgtattagcaagactgctggaaatccacatttgttacatgaaattaggacattaaaactgtatcctgctgcttagtgcccagaccttgtaccccatgcagcagcctgcttgtcggccatggaacaatgtgtagcaaatgccttggtgatgacatatctgtcagagggaaagaaggagggcattgattatcataatgcggcatagagctcatttccttctgaaattaccc

SEQ ID NO: 169401 - DNA, 601 bp, Human
aaaactctaaagtaagaataaatggaaaatcattagaagaagtatagaaattactttgaaagggtatatacagtctaattcatttatttttattttagaaatttgaatgaattatttcaataaatgtatataaaagattttacattacgttatactcagtttttctttttctttatttttttgagccagtcctccgagcctgtttcctcaactgcccttttctcctacccagtacatcgagctgttcagtgaaaaagaacagtgttttgtgtgtataaataaataaataaataaataaaaataaaaataaacagctaactaacgtaggaaaccctccttctccttccccaacaagttgcctgaagaaatatgtattagcaagactgctggaaatccacatttgttacatgaaattaggacattaaaactgtatcctgctgcttagtgcccagaccttgtaccccatgcagcagcctgcttgtcggccatggaacaatgtgtagcaaatgccttggtgatgacatatctgtcagagggaaagaaggagggcattgattatcataatgcggcatagagctcatttccttctgaaattacccag

SEQ ID NO: 169402 - DNA, 601 bp, Human
aaagaaaaaaaaggatggactgacacgtggtcagtctttgttcttctggtggcttggacattaacaaagtgttccctacccacttaagcttctcatctgcatctgcacatcagtggtcttcaaactttttttgttatatgccattgaaagaatgttttaaaaactgtgtaccatctcactgtttaaatctgacatctaaatatttccatcattttaaaaataaggagtagaagacattacatgtttcataaggtaaagattgatggtgtgtggaataaatattttgtgacatgatttgatraactaggttttaatgaccttattgaataacatgttaaattggaaggaaatcagtaaaaagcttatatgtagactttatccagcacatcttgaaagatctgatgacttcagaaaacactgtggttatttaaagataatccacatcacttatatgtactactttgtcctgaactcagaactacccaggactggccaaccctactcttacagacttgcttgcaggacagggagagacagaaagtgctaaggcttcccccaaccagtatttggaatcatttagtgtagcacaccatattaagat

SEQ ID NO: 169403 - DNA, 601 bp, Human
ttgtgaaactgtccctgctctagtacctttgggaagtccatttgaagactgctggaatagatcatggactcaataaataccttttcataggagcacagagggatgaacaaggcagactgaaggagagaataggaatgctccccatgtcaggtgtgtggagggtgcaccaaggctcattctggtagaggtagaggagcttctcccaaagtagcaaactcagatcactcatggtctcagtccccttaattctttcaagctgctggatcaagaacgaggcagccagccctccagctgatgaccrgagacatttattatctaccatgtgctaggcactgtcctaggtaccagagacatcctggtaatcaagacaaagttccacgtttgtgaagttggggatcagggaggtggagagacagagaaaataaacaaatctatgagaatctatgagaggtagagataaatgctatgatgcagatcacctgagtgatatgactggaatggcacctccagcttggctggtcagaagtggcttctcaaaggaagtagcagctaagctgagacctaaagccatccaaataaaaaccaatgagtacatccatca

SEQ ID NO: 169404 - DNA, 601 bp, Human
ctccagctgatgaccagagacatttattatctaccatgtgctaggcactgtcctaggtaccagagacatcctggtaatcaagacaaagttccacgtttgtgaagttggggatcagggaggtggagagacagagaaaataaacaaatctatgagaatctatgagaggtagagataaatgctatgatgcagatcacctgagtgatatgactggaatggcacctccagcttggctggtcagaagtggcttctcaaaggaagtagcagctaagctgagacctaaagccatccaaataaaaaccartgagtacatccatcagtcagcaagtatttatcgggtgcctgctatgtgctaggcactgtttaggtacttggtttacattggaaaacaggcctggggatcttacattctaactgggtgagaaggggtctgacaggcaataagcattataaataagtaaattacctggtatgttagaagatggtaagtgttatgcaaaaaaaaaaaaaaaaaaaaagtatagagcaggctaaggaacagaggtagcatgggggtagtgtgtgattttaattagggtgggtggggaggcccccattcagtggg

SEQ ID NO: 169405 - DNA, 601 bp, Human
attcagtgatctccaccgtggggattattacaattcaaggtgagatttgggtagggacacagcaacaccacatcagttctcattttattatcccatgagaacatccagctcccctttattgcagcactgtgcccacccagtttctcaaggaagccaatgagactagcagacattgtcaggtcacagtattttggagtgctctgcattgcctcttatcagtccagctctttgtggcttcagttgatacatttcagtccccaatcacctctgagtgagccaatgccgttgagtagctgcatgyactgagtactgcattgcttgcccaggtcacctctgaagatcccctgccttcctcagactgaccatgttcctaggaggtcggggaaagtagaccacagtggctcatctcaagcatagaatctttgtgaaggcttctttttattataaacatttttgtgaaatttgacttctttttttcttttttttgagattgagtttcactcttgttgctcaggctggagtgcaatggcgccttcttggctcacttcagcctccttctcccaggttcaagcgattctcctgcctcagccttctgagtagc

SEQ ID NO: 169406 - DNA, 601 bp, Human
gcccacccagtttctcaaggaagccaatgagactagcagacattgtcaggtcacagtattttggagtgctctgcattgcctcttatcagtccagctctttgtggcttcagttgatacatttcagtccccaatcacctctgagtgagccaatgccgttgagtagctgcatgcactgagtactgcattgcttgcccaggtcacctctgaagatcccctgccttcctcagactgaccatgttcctaggaggtcggggaaagtagaccacagtggctcatctcaagcatagaatctttgtgaagscttctttttattataaacatttttgtgaaatttgacttctttttttcttttttttgagattgagtttcactcttgttgctcaggctggagtgcaatggcgccttcttggctcacttcagcctccttctcccaggttcaagcgattctcctgcctcagccttctgagtagctgggattacaggcacacaccaccacacccagataattttgtatttttaatggaaacagagtttcaccttgttgaccaggctggtctcaaactcctgacctcaggtgatccacctgccttgctctcccaaa

SEQ ID NO: 169407 - DNA, 601 bp, Human
gcttcagttgatacatttcagtccccaatcacctctgagtgagccaatgccgttgagtagctgcatgcactgagtactgcattgcttgcccaggtcacctctgaagatcccctgccttcctcagactgaccatgttcctaggaggtcggggaaagtagaccacagtggctcatctcaagcatagaatctttgtgaaggcttctttttattataaacatttttgtgaaatttgacttctttttttcttttttttgagattgagtttcactcttgttgctcaggctggagtgcaatggcgccwtcttggctcacttcagcctccttctcccaggttcaagcgattctcctgcctcagccttctgagtagctgggattacaggcacacaccaccacacccagataattttgtatttttaatggaaacagagtttcaccttgttgaccaggctggtctcaaactcctgacctcaggtgatccacctgccttgctctcccaaagtgctgggattacaggtgtgagccactgtgcccagcctgaattttgacttctattcataatatattcatatgtgttttaatataaaatgtttatcatttaaat

SEQ ID NO: 169408 - DNA, 601 bp, Human
ttttgggttagtgtttgcattactgactgtggtttcatggcatgataatgcaaagtttaataagagcaggctgtctttgcctacagctagagttgcattgaggcatgactacttctagtgcctgctctgtgccagattcacagtgccttacagcccctccccagaactggggcagaggaggaagaaaaaagtgactctgtggttcaggggaaggagtaaagtttcaaggctgtgtgataggacatttccctgatgcttggctttaggctcaggatggggacgttaatacattcagcagagrctggctacctatactggcaccattgaaggactctgccctggctcagtgctggttttgcttggtgatgcagtgtagtgtagcaggatgatcaccagctttaaagccagatcaacccaaatttgaatctcagcattagtcctcactctgctttgagacgtcgggcaagtgatttaatctcttgaaatctcagtttgttcatctgagtaacaggtggtaaaatacatacattgaaacgctgctaaaagattaagcaatgagaaggcaaaatggtacagcaactttgggagacagtttggcagt

SEQ ID NO: 169409 - DNA, 601 bp, Human
gttgatgaagcataggggacttttagggcagtgaaactcttctatagtatctagaatactatattactctatcaatcatagaatgatactagagaacatactgtagtgatggacacatgtcgttgtgtatttgacaaacccttctttgtgttgtacacgaagaaggaaccctaatgtcagctatggactttagttagtaagtcttctaaaaagcttaaacaaggcaatgtgtataaactaactgactaactggcataaataaatagtggacttcaaaaaaaattcataatcctagcacttygggaggccgaggtgggtggatcaactgaggtcagaagttcaagaccagcctggccaacttggcaaaaccccatctctactaaaaaaatacaaaaaaaaaaaaaaattgtattctaagttccaggaatgtcatttagacatagtttcttttggggctagatgtatcaattttcattaaaggtgatattattatttaaaaatccagctggttgctaaatgagaattagctaccctttataaccagggattgtttcaaagaaatgtagttattttctcccctgtggcctatcttgtgcaaagt

SEQ ID NO: 169410 - DNA, 601 bp, Human
ctgatagagcagaagggattgtataattaaataagaactaacacctattttgtaactggaaattgcattgtcagagtccctttccttttatcactagatgctaagaatctagccatgtaaaaactcccaaaacatccaaattcaaaaaaactggaatctaacgtggtaatgcagttgtcaagaacacgcaatagtctttgggcttttacaaagcactgaaaactaaatgttgcatttgtgcccttatcttccacaacttctttcttggcagcttttcttggctcacttcagacacacagartttcaagtaatcagggaaagttgggacagaaacttcctctgtctttccatggccttttctttttcctttacggatctgtgatcctatgctttctctcacattcacattatatgtgtcagttggagaaatcttgatgcccagtttcatttgtttcttctgtcccacctgtaactaatttaggttgagttctccggctcatgtatcagagtgtgtatgacaaattatctcaaagcccagagggcctcggtggtccaagtcccagcaacaagggacacctgctgtcatgacatgggcttgacc

SEQ ID NO: 169411 - DNA, 601 bp, Human
ctaagaatctagccatgtaaaaactcccaaaacatccaaattcaaaaaaactggaatctaacgtggtaatgcagttgtcaagaacacgcaatagtctttgggcttttacaaagcactgaaaactaaatgttgcatttgtgcccttatcttccacaacttctttcttggcagcttttcttggctcacttcagacacacagagtttcaagtaatcagggaaagttgggacagaaacttcctctgtctttccatggccttttctttttcctttacggatctgtgatcctatgctttctctcacrttcacattatatgtgtcagttggagaaatcttgatgcccagtttcatttgtttcttctgtcccacctgtaactaatttaggttgagttctccggctcatgtatcagagtgtgtatgacaaattatctcaaagcccagagggcctcggtggtccaagtcccagcaacaagggacacctgctgtcatgacatgggcttgacctgggttctgtggacattaaggaaccactgtcctgagaggggggtatggagctaagctaggggagggagcaggatgagcttagagctgccgaggaaacgga

SEQ ID NO: 169412 - DNA, 601 bp, Human
tctgtctttccatggccttttctttttcctttacggatctgtgatcctatgctttctctcacattcacattatatgtgtcagttggagaaatcttgatgcccagtttcatttgtttcttctgtcccacctgtaactaatttaggttgagttctccggctcatgtatcagagtgtgtatgacaaattatctcaaagcccagagggcctcggtggtccaagtcccagcaacaagggacacctgctgtcatgacatgggcttgacctgggttctgtggacattaaggaaccactgtcctgagargggggtatggagctaagctaggggagggagcaggatgagcttagagctgccgaggaaacggaaagagtctataggctttaaaaaagaggagagaaagaaagaagaataaaagatgtttctggagactctgagaatagttaagagtccagggccagccagaatcaccctttcccccagctaccgagagtgccacagaacagaaattgacttggaagatattgctcctagaccaaaagtccaaattaaggggtataggcagttaagggcaagtgagggcagtagagatggttgtccgagtcc

SEQ ID NO: 169413 - DNA, 601 bp, Human
tgtggacattaaggaaccactgtcctgagaggggggtatggagctaagctaggggagggagcaggatgagcttagagctgccgaggaaacggaaagagtctataggctttaaaaaagaggagagaaagaaagaagaataaaagatgtttctggagactctgagaatagttaagagtccagggccagccagaatcaccctttcccccagctaccgagagtgccacagaacagaaattgacttggaagatattgctcctagaccaaaagtccaaattaaggggtataggcagttaagggcaartgagggcagtagagatggttgtccgagtccagtggccatgagaggtttctcagctgcctgccaattctcttctgggacaatgccagccataaagtacaagccatgctttggtgtgggctgtagacatattgttttcccataactactgtcattcaaacaggatctagtttcttggcatgagcaaattgttcccgctgaatacacacactatgtccgctatggggcaaggcaaagcgaatcctccaaggaactggatggatttttcattctgagataagcagtttttttgtgggggcgggg

SEQ ID NO: 169414 - DNA, 601 bp, Human
ttcccatccctgtagaatgacaatggatggggaacgggggtgcagcaggtggagtttaccatcacctactccctgcactcgtctgtgcactagagtcataggcttaaaaaatgtgagacggtttctgctaagacttacttgcaaggtcatgcgacgacgtagcagggttcaagccttggaagagaggactagtgatctgaaatcagaggtctgcctttggagaagtggttgcttgccaggaattagagggcttagtcctgtagaactttactgaataattttacaaatatagtatttttamagtaatacctttttttttctcattgtatcttaatctcatttggctcattcatggtgcacaaatataaaaggtattagaccagatgattgtttaagtctctcctagtcgctgtcactgtctcctaatttggaaggaggtccatcggagactcagatctggtccttcaagagactgtgacttccagccaggtctctccccaagtggctctgaggtttttgaagtgtgttttcaatgcccaagagctgtctatgttcagctgtgtgtgtgcttgtgttgtggagtcgggttcgggacagggaa

SEQ ID NO: 169415 - DNA, 601 bp, Human
tgttcagctgtgtgtgtgcttgtgttgtggagtcgggttcgggacagggaacgtggagcttaaccaggcaaagtgctttacgtctatgaccctgttgaatcagtggaacaaccatttgaggtcgatgctgtcgttattctcattttccacaaaaggaaacagaggcaacagaggttaagcaactcctccaaggtcacagtggctgtcgccatttcattctttatggttggcgggctgaattttctttcttggtggaaacctgcctgccccttcttagtcatccttcttttcctcttcttcwtgacatatttttcccttttcttcccctactcctcaaccacaaacacgcatcagatgaggagcacctcatcataaagcaggttgggggcttcgaatccactctcggtggcccttagatttctcaactggttttccatttgatggctcacattccttcttcaggaagctcaggctgggaatgcatgacactctcctcgcacttggtcattctacagccagtcagggatcctgttggcctgccttctcttggggacccagaatatgggagctgttgctactactgttgcaaccttaacctgtc

SEQ ID NO: 169416 - DNA, 601 bp, Human
gaccctgttgaatcagtggaacaaccatttgaggtcgatgctgtcgttattctcattttccacaaaaggaaacagaggcaacagaggttaagcaactcctccaaggtcacagtggctgtcgccatttcattctttatggttggcgggctgaattttctttcttggtggaaacctgcctgccccttcttagtcatccttcttttcctcttcttcatgacatatttttcccttttcttcccctactcctcaaccacaaacacgcatcagatgaggagcacctcatcataaagcaggttggggscttcgaatccactctcggtggcccttagatttctcaactggttttccatttgatggctcacattccttcttcaggaagctcaggctgggaatgcatgacactctcctcgcacttggtcattctacagccagtcagggatcctgttggcctgccttctcttggggacccagaatatgggagctgttgctactactgttgcaaccttaacctgtcataagaagaaaagctgctttccaagaccagaggaaggctgctggccgtgcagcggtgccttgtggatgggcagggctctgccagggt

SEQ ID NO: 169417 - DNA, 601 bp, Human
gaggtcgatgctgtcgttattctcattttccacaaaaggaaacagaggcaacagaggttaagcaactcctccaaggtcacagtggctgtcgccatttcattctttatggttggcgggctgaattttctttcttggtggaaacctgcctgccccttcttagtcatccttcttttcctcttcttcatgacatatttttcccttttcttcccctactcctcaaccacaaacacgcatcagatgaggagcacctcatcataaagcaggttgggggcttcgaatccactctcggtggcccttagayttctcaactggttttccatttgatggctcacattccttcttcaggaagctcaggctgggaatgcatgacactctcctcgcacttggtcattctacagccagtcagggatcctgttggcctgccttctcttggggacccagaatatgggagctgttgctactactgttgcaaccttaacctgtcataagaagaaaagctgctttccaagaccagaggaaggctgctggccgtgcagcggtgccttgtggatgggcagggctctgccagggttccccccgccaggtctggtcctcagcttcg

SEQ ID NO: 169418 - DNA, 601 bp, Human
taccagccacccagtcattcaaggtagaaactggaccatcagccccctttgatgcttccctctgtcttgcccctgtatttaatcagtcacaaacagatgtccattctacctcctcaatatctttggagcctgtcttttttttcctccacagccactgcctccatctgagttcaagaatcatcatcatccctcccctgtaggaactttctagcttgccatcttggtttacccctgccccatggctagaaaacctgcagggcaccttgatatagaaaaagcatgctccccaaggtcaggagayagagaccatcctggctaacacggtgaaaccccatctctactaaaaaagaaaaaatacaaaaaattagctgggcacggtggttggcacctgtagtcccagctacttgggaggctgaggcaggagaatggcgtgaactcagaaggcggagcttgcagtgagccgagatcataccactgcactccagcctgggcaacagagcgagactctgtctcaaaaaaaaaaaaaagaaaaaaaagcatgctcccctctgagaagacgcatcactgggccaggactttatgcagcccaggggccagattt

SEQ ID NO: 169419 - DNA, 601 bp, Human
gagcctgtcttttttttcctccacagccactgcctccatctgagttcaagaatcatcatcatccctcccctgtaggaactttctagcttgccatcttggtttacccctgccccatggctagaaaacctgcagggcaccttgatatagaaaaagcatgctccccaaggtcaggagatagagaccatcctggctaacacggtgaaaccccatctctactaaaaaagaaaaaatacaaaaaattagctgggcacggtggttggcacctgtagtcccagctacttgggaggctgaggcaggagartggcgtgaactcagaaggcggagcttgcagtgagccgagatcataccactgcactccagcctgggcaacagagcgagactctgtctcaaaaaaaaaaaaaagaaaaaaaagcatgctcccctctgagaagacgcatcactgggccaggactttatgcagcccaggggccagatttccccatcgcttgccacttagctggtgctcatgtgtttgccacactggcttgaccaagtatagtggttcttcttttcagttcattcttcccacagcagtcgggatggatttgtgaaaatgtaaatt

SEQ ID NO: 169420 - DNA, 601 bp, Human
atccctcccctgtaggaactttctagcttgccatcttggtttacccctgccccatggctagaaaacctgcagggcaccttgatatagaaaaagcatgctccccaaggtcaggagatagagaccatcctggctaacacggtgaaaccccatctctactaaaaaagaaaaaatacaaaaaattagctgggcacggtggttggcacctgtagtcccagctacttgggaggctgaggcaggagaatggcgtgaactcagaaggcggagcttgcagtgagccgagatcataccactgcactccagsctgggcaacagagcgagactctgtctcaaaaaaaaaaaaaagaaaaaaaagcatgctcccctctgagaagacgcatcactgggccaggactttatgcagcccaggggccagatttccccatcgcttgccacttagctggtgctcatgtgtttgccacactggcttgaccaagtatagtggttcttcttttcagttcattcttcccacagcagtcgggatggatttgtgaaaatgtaaattggatcatgccccatttctctcagatatcacccccatgcccagtccctcttggtttcccgt

SEQ ID NO: 169421 - DNA, 601 bp, Human
cccaaaaagaggccatgggagggagttcagtgttacatgcagtcaccttttgggttttgtctctattggattattctgttttttgtttctcattggagtctagaaatgtttaatgatacttgatggtacttcctttatccatgtaaaagtatatctaagaacttctgcatatattaacactctgtaatgattaagccaatgtaattagagtattgtatcagcaagagaaatatttttctctagacatagataaatcaaattttttctttcaaatctctgtgcaattgctccaaaatggaartcagttttatgatttcatggattgtcatctccttacaacagcagactaatgaacatgatgatttatgcaaacaaaatatactcatttaagaatatgctcgcattggccgggcacggtggctcatgcctgtaatcccagcactttgggaggccaaggcaggaggatcaccaggtcaggagttcgagactagcctggtcaacatggtgaaaccatgtctctactgaaaatacaaaattagcctggcgtggtggcaggtgcctgtaatcctagctactcaggaggctgaaacaggagaatcgc

SEQ ID NO: 169422 - DNA, 601 bp, Human
gtctgtgagttttggtgtaagctcagtggcaatgttaccctcacctctaggctgctgtaggacacaccccggtctcattttcagtgtctcagcatactttccaatgcttccagtaatggattgtgcaaaacacaaagccaaaagcagatgggacatatgtagataagctgtttcatttttcatccctataatttcctaggtttgatagcacttcaattttctaaccataaaagctgcttctgtgctctttggaaaacacacacacactcatacacacacatacacacacacacacacacactaccaggaagcaggctaaaagaatattacatggggtttttgtgttgttttgcttatttctttccttttaaaagaagtaccttgctgctggaaaagaagtcaaaaaattgctttgaagagtatatttactagagttcagtttacttagggaactgtcgtgttaacaccgaagaatgcattagaatgcatcattctatgatacattatccgagctgaagctgaaacctagccttctgccgagtggtattcctgaagccagtcactcttagaagtgataatgtttatttaccagaactttaaa

SEQ ID NO: 169423 - DNA, 601 bp, Human
aagttattcagcttctccaaatattagtgaccccttgggagaagatgatggtgatacctatcttgtggcgatggctttaagagtaaaagtgtttcctttgttttcctttctccttgttttaaaatgataggaggagggagcacacttatttcaaaactctctgaactggaaggggctgtgttggaaactgtttctaagcttggaatggagcatgtgtcatatttgtcatacagcggagagggaaatgacttctcttatttctcttctctgttatccacccaatagctaggagataaaacayagggctggctaagcctaggagaagcacagcagtattaggctatgagaacctattttgcttaacctctttccggcaaaaggtggagccactgacaccaaaaaagggcaagcaggatgtccagtacctctctccctaacttttcagaccctttgatgccacagaggaagacaggcatatcggcaacatggcctcctccttccatctccctgatggttttgtcttccccattaatacaagcacagttccttttaaatgaacaaaaagtgagacaaatacatccctagaatctgacaagtattt

SEQ ID NO: 169424 - DNA, 601 bp, Human
atgaatggcagggctgaactgtcttcaggaaaatctgaaagcccggaacttattaacatgcttgacacctgcctctatgagggacttctgaagccagagatattctttgtaactgaggtccatctgttgcacagatttttaattcagatattcttccttctcaagccaaggctgagagagcagccaattttgtggaaagatttctttaataagaaatgaataaaactatcaatgctaaataaaatagaccgctgtgaaacttgggttaaatcccacagggaagagtatgtgagattaactgcattatataacaaaaccgcctttaatagctggcacgattctttttgttgttccaagggagaagcagccaagactagaaccaaagcacatgatattattttaaagtgctgcagcctctggaatttttcctcggagagatgtcaggatcccaagtcttcctgtgatttatagttgttttaaacgtttaatactttttacattttcaaagctatatcctctgcttccagcagcctaggggtgtgtttctgttgctttgaaagatgatttccaaatgggaagttttaaaactgtgcaaaaagga

SEQ ID NO: 169425 - DNA, 601 bp, Human
cttgtgcgtatggagagtcagttgttttagcatcacttgttgaagaaactatcctttctccattgaactgcctttgcacctttgtcaaaaggtttccacatgggtgtaaatctatttctgaactttctcctgttttattgatctatttgtctaccttttcactaatacccactgtcaatttctatagctttaggatgtcttaaaatcagggagtgtaattattccagctgcattctttttcaaaattattttggctcttctaaggtcttcacatttctttataaattttagaatcagcttktcaatttctatttttaaaaatatgtttggattttgattggaagtcattttgatcgggagtgattgagctttccagggggatgtgttcatgggaggaaacacatttttatatgtgaacaactggcattttaagacccatacagcatttaaaaaattttccacagccttgctccgaagtttattgaaaacccatctgtgaaaaatagtgttatttgatgccaaaggatacaaggaaaaataaaatgttctaattctggtccttatttcctatgatttcaccttttttttttttttcaatgtc

SEQ ID NO: 169426 - DNA, 601 bp, Human
aaggagattaaaagaatatttattaaggataagcctatgttatttctgcagtcctttataaatatgccccttcacctgcttatttgcaacactaagtaggtactgaactaagtaggtactgaatacttgctaggataatcatctgcaaatcactctattactgactgagctccacagtaatcatgagactaagcaagtgactttaattctcttgactttatctccttcattgaaataagtgagttggtctagaaaaggtcgtgttgaagcctaagtttcacagagatgctttagacaatcyccaaacaatttacagaaatagctaaatttgcccatttctgtatcgttagcacctaaaatgtacttggcaatatagcaggcctcaattaatatttgctaaatcaatatgtctgtcttcagggtgccattgtattttatgtgagattgggcatatttgaattcactaataaaattcttcactgaattctcactttaggcacaaaatttgaaacattgccaggcacattaacctgtgcctggagtcccagctaatcaggaggctgaggcaggagggtcacctgagtctaggacttctgggctg

SEQ ID NO: 169427 - DNA, 601 bp, Human
aagccaaatgggattcccatctgtgaatctgcatggcagcacctcctgtgcttcgtcaggttagttttgcattatgtgcagctgcacggggaatgcagctgctacccaaaatgcaactgctccacaagtgttttaaattactctcttaaacgatacttcttgggatctgcttcctaccagacattgtgctaggggctagctgtgaacaagaaagatacagctctcatcttcctttaactcttagttcactgcggtatatgccacatgctttcatgctgagttaatacctgcttgcaggttmgcgtctttgggtagaccctgtgatcaggctttgcctgcatctgtctgtatcacatgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgat

SEQ ID NO: 169428 - DNA, 601 bp, Human
gtcaggttagttttgcattatgtgcagctgcacggggaatgcagctgctacccaaaatgcaactgctccacaagtgttttaaattactctcttaaacgatacttcttgggatctgcttcctaccagacattgtgctaggggctagctgtgaacaagaaagatacagctctcatcttcctttaactcttagttcactgcggtatatgccacatgctttcatgctgagttaatacctgcttgcaggttagcgtctttgggtagaccctgtgatcaggctttgcctgcatctgtctgtatcacrtgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgatttttttaacttgatgatatcacatttatcccatgacaaatcttgttaggatcat

SEQ ID NO: 169429 - DNA, 601 bp, Human
aatacctgcttgcaggttagcgtctttgggtagaccctgtgatcaggctttgcctgcatctgtctgtatcacatgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattstatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcgtgacatccatacttttttcatttctttg

SEQ ID NO: 169430 - DNA, 601 bp, Human
tttgggtagaccctgtgatcaggctttgcctgcatctgtctgtatcacatgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcgtgacatccatacttttttcatttctttggtcttactgccaagccactcaaca

SEQ ID NO: 169431 - DNA, 601 bp, Human
tcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttayagctttgggaagacagcaaatttaaaagcctgccttctctctctcttcctaggatgctaataagagaactgaaagtttcatttataagattgttgttgagtcacagctttgaaggattttgcttggtaaatttgcgtgacatccatacttttttcatttctttggtcttactgccaagccactcaacacagctgaactccatgaaagaaatatgcttttgatgcctgaagtcagctgccttcttagcgttactgataatcttacccttcttctaggcaggtttggcattaataaggaaaa

SEQ ID NO: 169432 - DNA, 601 bp, Human
acagcattatagccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcktgacatccatacttttttcatttctttggtcttactgccaagccactcaacacagctgaactccatgaaagaaatatgcttttgatgcctgaagtcagctgccttcttagcgttactgataatcttacccttcttctaggcaggtttggcattaataaggaaaacataagtccatcagaattgttattttatagtttataatatgcaattgaagcttcttaatctttctctatactctttattacttagtaaacagcagcaaagataatatcaaggaaccataggccaccttgttttctt

SEQ ID NO: 169433 - DNA, 601 bp, Human
agccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcgtgacatccakacttttttcatttctttggtcttactgccaagccactcaacacagctgaactccatgaaagaaatatgcttttgatgcctgaagtcagctgccttcttagcgttactgataatcttacccttcttctaggcaggtttggcattaataaggaaaacataagtccatcagaattgttattttatagtttataatatgcaattgaagcttcttaatctttctctatactctttattacttagtaaacagcagcaaagataatatcaaggaaccataggccaccttgttttcttcagctttaat

SEQ ID NO: 169434 - DNA, 601 bp, Human
aaggaaaacataagtccatcagaattgttattttatagtttataatatgcaattgaagcttcttaatctttctctatactctttattacttagtaaacagcagcaaagataatatcaaggaaccataggccaccttgttttcttcagctttaatatctgtttacatatttatatatttgatattgaagatgaaactaaagttataagtatttttaaacaattttgaaaattttggagaacaatcatcagtaggaaataattacgtgattaaggagttcattttccctatttagaaaagggrgaagactgaagaatgcaaaatattatgttcacatatacgacttctatataaaggaatcttaaatgtcttttgctaataacctgtgaagaagcagtgttgtcattaatgttgaacttacaatagttatctgagcattttggtaaacagacaaggcacttggaattttgtctctcaacatctgtactctgcttttaacttcaaaaggtagttttgaagtacatgtaatttttgccatctgccactgaatttgtgatttagaaatattagaagcagggccacattatgactttcttgggctgc

SEQ ID NO: 169435 - DNA, 601 bp, Human
attgttattttatagtttataatatgcaattgaagcttcttaatctttctctatactctttattacttagtaaacagcagcaaagataatatcaaggaaccataggccaccttgttttcttcagctttaatatctgtttacatatttatatatttgatattgaagatgaaactaaagttataagtatttttaaacaattttgaaaattttggagaacaatcatcagtaggaaataattacgtgattaaggagttcattttccctatttagaaaagggggaagactgaagaatgcaaaataytatgttcacatatacgacttctatataaaggaatcttaaatgtcttttgctaataacctgtgaagaagcagtgttgtcattaatgttgaacttacaatagttatctgagcattttggtaaacagacaaggcacttggaattttgtctctcaacatctgtactctgcttttaacttcaaaaggtagttttgaagtacatgtaatttttgccatctgccactgaatttgtgatttagaaatattagaagcagggccacattatgactttcttgggctgcaggctcttttgcctttgtggcaa

SEQ ID NO: 169436 - DNA, 601 bp, Human
atgcaaaatattatgttcacatatacgacttctatataaaggaatcttaaatgtcttttgctaataacctgtgaagaagcagtgttgtcattaatgttgaacttacaatagttatctgagcattttggtaaacagacaaggcacttggaattttgtctctcaacatctgtactctgcttttaacttcaaaaggtagttttgaagtacatgtaatttttgccatctgccactgaatttgtgatttagaaatattagaagcagggccacattatgactttcttgggctgcaggctcttttgcstttgtggcaaaacttctcatgactttattgtgttacacaaatgctaagtgttcattataaggaatccaagggatgtagaaaagtaaaaagaaacaaatcataaattctatcatttaaaaataagcctcattaatattaaggaaacgttgtgttagataccaccctaagcatgtttgcagatgggaagatagatggatggagagatagatatgctttcaaagaagagtgatcatatgatacaggctaagtttttatttatatttatttttttgaggtagggtctccctgtgtcactcaggc

SEQ ID NO: 169437 - DNA, 601 bp, Human
gcacttggaattttgtctctcaacatctgtactctgcttttaacttcaaaaggtagttttgaagtacatgtaatttttgccatctgccactgaatttgtgatttagaaatattagaagcagggccacattatgactttcttgggctgcaggctcttttgcctttgtggcaaaacttctcatgactttattgtgttacacaaatgctaagtgttcattataaggaatccaagggatgtagaaaagtaaaaagaaacaaatcataaattctatcatttaaaaataagcctcattaatattaargaaacgttgtgttagataccaccctaagcatgtttgcagatgggaagatagatggatggagagatagatatgctttcaaagaagagtgatcatatgatacaggctaagtttttatttatatttatttttttgaggtagggtctccctgtgtcactcaggctggagtgcagtggcactctcacagctcactgcagcctccacctctcaggcccaagcaatccttccaccctggcctcccaagtagctgagaccacaggcatgcactaccatgcctggctaattttttatttttatttttgt

SEQ ID NO: 169438 - DNA, 601 bp, Human
tatgctttcaaagaagagtgatcatatgatacaggctaagtttttatttatatttatttttttgaggtagggtctccctgtgtcactcaggctggagtgcagtggcactctcacagctcactgcagcctccacctctcaggcccaagcaatccttccaccctggcctcccaagtagctgagaccacaggcatgcactaccatgcctggctaattttttatttttatttttgtacagattgaggggtgtccctatgttgcccaggctagtcttgaactcctgaactcaagcgaccctccccmcttggccttccaaagtgtataggcatgagccactgcctcagctatacacactaatttttaaatgtaaaaaccattacacttaattttacctgattttaactggagaaaactaagtgagaattaaggaattactgaactttgaacaaacattttttcacataaaaatgttattttttccccctctatggttaagtaaagagataagaacttgctggttttcattttgtgttttttttttccaattatgtttttgtggtaggcactgttgctgttcacccagttttcttcctcttctgggat

SEQ ID NO: 169439 - DNA, 601 bp, Human
tgaggggtgtccctatgttgcccaggctagtcttgaactcctgaactcaagcgaccctccccccttggccttccaaagtgtataggcatgagccactgcctcagctatacacactaatttttaaatgtaaaaaccattacacttaattttacctgattttaactggagaaaactaagtgagaattaaggaattactgaactttgaacaaacattttttcacataaaaatgttattttttccccctctatggttaagtaaagagataagaacttgctggttttcattttgtgttttttttttccaattatgtttttgtggtaggcactgttgctgttcacccagttttcttcctcttctgggatataggagaatcatatttgctcagtctcttcaagttagatgtgaccttgtggcttgctttagtcacacaacatgagcagaaacgaccattatggatgaatgcatttaattaccgggtctccagtctcaccctttcttctatcaccttggtgagcctgggtgctcatgttaatgtggtgggcgcataagatcaacacagcacagagtgcagagccggcacgtgaaaggcacagcccttac

SEQ ID NO: 169440 - DNA, 601 bp, Human
gcagtgcagggagtatgagcatgaaatgaactcttgatcggttaggtcactgagacttgggacttgtttttaaccatagattacttaggttatcctgatgctatcattttcatactagacagtatggacttcctttctgccatgataaataaggtcattaagaactttcactctttttccttccttccttccctttagattttagttagttacattgctgttttcacatagtcaagtatataatatttacattctattctataatctagctttgattttgattagttatgttattttcatrtagttgaagtatataatgttatgttcagttgtttaaaattagtttggtttttttcttttttgagacggagtttcgcttttgttacccaggctggactgcagtggcacaatcttagctcaccacaacctctacctcccaggttcaagtgattctcctgcttcagcctcccaagtagctgggactacaggcctgcgccaccacatccggctaattttgtattttcagtagagacggggtttctccatgttggtcaggctagtctcaagctgcccacctcaggtgatccacctgcctcggcct

SEQ ID NO: 169441 - DNA, 601 bp, Human
gcatttgagcatctctttatgtgctcgcttttgtgtttcctctaattcgaatcacctgttcatacctttgttctgtttcctgtggaggttcttacctttgctgttggttttcagaaacaccttacccagcctagatagtgtttcccttattggtcttagacattagccttggtcttagacatcagcttggatcacgtctccttcattgagcagaaatccgtaattttgatataaaaaatttacctttgggagattaattttaaaaaccacttctgaccacaggccataaagatactcctgycttattttccatgaactttatagttttaccttttacctttgggactttatctccatgggatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagggactctccttttagtcagatcttgctttatgtcttttaataaaggcttaaaattttccccatgaagg

SEQ ID NO: 169442 - DNA, 601 bp, Human
aaaaatttacctttgggagattaattttaaaaaccacttctgaccacaggccataaagatactcctgccttattttccatgaactttatagttttaccttttacctttgggactttatctccatgggatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagkgactctccttttagtcagatcttgctttatgtcttttaataaaggcttaaaattttccccatgaaggtcttatacagtctttattaacttcatagatcctttatccttctcattgcttattgtatttttattatgttttgtatttgattattgtaagagtgttgaaatgctgctttgtagttttttgctttaagttgatcttgtatctggcaattttgctcagtcctcttactctaatagattatctgctaatcctgatatttttctatgtattaggtcatattgtctgaaaataatgtt

SEQ ID NO: 169443 - DNA, 601 bp, Human
cctgccttattttccatgaactttatagttttaccttttacctttgggactttatctccatgggatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagggactctccttttagtcagatcttgctttatgtcttttaataaaggcttaaaattttccccatraaggtcttatacagtctttattaacttcatagatcctttatccttctcattgcttattgtatttttattatgttttgtatttgattattgtaagagtgttgaaatgctgctttgtagttttttgctttaagttgatcttgtatctggcaattttgctcagtcctcttactctaatagattatctgctaatcctgatatttttctatgtattaggtcatattgtctgaaaataatgttagttttatctcttccctagaaatgcttattatttataactaactaatttcttttttttttctt

SEQ ID NO: 169444 - DNA, 601 bp, Human
tttcagtgtatttcatactttggtctgttcaagtttctgttttttcctgcaccaatatccaacacttctgagtgtttagaggtcattgttcagcaaactttcactcctcctaccccgtgggaagatttaattccctttcctgttggtgttgggcttggccacatatcttgctttgatcaatggagcattagtggacttgacatgggcagaggacttaaatgtcctcacagcaggatttagccctgtcttctaaaaagcggctgtgctggaacgggacagtctcttcgctcagctttttttyctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgtgtctgctgcacctcttcttagccgttggtc

SEQ ID NO: 169445 - DNA, 601 bp, Human
gttttttcctgcaccaatatccaacacttctgagtgtttagaggtcattgttcagcaaactttcactcctcctaccccgtgggaagatttaattccctttcctgttggtgttgggcttggccacatatcttgctttgatcaatggagcattagtggacttgacatgggcagaggacttaaatgtcctcacagcaggatttagccctgtcttctaaaaagcggctgtgctggaacgggacagtctcttcgctcagcttttttttctagtcccgcacacctgcagcatatgacacttacatcrgtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgtgtctgctgcacctcttcttagccgttggtcttcagcttctcaactgtgcttttgaaccctggagagtt

SEQ ID NO: 169446 - DNA, 601 bp, Human
ctttgatcaatggagcattagtggacttgacatgggcagaggacttaaatgtcctcacagcaggatttagccctgtcttctaaaaagcggctgtgctggaacgggacagtctcttcgctcagcttttttttctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatayctgcttacaacatctcctctcatatcacaaaataactgaagttgagaaaggaatttcatagttaaaaaacttttttgactcttccagcagctatttgtgtgtctgctgcacctcttcttagccgttggtcttcagcttctcaactgtgcttttgaaccctggagagttcccattctcagattacctgtaaggtgatcacatcattgaatgcaaggtgaaaacaggaggttgaccagacaggaccctgggcctgtggactgtccttcactcacagaacccacatccaaccagttattccag

SEQ ID NO: 169447 - DNA, 601 bp, Human
acgggacagtctcttcgctcagcttttttttctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgygtctgctgcacctcttcttagccgttggtcttcagcttctcaactgtgcttttgaaccctggagagttcccattctcagattacctgtaaggtgatcacatcattgaatgcaaggtgaaaacaggaggttgaccagacaggaccctgggcctgtggactgtccttcactcacagaacccacatccaaccagttattccagtgaaagcaataaggaataggtaggaagtactgctgcacagagattcgttagaagacatggctttttttctggaacagatgaagtcaaacagacagctagt

SEQ ID NO: 169448 - DNA, 601 bp, Human
cagcttttttttctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgtgtctgctgcacctcttcttagccgttggtcttcagcttctcaactgtgcttttgaaccctggagagttcccattctcagattacctgtaaggtgatcacatcattgaatgcaaggtgaaaacaggaggttgaccagacaggaccctgggcctgtggactgtccttcactcacagaacccacatccaaccagttattccagtgaaagcaataaggaataggtaggaagtactgctgcacagagattcgttagaagacatggctttttttctggaacagatgaagtcaaacagacagctagtggagatggtgagtcgggaa

SEQ ID NO: 169449 - DNA, 601 bp, Human
tcctccatggcagaagtgttcatggaaagcagcagccaacctaaagttgtagctcagaggtagaacgacacctggttccctataaagtgaggagagtgtcaaaagatacatcagcttgctctgggagagcaaagagcagttctggacagagatgttcacgttataagtatgaacaagatggcagtgagtgtcatgactgttctgtgaaatgctgcagcagaggaatgcaagagaggagcacagcttgttggctgagcacagtggttcacacctgtaatcccaaaactttgggaggctgggkcacgaggatcagttgaggccaggagtttgagaccagcctgggcaacacagcaagaccctgtctctattaaatatatatatatatatttttaataaagaaaagaaaggaacacagcttgcaaaaataaacatacaaccaatctggtctataagaaaacccagtcctagaaaactcaacctcacaagtattttatgctatagaaagactcagcatcaattgagtagaaacaaaaactcaagatgtcatcatgataaaacaacaatgggattcttttaatttttatttttaattgtggtaaaa

SEQ ID NO: 169450 - DNA, 601 bp, Human
agtgaggagagtgtcaaaagatacatcagcttgctctgggagagcaaagagcagttctggacagagatgttcacgttataagtatgaacaagatggcagtgagtgtcatgactgttctgtgaaatgctgcagcagaggaatgcaagagaggagcacagcttgttggctgagcacagtggttcacacctgtaatcccaaaactttgggaggctgggtcacgaggatcagttgaggccaggagtttgagaccagcctgggcaacacagcaagaccctgtctctattaaatatatatatatatatttttaataaagaaaagaaaggaacacagcttgcaaaaataaacatacaaccaatctggtctataagaaaacccagtcctagaaaactcaacctcacaagtattttatgctatagaaagactcagcatcaattgagtagaaacaaaaactcaagatgtcatcatgataaaacaacaatgggattcttttaatttttatttttaattgtggtaaaatgtacataacatagaatttgccattgtaaccatttttaaatgtacaattcagttgtgttaagtaccttcacattgttttataacc

SEQ ID NO: 169451 - DNA, 601 bp, Human
gagataatcccaaggaggggattaaagcaataaggacaatataacagccatggaggagaggcacagccatccagcatatggagcaagaaaagaatgcaaccatgtgacccaggaagattttcccaaaaggaagaaacaactgaatctttggttagaaggttatgccagccaggcacagtggctcacgcctgtagtcccagcactctgggaggctgaggcaggcggatcacaaggtcaggagatcgagaccatcctggctaacacagtgaaaccccatctctactaaaaatacaaaaaaaaattagccaggcatggtagtaggcacctgtagtcccagctgctccggagactgaggcagaagaatggcatgaacccaggaggcagagcttgcagtgagctgagatcacgccactgcactccagcctggatgacagagcgagactccgtctcagaaaaaaagaaggttatgccacatatctgaaagtgcagatgtagaatggataacatataccctggtctaaagtttcagtatttagacctcagacaggaaaagcaagttacacaaaatactggatgactaagttggtatcagaattctcca

SEQ ID NO: 169452 - DNA, 601 bp, Human
cagccatggaggagaggcacagccatccagcatatggagcaagaaaagaatgcaaccatgtgacccaggaagattttcccaaaaggaagaaacaactgaatctttggttagaaggttatgccagccaggcacagtggctcacgcctgtagtcccagcactctgggaggctgaggcaggcggatcacaaggtcaggagatcgagaccatcctggctaacacagtgaaaccccatctctactaaaaatacaaaaaaaaattagccaggcatggtagtaggcacctgtagtcccagctgctccrgagactgaggcagaagaatggcatgaacccaggaggcagagcttgcagtgagctgagatcacgccactgcactccagcctggatgacagagcgagactccgtctcagaaaaaaagaaggttatgccacatatctgaaagtgcagatgtagaatggataacatataccctggtctaaagtttcagtatttagacctcagacaggaaaagcaagttacacaaaatactggatgactaagttggtatcagaattctccacatcagcaacccctaccataaagtacgaacaaggtctacaaact

SEQ ID NO: 169453 - DNA, 601 bp, Human
aggaaaagcaagttacacaaaatactggatgactaagttggtatcagaattctccacatcagcaacccctaccataaagtacgaacaaggtctacaaacttttaagggaaataacattatttaaataatataatttaaaattatgaatataattttatattatactgttaagaatataaaaagataaaaataatataaaattgttctctaaatattaagttattattccagtgaaggcaataagcaggatgccttgacctgaaagaagtcaagagactatggcagtcatgagcattgcttaaaaaaaaaaaaaaaaaaaaaaaacctccctgtgatgaaattgacccaaatgactcaaatcagaagaacagacccaggagtagaaaagccacagatgaagaacagtaacaacagcaacaacaacaaaacactggtgagcattcaaccattacaatgccaccttaggactaaacaatggggcaagggggcatggatgattgttaaagaaatgtataactattaggcatctggcaaaataaaaattatgtaagtgaaaaaaaatcaagtgtgaggaagtggagaggaaatgtaaagtaattat

SEQ ID NO: 169454 - DNA, 601 bp, Human
ccctgtgatgctgatggatgggagtatagtgtactgtgctgtcaaacaaatgtctgaacctagcaaatgactttggatgtttggagtccgtctcaatctctgcacttggctgctgtgagtgcctttcacttcctccattgcgattctcctgcctctgggcctttgcacatgcaattctctcttctcgagatgcgccacgccctgttcctccttcatcacccagctcctcctcctagtgttcagggcttagctttagcctccttcccctggaaggccttccctaatgaagttaggagctcctctgtataaccaaaggcactgctcactggttttgctgggcacatttataaccattcactcaatgtcatgcttcttagcagactggcctcaggcaaataagaatctagttcaggaagtgtaaggtcagatttcctcgttgccccgtctcatacttcctgttcctcttctgggctctgccagaacggtaactccactcttgtggcctctgctatgaacaaaccccgctctcttcccttcctgctaccctatggcctcttaggtttattttgttctcagcagccctcttggctctggcttctgt

SEQ ID NO: 169455 - DNA, 601 bp, Human
tcttagcagactggcctcaggcaaataagaatctagttcaggaagtgtaaggtcagatttcctcgttgccccgtctcatacttcctgttcctcttctgggctctgccagaacggtaactccactcttgtggcctctgctatgaacaaaccccgctctcttcccttcctgctaccctatggcctcttaggtttattttgttctcagcagccctcttggctctggcttctgttagcagctacacgttttctcggtaatatttcaagttcaacctcatcggcgagggtagctgtttggtttagyctttgtcctctagcacgtgcctttcctgcagggaggggcattcccagccttggaacaggccccatcactaaggccacagacagtgccagagggagctggggtctgtgcagccattcttgaattcccccagaatgccttgcctggccttgagtaaaagggatagaagtgaaaaaagcctgttacaaagcagcatgtacgaggtaacccttcatgtgtgttttatatatcaaagaaaatagactagttattatcaatgagtttttctggtgggatttctagttatttttattttgttgcttt

SEQ ID NO: 169456 - DNA, 601 bp, Human
ggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactayacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccac

SEQ ID NO: 169457 - DNA, 601 bp, Human
tgccctcggcagagaagccattgaacctaaagggctccctgccacaccccagcctttgtggccccctgtctccgccccccaccggcaacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagygcaagggaaagtgttgggggtgctacaggcagtttctgggctccagattgcgagactagatggcgggactcagagtcaccaccctggggctgaaccaggcaagcgatacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggg

SEQ ID NO: 169458 - DNA, 601 bp, Human
aacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagtgcaagggaaagtgttgggggtgctacaggcagtttctgggctccagattgcgagactagatggcgggactcagagtcaccaccctsgggctgaaccaggcaagcgatacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtaca

SEQ ID NO: 169459 - DNA, 601 bp, Human
agagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagtgcaagggaaagtgttgggggtgctacaggcagtttctgggctccagattgcgagactagatggcgggactcagagtcaccaccctggggctgaaccaggcaagcgayacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtacaaaatgaatcagagaggaaggg

SEQ ID NO: 169460 - DNA, 601 bp, Human
gggagcctcctttataactggacaaaaatcaaagcgcagaaattaacggctacaggtgttgccattgttttggtacaaaatgaatcagagaggaaggggagaagtcactgcttggaaaatgtgttgatacaggggcacgttggctcccaggtatattaatatgtgtatagaaagacagcttcccccacccccttctttctctgcaaagcacatcttaccaaatattagccctatgagccagggagaaaaaaaccaggaggtcttttgcaaggcttcttagaacggtcacttgctgctgctkctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaattatcgtttcctacttctctgttgaaagacttgaaagtacccccgaaatattactttgtgtcaagctttagacacacttagtctctggggttaatgacaagccagctc

SEQ ID NO: 169461 - DNA, 601 bp, Human
ctttctctgcaaagcacatcttaccaaatattagccctatgagccagggagaaaaaaaccaggaggtcttttgcaaggcttcttagaacggtcacttgctgctgcttctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaatyatcgtttcctacttctctgttgaaagacttgaaagtacccccgaaatattactttgtgtcaagctttagacacacttagtctctggggttaatgacaagccagctcagaggcccacagcaggtaatgagggtgaaagtccaagctttgccatctgacagctgtgtcgatgtgtggagccaaaacatttctcttgactgcgtctctctacctattgggtcctggaagactcagttcccttccaaacccagccagcatcttgaatgcactcaaaatccacgttttggctcaatcaggtgttc

SEQ ID NO: 169462 - DNA, 601 bp, Human
gccagcatcttgaatgcactcaaaatccacgttttggctcaatcaggtgttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttmaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaag

SEQ ID NO: 169463 - DNA, 601 bp, Human
tggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaaygtgtttttgaaaaggcatgctgaattataggtgcctaaaacaggagcaggacttgaaacactctagagggaacctcaatagattccaacagcaattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcc

SEQ ID NO: 169464 - DNA, 601 bp, Human
gatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaatgtgtttttgaaaaggcatgctgaattataggtgcctaaaacaggagcaggacttgaaacactctagagggaacctcaatagattccaacagcrattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtgtactcagctgtttacacactggaccattactttttctg

SEQ ID NO: 169465 - DNA, 601 bp, Human
aatgtttttaattatgcacaagttaatcaatttgacttcctacctttctgaactctcactacccctggcacaccaacgtgatacacagaaagtgtttgtgttcgagtttgtggagtctgattgctccagacttgtttggccaccattgttgggttctggggtcactcgtggtttaaacatggcagccacccctcggtagacattgagggtagtacgttttcctgcagtattggtccacaggactctagatcattctagtttgttctctagttcattctaccctttgtagggggacataccrccttcttccacgcctacataattctaaagcctgacataatttaactgtcatgcagacaaccacagaatgctcacatgctgcccaacagagagcaacccaaggaacatgtgtggagaagtgacatcccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaagga

SEQ ID NO: 169466 - DNA, 601 bp, Human
cccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcwttcaccatatggggcaaggactgtagttatcatgatgattagagatgagaaaattaaggcccagagagcttctgttaggttccatagctggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattg

SEQ ID NO: 169467 - DNA, 601 bp, Human
ttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcattcaccatatggggcaaggactgtagttatcatgatgattagagatgagaaaattaaggcccagagagcttctgttaggttccatagcyggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattgctgtcaaggaaatgggattccccacttataaataaagaaaccaaagcacgaagggttaaataattactacatgcaataatgtgtacatg

SEQ ID NO: 169468 - DNA, 601 bp, Human
tattgtctggattcacgagttaataagtatagaatgaatactactaactacttaactcatagtaaatgttatgtctgtgtttactatcatcaccatcattactactaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactcyctcccacctgagtatgcctcaggcctgccttgatccccactgtctatcttttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaa

SEQ ID NO: 169469 - DNA, 601 bp, Human
aaatgttatgtctgtgtttactatcatcaccatcattactactaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactccctcccacctgagtatgcctcaggcctgccttgatccccactgtctatcttttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaaacagagtctcaccctgtcacctagactggagtgcagtggcatgatcatagcttattgcggcct

SEQ ID NO: 169470 - DNA, 601 bp, Human
gcttcctcaaacatctactccctcccacctgagtatgcctcaggcctgccttgatccccactgtctatcttttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttyttttttttttttttttttaaacagagtctcaccctgtcacctagactggagtgcagtggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactg

SEQ ID NO: 169471 - DNA, 601 bp, Human
ccactgtctatcttttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaaacagagtctcaccctgtcacctagactggagtgcagkggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactgtacatcttaacagcctgtcaccttcggctttggctactaactggcaatgactttctg

SEQ ID NO: 169472 - DNA, 601 bp, Human
atcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcagcaagccagatttggcccacaggtggtggtttgttgactcctgctrttatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtcc

SEQ ID NO: 169473 - DNA, 601 bp, Human
cagcggaagaaggaaaacctgcaggaggctcttgcagtagtccagacaagaaataatgtcaccttggccacgagcagtggtgacaaatatggagagaaacagatggattttgtttattgcaatcattcaactgagggacgttgaagagctgaactgaggttgcagcaatgaggatggagaggaggggtgaagtgaaataggtttttaagacgtggaggaccaattagaggatgagtttaatttttgttgatttttagatgccttgggacatacaggaagacaggaagagttgctaagtagsgagttggcaatgaagttaggagttggggatccactctataaaccttagagtgtgccaggccctgtgtcaggccccacacatccctgtttgggctatatgtgcactgaggggagtagccaggtctggctcatctttctttcccaggcatctatcaggttggctaacacatggtgagtgagccctcagtaagtgtttctagaactggaaaaaaggtactcttcatctggtggagaagatagtgattatagcatggtgagatgagtgcgtccaagaggagttgacactggggctctgttttga

SEQ ID NO: 169474 - DNA, 601 bp, Human
tagaccccctgacagaataatgttttttaatgcatgaaatgaaaacattggattgcaaaatagatgtaatatattaatatatcgatctatcaaaatgttttttcaattaaaggtatagtaatgtatcttaacacattcaatagcaagatatagaggcagtaactaccataatttcaaagtagagatgagcataaatgatactttgagatatctgcaacaactatcaaataatatgaaaatatctgatttcttttggtgacaaagtcacaggttcagtaaatactgctgtggcctgaatccrtgattaaaggaaatgctaagttccagttagagctccctggaataaagatttttttttttcatccagtttcatggattccctgaattctgttcatgaactgtggatatcagtggagccccactctaaccattcatttcagttaccaagtgtttcagaaaccaatgacatgaaatgcaaagtttagcattttatttcaaaactcatttgactggtttattttgacaatagggagtttgttcccatctgtattttacagatcaagtacttggtcaacagcaagtgctccataaataataggtg

SEQ ID NO: 169475 - DNA, 601 bp, Human
ggcaaggaatgggtgtgaagacgtcatcagggatcagctcagggagagtctggggaggcatatggattcaattctcagcattgtgatgggaagccattggagaattttagtcaagggagtaacaggacctgtttcatgttttaaaagatcactttggctactggacagagaataaattgaaagttaaaagggagacaccaagagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagggaagaaaagtctagataaccatttgtcagcacctctgaaaccatgtcacagatttcagtggttcttaacaggggataatgacatttacttaggggatgttgagaaatgttggggagagactttcacagtagtcaacataatagagggcactgctttgtggacaggagtcaggaatgctagaagtcccgcatcacacagga

SEQ ID NO: 169476 - DNA, 601 bp, Human
aagggttccttttcccattcacagggacctgtccatttctgtgtgtttccagcacaaaagaatccatttccattcagccagagcagcccctagagttttcatgaggtccaagcctcctctcctgttttcttccaggctcgctgttgtaataggctgcaaaatcctgactgtggccagggtcctccaggctggtgagaggaacaagcatttgtccacgtcctggtccctgcagctggggaagaactgcagtttagtgtccgctccaacaagttgtgattgtcatttcttaaacagtgacttscttttggttccaagtagcagaaaacgcaaccaacagtggcttaaaccatgacaactattgttaacttagtaaaatgtttaaaagttgaaggtctgcggctcagtggtgtctccaggaacatagaatctcttttctttcccctgcaccaatcttagcatgttgctttgtatccttcatcttgaatctcatggaaacagaacggttgccacgagtctatgcatgatgagatcacacaactgtattccagaggaggaagtgagggaagagggcaaacgggttctcctcaagaggcttctgtta

SEQ ID NO: 169477 - DNA, 601 bp, Human
atttaataaaaataacaggcatggtcagctgatcttacgtttgaacaattctggatttattttaaagcaagatgtgtggcatggttttacttatttttttaatcctaaaggtcatccgacttttctttttctgctcatagtcatgaggcttccttatctaaacagtgatctattgttccaaccttagacccacagagaatttttttccttaacttcaattttcacaggacagctcctcatcttcccatattgcatgaaaagtatctttcaacaagggaaaaagaaactctaatgagctttycctaaatcttcttaaaccgagttcactatagaatattttatgcaaaaacattgccttctcttaggttatgacatcttttccttgaaaagtgatcagggcattggacaaatcctggctagcttatcttgtccttgcagcgcaacctcaacaaagaaatatagatggcactttaaaggcttcagaaatcaatttagtcccataatccatttagtttagatgttaatgaaacttggtgggtttaaaaataatgaatatttaataagacataaattgaaagacataaacactgttggcgataat

SEQ ID NO: 169478 - DNA, 601 bp, Human
ttcattccttttaaacaaaaaagaaaaagacattttggtcgacactctctctgctctgggtttaaagaggggctttatttaatgatcaggaccaagcgtgtgattacatgtgctcagagcctcagacaatttaaatgccttcaggttgggagttagactttttgttttcccctttaaaagcatcagcaccagggccagcccttcaacttggttcctccttagctctgtggctcgatcctaccccatcgtccacaactgtatctttaccttttcaccccctcaactagctaccctgtctttrggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctttggcactcaatacctgttcatacatagta

SEQ ID NO: 169479 - DNA, 601 bp, Human
tcaccccctcaactagctaccctgtctttgggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctytggcactcaatacctgttcatacatagtaaacaggggttttctttggttgggcaggtatggtgattttgcaaggtaatgaaaggttgctcccggggaatctagtctaagagaatatatgtggggcccagaagtgagatcctgcctaggagggcatgagtgacatttcatcagtataatgagaactattgttgttaaaaattattattatttttttgtgcgtttgtgtgcatgttcagaaagaaggggatcaacctgaaagagtccaaccaatcgcatcatctaccttgatccattccgac

SEQ ID NO: 169480 - DNA, 601 bp, Human
tgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctttggcactcaatacctgttcatacatagtaaacaggggttttctttggttgggcaggtatggtgattttgcaaggtaatgaaaggttgctcccggggaatctagtctaagaraatatatgtggggcccagaagtgagatcctgcctaggagggcatgagtgacatttcatcagtataatgagaactattgttgttaaaaattattattatttttttgtgcgtttgtgtgcatgttcagaaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctatt

SEQ ID NO: 169481 - DNA, 601 bp, Human
cagccaagtataagatagtctgcctcccaattcagcggtgggctgtctcttggcactaaagtggaattcagcttcttatatcagctgaggggtgttagatagatggccagctcgctttggcactcaatacctgttcatacatagtaaacaggggttttctttggttgggcaggtatggtgattttgcaaggtaatgaaaggttgctcccggggaatctagtctaagagaatatatgtggggcccagaagtgagatcctgcctaggagggcatgagtgacatttcatcagtataatgagaastattgttgttaaaaattattattatttttttgtgcgtttgtgtgcatgttcagaaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgatattttgtactttaaaaaaacatttttttaatgcttctgggttatacatgagaccaaaccaag

SEQ ID NO: 169482 - DNA, 601 bp, Human
caaatgtcttgcctggagacctcaccttttcactggtgtctgtcttgccttcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacrtctgtagctccaccaacctggtcaggcttattggacccatttgcctggcgggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggca

SEQ ID NO: 169483 - DNA, 601 bp, Human
tcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacgtctgtagctccaccaacctggtcaggcttattggacccatttgcctggcrggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggcaaccagggagtggaccaagctgcagcttcatgctgctgaggaggccgcagc

SEQ ID NO: 169484 - DNA, 601 bp, Human
aagccacctgtgtggcctcgttgtttttttcaaggtttgaataacaaaggcagctttttgttgtttgttttgtgactgctaacatttacacagtgcttcctagatgccaagggactctatatcttctaccgaattcagtcctctccatgacacaatggggcaggcctactattcccattttacagatgagggaatcgaggcccagagaaatgggatgattgttgttcaaggtcacacaggggcagagcagggatttgaacctggaatgacttcagagactgcactaagatcccctatgctrcactgactttgcaacctctgccgcacacattggtactactctctgaggattccgggggcacatgggagacatgcagatagggttccatgccgtggctggggacacatgctcctggggtgagtcagccttcctagaggctcaggaaagagtcccagcttgagaataaggcggaccatctgactgaggaaatacctcactggcgtggtaacttcttgggaattaacacccaccccccaagcccccaataagagagaagttctctcactcaggagaagggtgtgagggatgaacttgagctga

SEQ ID NO: 169485 - DNA, 601 bp, Human
agaagaaagagggcttggatcagccacagcctgactcatcagtttctgagtgatcatgagttgacggcattttgacatgtgccaggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtygtcgggggtgagaggacaacaaagaaaaaattacccctaatcatgtcatgcagaagcaactgctgtcagcattttggattctctatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagatggcatt

SEQ ID NO: 169486 - DNA, 601 bp, Human
aggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtcgtcgggggtgagaggacaacaaagaaaaaattacccctaatcatgtcatgcagaagcaactgctgtcagcattttggattctytatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagatggcattacctccaaaggtaagatttcactgataatctgtgaagaaactaaaggctacagtatgccagtacctttactgtcctccttctc

SEQ ID NO: 169487 - DNA, 601 bp, Human
cagagtcgtcgggggtgagaggacaacaaagaaaaaattacccctaatcatgtcatgcagaagcaactgctgtcagcattttggattctctatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagayggcattacctccaaaggtaagatttcactgataatctgtgaagaaactaaaggctacagtatgccagtacctttactgtcctccttctcttgcctatagacctaagtccctttataagattttggggaaatagaaggaatttagagctcaaagggtcctttgagagcatctaatctgctcttttattttatcggtgtaccgtcccatggtcgtgaggtgagttatgtctagtcacccccgcagttatttccccatcctgcttcttttcggaacatgattgcatgccgggtttttttcagt

SEQ ID NO: 169488 - DNA, 601 bp, Human
cgtgttgcacaatgtatgcatttctgtaaacacacaccgagtctttctccagattatagtacagcctatcatgtggtttggattcctttgagctgactctgttgcccatagaaaattgtccttatttcaaaggcagaattgcatattttgagcttttccaggtggtaaagtaagtaataacagaatatgcatgaaatttgaaatttgtaactttatgcatgcccattaaccttcgtgtaagcataaaagataagaaggcaatgggcaaggaagaataatcgctaacatttctgagctcttmctgtgtgctgggcattagaaccagcatctgcacgggttaactggtttaatccttaccagtcaatactctcaccatccccactttataaatgaaaaaacctgaggcctcgagaggttaggtatctttttcaaggtgctctgaaccaaaataatctgtcccagagcccgagcttctatcccccaactaaactgcattaactcttacagagcttagtagagtttgagagctggtttttgttatatttctttctaatactggggtataagggttgataccaagatgcagatgtttgaggtttca

SEQ ID NO: 169489 - DNA, 601 bp, Human
tatttctttctaatactggggtataagggttgataccaagatgcagatgtttgaggtttcataagaaggggccgagaaccctgtggtttagtttgttcctatttggggatggcttcctggcaacccagctgagtgcagagcccgctcctctctgagctgcgcgtagtccacgggggtctctgaatctcctttggggccccagctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggctcagactggttacctatgtggccctctactcccacttaatggctttcttttgtttatttttttttcttttttgagccaaggtctggctctgttgcccaggctggagtgcagtggtgcagtctcggctcactacaacctctgtctcccaggcttaagcgatcctcccacctcagcctcttgagtagctgggactacagacc

SEQ ID NO: 169490 - DNA, 601 bp, Human
caactggttagccccacagagtgaggcataggaaattaaatttggcataaaatattatagctttttgaacacccgtggcttttccatctcatggtaatcgtaaagaaaaaaaaatagttttttgtttaatttttctcccccctcattttcctcaccatgatatccttcctgtgggtgatcttgaacctgtcttacaattgtatggtgttgaaatctccactcagttaatttcagcagtgtagttgggagttttatatgcaacaaaaatcccaaggctcgttaatagtctaccatgaggctkcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaaatggattaatcagcgataaagacacttcagata

SEQ ID NO: 169491 - DNA, 601 bp, Human
cccaaggctcgttaatagtctaccatgaggcttcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaartggattaatcagcgataaagacacttcagatagtgctatgaagaaaatacagtgatgggtagagagtgacagaggtgttcagcggagaagtgatcagggaaggcttctcagaggaggtgatgttggagacttgaaagataaaggagtatacaagcatacacatggagaaggttcagattgacttcagattagatctatattaaggtcgtatcctggaagataaaaatccacatcgtgcccaaggattgtgtgtgtgaattggatgagatttctcttatgcaaaattcaacccgttttggg

SEQ ID NO: 169492 - DNA, 601 bp, Human
actgctttccagaaccagatcaactgaatctgagctgattaatacagctaatgaattagagacggcaaatcctggcaagcccataccttggtcagtgcctgtcccttggctccacttacaggattctgtagagcagtgttggccaagagaactttctgtagtgatagaaatgttctacatctgtactctccagtatggtagccagtcaccttaggtagctagtgaacacttgaaatgttgctagtgtttttaattaaatgtaaatttttaattaaatttaaatagccattatgtggctagyggctgtcatatttgatagtgcagctataaagtcgttttaaaatgacttgagacacacacctttcccacctcccttaggacctaactgcttctgttttaaaaagagcttttaagaagtcatatttcatatgtttggttagtgagattgacttttacaaagctgctgctgaatttgatgagcagtccaagggcttcaagtgagccactatttgcaccaaatccacctgggcttggcccaagcagatgatggaaggaagtcactgatcgcagggcaaagctagactcgggcccaggtcctgga

SEQ ID NO: 169493 - DNA, 601 bp, Human
aatttttgccaccctgctattcaaagtgttgaatagaggccggaagtggtggctcacacctgttaccccagcactttgggaggctgaggcgggtggatcacgaggtcaggagatcaaaaccatcctggccaacgtagtgaaaccccatctctactaaaaaaaattagctgggtgtggtgcatctatagtcccagctacttgggaggctgaggcagtggaattgcttgaacctgggaggcggaggttgcagtgagccaagatcatgccaatgcattccagcctggcgacagagcgagattcygtctcaaaaaaaaaaaaaagtattaaatagaaatcatgtttctctttttgaaaaaaaaaaataggttattcttggtgagaatttgacttcaaattgtccagaggttatctatgaaattaaagaagagacacctgttttctacaaactcgttcctgatcctgtgaagaatatctacatttatctaacagctgggaaagaggtaggtagaaatactagttattgcttctgatttatgaataaaaatggtttaattgatgtcattatctagtagcaaagcttttactttgaactacagagttt

SEQ ID NO: 169494 - DNA, 601 bp, Human
aacttcctggcataatgagttccacaagttcccttactacctgctgtgtggttttgcctgcagaaagtgctctgtgtgatgctcagttactccctgcctctcaccgccctacttgcaggctctgactggctgcctagatgtctgggtctgcccagctggggtgccctctttgtgggctgctgtttcctgacaatggcaagaggcagctctagggatggggaaatgatttgactactccccctgtttcttttattttcaactccactggaggggtgtgagcaaaacaagccaggagctgagrtgacggcgctgcccctggcaggggtgtgggagggcctcgtccctggtcctcctcgtttccacattgagtgccaaactcctgctgacactcctggggcagagcctttgttattccctaatactcatttccaaaatgccattggccacatatggactgtctctgtatgaaaaccaggcaacctgattccatgatccgtatggaaatcatcattagcagatcggaaacccaactgggtgtcagactcacctgagagagagctcttaaaatacagattcctggccagacacagtggtgcacgcc

SEQ ID NO: 169495 - DNA, 601 bp, Human
gcctcgttattgatggcgccgtctcctaatgcgccgcgcagctgtgggcctgatgtacaatctcagtctccgggcagaatctgcccagcctggtctggaatgacgatgctcacgacccatctaggctcaggggcgactcggagcggcttccccgccatggcagtttcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagacagccaagagaaatgaagggagagggggaaatgcaatacaagcaagaggtttaggaaacaaatcaaaaatacggggatggaattaattaagagttcacgggggaaggcgcaatccgagctgcagcaagaggaata

SEQ ID NO: 169496 - DNA, 601 bp, Human
tcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagrcagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggatttgtttgttgcacactcagtgagcagtcttgccataatcttttaga

SEQ ID NO: 169497 - DNA, 601 bp, Human
ggtttagaaaagagcaggaggaagagaattggtgactgaagggggagacagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggrtttgtttgttgcacactcagtgagcagtcttgccataatcttttagatccattcatttatgtagcatccctgtctgtatttgtagagctgtgtacaggagtcaattcgataatggtggcgatgatggtggtgattaaatagccacatggagctagcggctaacgtattaacaagctcagctctggagcttttgggagatctccaagctggtgatatgaatttgggagttggtagtattttagatggtacttagagaagccttaagaccagacgaaggagtgagtgttgattgaggagaga

SEQ ID NO: 169498 - DNA, 601 bp, Human
tattttagatggtacttagagaagccttaagaccagacgaaggagtgagtgttgattgaggagagaagtttgagaactgggccttgaggggctgtggtgtttaggggttggggagaaggaggggaaacagaacaagaaataaggagggagcagtcagaaggggaagaggaaaaactggagagggtggtctcctggaagccaaggaaagaaaggaggaggaagtgatccactgggtcagattcagctgagaggtcaagcaggagaagaaaagaatggatcctttgcacttagcaggtgacartgggtgactgctgggaatgccatggttaggagtggcgctaaatccacaagagacaatgggaaaataagaccttaagaagggacagcttagagaagctttactgagaaaggcagctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctc

SEQ ID NO: 169499 - DNA, 601 bp, Human
ctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcagrtgatccgcctgcctcagcctcccaaattgccaggattacagccgtgagccaccacgcccagccagttttgtctttttaagatgcatgaaataacagtgcatgtctgcactgttgggaaaattccagaagagaaggagaaatggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagca

SEQ ID NO: 169500 - DNA, 601 bp, Human
tttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcaggtgatccgcctgcctcagcctcccaaattgccaggattacagccgtgagccaccaygcccagccagttttgtctttttaagatgcatgaaataacagtgcatgtctgcactgttgggaaaattccagaagagaaggagaaatggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttc

SEQ ID NO: 169501 - DNA, 601 bp, Human
caacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcaggtgatccgcctgcctcagcctcccaaattgccaggattacagccgtgagccaccacgcccagccagttttgtctttttaagatgcatgaaataacagtgcatgtctgcactgttgggaaaattccagaagagaaggagaaayggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaaga

SEQ ID NO: 169502 - DNA, 601 bp, Human
ggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttsaagttgagtttaaagattgttaggggcaggcgcggtgactcacgcctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccc

SEQ ID NO: 169503 - DNA, 601 bp, Human
ctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttgaagttgagtttaaagattgttaggggcaggcgcggtgactcacrcctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaattgttggaactagagaattggaaag

SEQ ID NO: 169504 - DNA, 601 bp, Human
ttcatttaaaatccaaatcagattatgtcactccccagcttaataccctcccctggctttccatcttagaactcagtctgactcccttgctgccagggcctgcataccaggctttccgtgatctggcctttcaccacttctctgacctctcatgccattctctcctttgtttacttaaccccagacatcctgatttaagactatgctaagcatgttcctgccccagggcctttgcatgtgctgtttcctcagtctagtacattcttccccacatctttctatggcagactctttcttgackgtctggtcctagagcacacatctctctgcacctgcctacccagtcttcagtagcctccccttactcacagtgacattactgttttattttcttcatggcccatcactattaggaatgaccttacttctctacctctctttattgaaatgtgctcagaaaaacataagttaaatgaatgagataggctgagtgattggtcgactctgccaatagcaggttaagacttgtgccttaaatcttataagacattctgaagtcatggagcgatggcccttcacagccatgtcagaaaccacttgg

SEQ ID NO: 169505 - DNA, 601 bp, Human
ccttttgatcagatgttaagaataggcatccagactgggcatggtggctcacgcctgtaatcccagcactttgggaggctgaggtaggtggatcacctgagatcaagagttcaacaccagcctggccaacatggtgaaaccctgtctctactaaaaatacaaaaattagccaggtgtggtggtgcatgcctgtaatcccagcaacacgggaggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgtgctgaatttgtctgtgtgggtggaaagtgaatttttgcaggctgaatatcttgggtttggaagcagtttctcagtttctcccatattgcaaagcatagcacatgtgttcagttatggatttccacaaaactggcaatcccgaaccaatgaatgggtgaggttccaaaagttcatttgcaagtttgtttgg

SEQ ID NO: 169506 - DNA, 601 bp, Human
ctgaggttgggaaaggcttcaacgaggaggtggccttaaaattggccttgaagcctgggtagaccttcaccaggggaagagtggtcgggaggcatttcaggcagaagaatcagcgcagtgagaggtctgtggagagactggcagatggagttctatgcactggctgtagaaggaaggaagtgggtggagatgctgggtgggctctcagggtggaccttactagcgggtgctgggaactcatgacagggttttaagcagaggccttccagcgccatatttgtgttttaaaaagattatcccrctggcagtgtggaagatgaaccacgttaatccaagtctctcccggcctcccaccccacccttcctgggtcactttcctctggtgtgttttgtaaagagagagtttatgtcacatctcgtcctgagtcagttacttggtggctattctccgaattcatgtacctccccactgggagaggtagtacgtctcccagtgcatccatggggccccacttgctctggttttagtgccatgatggaatcagggctgggtcctcttcagaaaatgggccctacaggaaagagcacacttgcattcacc

SEQ ID NO: 169507 - DNA, 601 bp, Human
acaaagaccctatttctacataaggtcacgttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgcyttcatgggctattgcactattgagtggaatggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcc

SEQ ID NO: 169508 - DNA, 601 bp, Human
ttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgccttcatgggctattgcactattgagtggaayggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcctcagggaattactgaattaccgttgtgtgg

SEQ ID NO: 169509 - DNA, 601 bp, Human
tgctcagaagccaggcttttttgtttgtttgtttgtttggttggttggtttttttagatggagtctcattctgttgtcaggctggagtgcaatggcacaatctcggctcactgcaacctccacctcccaggtccaaatgattcttctgcctcagcctcctgagaagctgggactgactacaggcgcgtgccaccatgctcgcctaatttttgtatttttagtagagatggggtttcaccatgttggccagtatggtctctatctcttgacctcgtgatccccctaccttggcctcccaaaytgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaaatgaccttatctcaggcagcatgcactttcataagaatgtattgattggcctttaaatattcctcaaatgttttcacttgtctctgtgacctaatatt

SEQ ID NO: 169510 - DNA, 601 bp, Human
taatttttgtatttttagtagagatggggtttcaccatgttggccagtatggtctctatctcttgacctcgtgatccccctaccttggcctcccaaactgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaartgaccttatctcaggcagcatgcactttcataagaatgtattgattggcctttaaatattcctcaaatgttttcacttgtctctgtgacctaatatttgtcctgttcccagcatctcctccatatccaaacacaatgttcaggtcttcattcgaagccttcctgccagtcttttgttttttgctttttaaacattttgatgcttttattctgctatatggagggtgcactgtttctgataggccaaatgtgggatttgatattgctttcaggaggatcgggttttaatatcattgccacc

SEQ ID NO: 169511 - DNA, 601 bp, Human
gtgcactgtttctgataggccaaatgtgggatttgatattgctttcaggaggatcgggttttaatatcattgccacctgtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcatygcccacaaaagaaccacatggagcaaaggccacaaacccattttgtgtgagtgtttcagtctgcaaatgtgttttttatgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaaca

SEQ ID NO: 169512 - DNA, 601 bp, Human
gtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcattgcccacaaaagaaccacatggagcaaaggccacaaacccattttgtgtgagtgtttcagtctgcaaatgtgttttttrtgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctct

SEQ ID NO: 169513 - DNA, 601 bp, Human
cctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctctaatagctggtactcaaggtatgaaaggactccaaagaaccctttaatatttaggaggaaacagagytgtgattaagaatcccccaagaagcctcgaattgtgtctgcctccttacatagaaaaggcatgttgggcattgagctggtgtgtgagcaatgccaaagggcatctggtcaacctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaact

SEQ ID NO: 169514 - DNA, 601 bp, Human
tacttttttttttttttttttttttttttttttgagacagagtcttgctctgtcacccaggctggagtgcagtggcatgatctcgactcactgcaggctctgcctccagttcaagcaattctcgtgcctcagcttcccgagtagctgggattacaggaatgcaccacctcgcccagctaattttttgtatttttattagagacagggtttcaccaggttggccaggatggtcttgagctcctggcctcaagtgatctggcctcccaaagtgctgggattacaggcataagccactagcacyggcctcttcctactactcttgacccgactacatggttctcacccttgaatgcttagctgaaatgccatctttcttcactagcctgtctaaagtgggttcctttctactatatctttggtttctgcagaagacgtacctcaatttgaaattattttaaatgattgtctgtttatttggtttttgtctatgtgcttctctggactgtaagctcaataagagaaggaacttaactggcttatccatggaagtgtctgcagttcctagtggagtgtttggcatctgatgggctctcagttaata

SEQ ID NO: 169515 - DNA, 601 bp, Human
tatgctgtgtagagtaggagcatgtgtaaatgtcatggagacacagaggagggagtgactgctttgcctggagtctgagcaaacatcatagaggaagacactgaaatagcccttgaacaaggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagayagactcatcaaccaaacttacctggggatgagtttgaagaggaaggcaggggccagatcacagtgttggggtcagagatgggcatggaaacatgtattgcagactgaggtgctgaaaggcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagagg

SEQ ID NO: 169516 - DNA, 601 bp, Human
aggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagatagactcatcaaccaaacttacctggggatgagtttgaagaggaaggcaggggccagatcacagtgttggggtcagagatgggcatggaaacatgtattgcagactgaggtgctgaaagkcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccgtgaggattattgctc

SEQ ID NO: 169517 - DNA, 601 bp, Human
ctgaggtgctgaaaggcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccrtgaggattattgctcattaaaccagaccaggtagtggttcccaacatgtgtgactagaatttctcatccctcagaacatccttcaacaaaaaagctggaagatggtacatcattcattcttgtctcagaaagttacaaagcacagtggcatctacaaggctctgagaagtcctgcagcagagagacttgtttaattttatttaactagtgtttcccaagcttcttggcaatagaaccctactttaatattaacaccaaaacaaatccaggaacacagtttgaaaaatgctgagaaattga

SEQ ID NO: 169518 - DNA, 601 bp, Human
ttctgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagaytgactttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgc

SEQ ID NO: 169519 - DNA, 601 bp, Human
tgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagactgrctttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctct

SEQ ID NO: 169520 - DNA, 601 bp, Human
ctattaagtggtggttaggatctataggaaggcatgaagccagggggccaagtttgtgggctctgaaatcagacttctgccacttggcagctatgtggccttgatatgttactgtacttctctgagcttctgtttcatccgtaaagagtgaggttgttgtgagaactaactgcaaacactcccatcagtgcctggcacacagtaatgtttcctccatgccagtctgtggtggggtaattattcagggatattatgggttacacatatttctatgaacccaggaagcaaacccactgtatakaaagactttctaagttttcaaacagtgaacttagaaacaagtgtctgggaccttcctgtttatgacttggggccggagtaggtttggaactttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtcttttt

SEQ ID NO: 169521 - DNA, 601 bp, Human
ttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtctttttaaattaactttttggtttgggggattttttttttttccttcaggcaatcttttctttgcatttgggcaggttctgtattctaatttgcaaayaggcttgtgtctgcctgcaggctttatcatgaaagtattagctctaagtggaaataaggactagaaaaataaaatactgactgggagtctgaggactttgggatagatcctcagtagaggatggagcaaaagtaatagtaagtcaagaaagcaaatatatctctaccagtttccctagaatatgtccattcttatccaaatccaattttcctcctattcttggcctgaagaaattgaaatgaagccattaagatatcagcctatctgagagtgcatcactgaagaatcagcctcactaag

SEQ ID NO: 169522 - DNA, 601 bp, Human
tataagatctgctctgtaagaaatgtaaatgtatgagtaatatgctgtcatgaagattttataatctgcagtatttgagaagtaataagatactgttgttggctggccatctggttatacatacttggtgtcatggtttgctttttattttttcattttttatttgtactggtgagaggcaaagaataggagttcagaggtggtgggttgtttttttatatatatataaaaacaaggaatttatgtttagttgcttaacatggttagattttgtttttgccttatgcagaataaaaaatgraaggttcattttatactttcttttccctttttttttcaaaaagtaaaatggaaacctcacccccaatttgtccccagatttaaactttttgcttgttttaaaaatagtctctttggcatgaggaggagtcagacatgaattaaaactctagaaagaaaaatcagcaacagaaaagacctatagagatttcatatttcatcctttcattcaaaaatatttattgaaaccctagtatttgcatatcatgctgccagacactgagggatttgctaaagaaatattaaagaccttctcccttct

SEQ ID NO: 169523 - DNA, 601 bp, Human
acacttgtttttttggcagccttaggctttgactcccaggcagcattaagagccaacaaaaatatttgtactccagtctcttcggaattggcttatttttttttttcttataggcagaggaagtgccttacacaaaccggagtgcccatgagaggcagggagtttttgacagtcatgatctatttcagatacaaccgaaagaaccagcttcgtcattctgtttttcaatccagcagtgcttgtctctccgttgcaaactctctctgacattgacaggcggtttaatttgaacttaatgtcyttgacggatgagctagccatcaagggtcagataaatttatggctttggagaattgccgatgaaaatccccatggttataatgttggagaagaaactgacacagatgtagtgggaggtggaacacagatgtgcttattgggagcagggttccccaaatgtcagaagccggtgacatgctaaaggtattgtgcttggggatgacgtttagtgaaactcactgacttcctgttctatttttgccatattcaaattaacacagagctcaaagatgaagccatgaggcctaaattcttaagaatt

SEQ ID NO: 169524 - DNA, 601 bp, Human
gagctgttctttgctaggcatttctaaaagggagctccctatttcagaatccatgggaggatgtgtttcagatatatttggcgatgtcatcttgagagatggctcaggagtcgaagttcaccatgttgtctacatttgttctttgctcctagacatgatggaaaaaaatgctctgctgttttcttgttgcttttcatggttttagcatcatgttcctattctcgctcaaatcaataatccactgtacaaagtctggcattttgtactgaagccaagtataagaaagttttaactaatgcaygtatggggtcgctgttttaactaacacacgtatggggtcgctgttttgttgcctcgtttttttaggtgcacttttcaaggagattgtgtacattcagagaacttagaaaactggctggatatttcgtctggagcaaaaaagtgccctaaaattcagataattcgaagcagtaaagaaaaggtaagaggaaagattttaatttgtcctcgttgtattgtctcattttgcacagcggatgctaaatttcttctgtgtgtaaaatatccattagcaatcaaacatgcttagtgatagcactcc

SEQ ID NO: 169525 - DNA, 601 bp, Human
cttacgatgatttaacatttaataaaggagagccaaagtatttaatgagtgataaataataaaataatcaagcttctaagttgtaactgatcagaacgaacagatttaaagttatttggctgttgtcactttctgttgtcttcctggagaaaaaaaataataataataactttcatacaaacttctaccagtcctgaatcagagtgaatagatttggtggaaaagattcttaggcatctaaacataggtatatccaaattctaatttctctcatcagtctgaaaaatagccaaatttggcrctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacaaccactggtgttttcttcctcgccc

SEQ ID NO: 169526 - DNA, 601 bp, Human
agtctgaaaaatagccaaatttggcgctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacraccactggtgttttcttcctcgccctaagtcccactgtggtttaccctaatcttcccagagacttcccacacagccactgcctcactctctccagctcaccaccactctcaaagaagataagaagttcgtaatttgactaaagctatcctttgaaaccaacttcggactaattattttaatagtgttgataagccatctgattctatctcttgatcacattatttcaaaatatttcctaccctattgccacctttggcttacctgaaaatctcaggtctttgtttaaataaacctgaccc

SEQ ID NO: 169527 - DNA, 601 bp, Human
ttgcaaaaattttctcccgttctgtaggttgcctgttcactctgatggtagtttcttttgccgtgcagaagctctttagtttaattagatcccatttgtctgttttggcttttgttgccattgcttttggtgttttagacatgaagtctttgcccatgcctatgtcctgaatggtattgcctaggttttcttctagggtttttatggttttaggtctaacatttaagtctttaatccatcttgaattaattttttgtatcaggtgtaaggaagggatccagtttccgctttctacattttktttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaac

SEQ ID NO: 169528 - DNA, 601 bp, Human
gggtttttatggttttaggtctaacatttaagtctttaatccatcttgaattaattttttgtatcaggtgtaaggaagggatccagtttccgctttctacattttttttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcytagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcat

SEQ ID NO: 169529 - DNA, 601 bp, Human
aacatttaagtctttaatccatcttgaattaattttttgtatcaggtgtaaggaagggatccagtttccgctttctacattttttttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcataagtgaccatgcccatcctaga

SEQ ID NO: 169530 - DNA, 601 bp, Human
atcgctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactsagctataaacttaaagagcaaggtacatatcctgcattaaaaccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctggga

SEQ ID NO: 169531 - DNA, 601 bp, Human
ctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactgagcyataaacttaaagagcaaggtacatatcctgcattaaaaccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattac

SEQ ID NO: 169532 - DNA, 601 bp, Human
gcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactgagctataaacttaaagagcaaggtacatatcctgcattaaarccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattacaggtgcccaccaccaagcctggctaattttttatattt

SEQ ID NO: 169533 - DNA, 601 bp, Human
aataagagttaacttggccaggcatggtggctcatgcctgtaatcccagcagtttggggactgaggcgggcagatcacctgaaggtcaggagtttgagaccagcctggccaacctggtgaaacactgtctctactacaaatacaaaaaaattagccaggcgtggtggcaggtgtctgtaatcccagctactcgggaggctgaggcaggagaatcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaatacaccaaaaagtaagtgggccaaaacacatatattctcacaagaggagattcagaaagtagatataaatatggaaatatgttcaacctcactagttttcaaataaatacaaattaaagcgataataagctatgctaacacccagtgttggtgatgccaattagcacaacctttttggaaagcaatttgg

SEQ ID NO: 169534 - DNA, 601 bp, Human
gggtttcttaggacgaagcttcagctttttaactgtactcgcctggaccccaagttacgcaaaaataccttcacctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcaygcccactccatgctctcctccttctctgtggccaggcctcaattcccttgctgggccttgctggtcccttccctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatac

SEQ ID NO: 169535 - DNA, 601 bp, Human
acctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcacgcccactccatgctctcctccttctctgtggccaggcctcaattcccttgctgggccttgctggtcccttcyctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatacacctaaagctgaagtcttgaatcttctacccatctgcctctccatcagtatgccccatctccatgtatggta

SEQ ID NO: 169536 - DNA, 601 bp, Human
gagggcaaggaccatagctgtttggttcactggtatattcagtacattgtgcagcacttggcacatgttgcaagcttgatgaacatttatggaataaataaatggaataattatagttatgtaaaagctacatatgtgagaactagaaggaaatgtggaaactttaaaagagttggtgaaaatgtgatttttaaaaattctgatactcttgttataacgtttgagtgtgaattcaatttaagacatatatgtatacaagataagatgtgtggtgcggatataaatgctgcgttgaagattsagcatgaatgagagttcaggcatttgttgaagatgagttagtgggaatggtttgggatctttcactgtgctcagaattccctaaagataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacag

SEQ ID NO: 169537 - DNA, 601 bp, Human
ataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacagagagctgccaggttgtctagactatggctcttcatagggggtgataaggttaccacttcctgcactcccaggttccttttacttagygctcattcccatcagatcccatcatgcgcctgatgcaaaaggagtccactgttggcatgttaattcctataatttcccttctgaacaggacacctggctgccttgttcctttggaccatttccttgggaaaaagttactttggggacatttcaagattgtctttttgtgtccctactatacacacacacacacacacgtacaggcacacagatgtatccctgtacacatacaaacatacacacacaaaaacactccctccacccaattttgatcatatgtttgaccacaagcaaaacctt

SEQ ID NO: 169538 - DNA, 601 bp, Human
tgggaagcactttatagccgagacaagaaaccctgtatttgattactcaaaagcacattgtgtaagggtaaaagatgccacaagcaaaagttacaagacaaacaatagattaggagaaaaatatgtgtcagaaatatgacagataaagattaatatctacaccatacagagagctcttgaaaattgataagaaaaatatacacacaaagcagaaaaatggtcaaagaataagaatatgctctttacagaagagcaaaccaaatagccaacaaaacatctattcttttatatttttatttatttatttatttatttatttatttatttatttatttatggaggcagtgtcttgctctgtcacccagaaacatctattctttacatcagctcttctgagaaattctccctcctgtggcaggtcaaagggtgagatcatatgaggctctatgatggatggaaatgaggcaaaaatcatcattttttccccatatcttccccgcacagactacagtgactatggtgggaagcttctctccaagacactcaaagtgcatggtgaagaatgtggactctagcagggagctctgccagaataaaagtc

SEQ ID NO: 169539 - DNA, 601 bp, Human
tgcattcatacatccatccaggaagtatttactgaacatctactatatgtgaggcactatgctaggtactagggatacagtgactcccccttgcccctaaaaaaaagactgtacactgggatagagagaagtaagtagctcattacaatgcagtgtgtaaatacagggaacatagagtaccatgagaagcacatgaaaaatgtaccttaccagacatggtggagggggaaggggtaaggaaagcttcctggaggaagtgatgtccagacaaggtgagggtagagttgagccagacaaagasgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaaacactgaaaggtttaagccggaggctggcagcacaatcagatttttattacagaaaggttccattgtgcattgtctgtctttcctgc

SEQ ID NO: 169540 - DNA, 601 bp, Human
acatggtggagggggaaggggtaaggaaagcttcctggaggaagtgatgtccagacaaggtgagggtagagttgagccagacaaagacgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaracactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaatagtatctggcacaacgtaggcattcacaatcaataaatgtttcttgaatgaatgaatggcttgaaggtggagaatggaccaaagaagggaaagactgaaagactgagttccaaaagatcacttggaggggtccaagtgagagggaaagtg

SEQ ID NO: 169541 - DNA, 601 bp, Human
atttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaayagtatctggcacaacgtaggcattcacaatcaataaatgtttcttgaatgaatgaatggcttgaaggtggagaatggaccaaagaagggaaagactgaaagactgagttccaaaagatcacttggaggggtccaagtgagagggaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagac

SEQ ID NO: 169542 - DNA, 601 bp, Human
ggccttgtgaaccgtgaatcctgcgagctgtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaatagtatctggcacaacgtaggcattcacaatcaataaatgtttcttgaatgaatgaatggcttgaaggtggagaatggaccaaagaagggaaagactgaaagactgagttccaamagatcacttggaggggtccaagtgagagggaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattct

SEQ ID NO: 169543 - DNA, 601 bp, Human
gtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaatagtatctggcacaacgtaggcattcacaatcaataaatgtttcttgaatgaatgaatggcttgaaggtggagaatggaccaaagaagggaaagactgaaagactgagttccaaaagatcacttggaggggtccaagtgagagrgaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattctggctgctataacaaaataccttagactgg

SEQ ID NO: 169544 - DNA, 601 bp, Human
ggtattagattccaacttatgaatttaggggagacataaatattctgaccatagcacccaattgatcctaaatccttcaaaaggcaatttaatgcaccaggccagagaagtgagcttaaaaatgctctcagccactgggtggtggctgtttgggtctgattgcttggaaaatcacctcaattttccactttactttgtccacactgtgcagcctttgtgatgcatttctggttaattttgttcattaaaacgcagaccttgctcacctataaaatatgcctctaaagtatttgagatcacyttgtaaagctagttggttgcttttagcgcctccatccgttgcacccaacccttcacctgccgttttctgaatatcttacatattctgaacgggcaaacaaatttgcttcccagcctcttgtactcagccagccggtgaccattgccaagcctttatccatggccttctttaaacctagaatggcttccccctttcacaaaatcctgtctccctttctgctttgaaacattggagaaaagtcacctcttccacatgcccttgccagattctgctctgactttctcagccattctaacaccc

SEQ ID NO: 169545 - DNA, 601 bp, Human
tttctgaaggtgcaggatttctaatgctccggttttcatgttctaggcacttcttgctcggtgacttgttttgttcttatgccttggccaattaaaagctgagatagtgatccctaggagagtatgagatgtaaatgagctgtaaaatggcttcttcctagtgattattcatgggaggcttggaactcgaggtgggttcagtctgtttggaggcttgagctgtgcacttcggctgcctgatgcgaatggcctatggggaaggaaccacatactgattgaaatgttagcaaacagctggcaygctcctgcccactatgcagaggaagcaaaaatatttatctttttttgcatttacagctatgcttgactatagcaggactccaccgtaaatgacattttccccccttccctccagatgtttcagttgtcaacgtgatgttctccttcggttcttggaatttatcagacagattcaactttaccaactgctcatcattaaaagagtaagattttatttgaaatttgaatattctctcgttgatcttaatttacttatttgtttgactcctcgatttcctaaagaactcttttgtgagacaga

SEQ ID NO: 169546 - DNA, 601 bp, Human
ccagcactttaggaggctgaggtgggcagatcgcttgagcccaggagagtttgagaccagcctgggcaatatagtgagacgccatcgctacaaaaaaacacaaaagttagccaagcatggtggtatgtgcctgtagtcccagctacttgggaggctgaggtgggaggatcacctgagcctaggagatggaggttgcagtgagccgggatggcgccccgcattccagtctgagtgacagagtgagattgtctcaacaaaaagaaggagcgctgctaggttctcttctgattggaatggcttygggaatttgggcggaacgagaagccttgagtgtaggggtaaaaagtcttacttgagaaggacaaggtgaagtccctttcaccaaaagaacatgttcctgctgccccccttttcaccatctttggcctctttgagctacataggcccctgagttagtgccaaacctcactccttgcttctaaagcagcaagaggacagaggaaatatgtttctcagatgcctgacttgccaattggaagttgggatggaggcctgcagggcaccttgggaggctgcatgagtagcagtgctgtagatcact

SEQ ID NO: 169547 - DNA, 601 bp, Human
ccacccatctggatgttgaagggatgttctccattccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaawggctggacactcacataaaataaattaaaactctgtaattatgaaaaatgatgttgctctggtcgaaataaaattgtaaaggtgactttgcggctcactggtgaagagctggaaggaagtttagcattccatctgagggatttcaacttgcactttatataattgcgtttctgggggttatgtgtgtggatgggggtctgtgcaaagtgtgcaaactaacctcgattccgttgttttttttcaactttgtagggacgtctaaccagtagtgaacactgctaaaccagaattgttatagaa

SEQ ID NO: 169548 - DNA, 601 bp, Human
gataccattttgcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctggrtatcaaccccctatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaact

SEQ ID NO: 169549 - DNA, 601 bp, Human
gcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctgggtatcaaccccytatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaacttcattcttttg

SEQ ID NO: 169550 - DNA, 601 bp, Human
ccaaattcaatgtcatgaaactttctttctgcatttatttgtaaaggtctgtagcacttatattttggcctctgattcattctcagttcatttttatatatggcataagaaatgggtctaacttcattcttttgcatgtggatatccagttttcccaacatcatttgttgaaaaaaatgtcctttcccccattgaatggtcttggcaccctcgttgaaaatcatttcaccatatttgtgagagtgtatttctgggtgttcttttctattctattggtctatgcctgtctttatggcagtamcgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatagtactatcctgcaaaactatagcaaaacatcacagtcaggatattgacgttgacagcagtcaagacacagaacagctctatcatcacaaggctccccaggttgccctttca

SEQ ID NO: 169551 - DNA, 601 bp, Human
ttggtctatgcctgtctttatggcagtaacgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatagtactatcctgcaaaactatagcaaaacatcacagtcaggatattgacgttgacagcagtcaagacacagaacagctctatcrtcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcttccaagttcttttatgtatcaataattcattcctttttatcgctgagtcgtggtccaggcagcggctttttaaacttctttaattttaaagataa

SEQ ID NO: 169552 - DNA, 601 bp, Human
gtttccttcaatagtactatcctgcaaaactatagcaaaacatcacagtcaggatattgacgttgacagcagtcaagacacagaacagctctatcatcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcwtccaagttcttttatgtatcaataattcattcctttttatcgctgagtcgtggtccaggcagcggctttttaaacttctttaattttaaagataaatatcataaagtcactacctcctggtttcctgcagtgtatctctctgcaccctttgaactgtgtggttaaaaggactggggtcaccacaagagaagaagaaggctgaaaataaacaaaagcccagatctgtttttagtgcttctctgtggattacccctctaagtgtggagaaagacattttgttgatactgacatgttttcttt

SEQ ID NO: 169553 - DNA, 601 bp, Human
tctcgtgctctgtcaaacactgctgtctttcattatcaggtggaatgtgtaacattctggtttccactttgggccttcatgttggccttgaacaaagcacccaatgtctttgtgattctgtttctaccagagaagtcactcacagctttgcttcaatgcatctgcccacaccacatatgtactgagtacttcctgtgtgctaggcactaggaatggagcaggtactgtcctaggcgtctaggatcctgaacttgagttgattctttctagaggcatttattgcacacctattagatgcaaktataccgacctccacagattccatgaggaggattcagatgaatcaggcacatctctggccatcagtctcaagaatcttatccatgagtacatgagtaaaaatacaagattttaaaaatattaatatgaaggtacaagaaagtacacagagagcctctctgtgcccggggctttgtcttagtccttcctgtttgcttaaacccagtgccttgaagttgaaaacacttaatcagtgtggttggttaagtctttgattgatggatggattgattgctggagatggcatttcagcccacctttg

SEQ ID NO: 169554 - DNA, 601 bp, Human
ttgaaaacacttaatcagtgtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcrctttattcttcagtggcaatggaatgccattcaaggtatcttattttatttttttagtgtatgagtttgctaatccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggc

SEQ ID NO: 169555 - DNA, 601 bp, Human
gtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcgctttattcttcagtggcartggaatgccattcaaggtatcttattttatttttttagtgtatgagtttgctaatccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtc

SEQ ID NO: 169556 - DNA, 601 bp, Human
gccagaagattccaggacacacgctagaggaaaccctaagtaggcacagaggatgcaggaaattatgagacacaaggttgaaatgaccctggagcctgcatatatagggcctcacataccagtcctgtgagtgctcgctttattcttcagtggcaatggaatgccattcaaggtatcttattttatttttttagtgtatgagtttgctaatccaaggatctggtacttatgaggtagggtcctggttcagtccctactaggccagtagccctcacactgtttcatgaccccaagacctacycctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggcccttttaccctgccctgaccacttctccttccatttcttaacattctcatatctggtgccttcactcactgagaccagagatagttcccctctct

SEQ ID NO: 169557 - DNA, 601 bp, Human
ccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggccctttyaccctgccctgaccacttctccttccatttcttaacattctcatatctggtgccttcactcactgagaccagagatagttcccctctcttttgtgcattcaaggagagattgtgaagatttatgatatgatgtcattctaatatttgttattaccctcaatatgcttatcactatagggcagaaataaagcatacaaagtcatatcccctggcaatttacattcaaatggttctttctcttccttgcacctcctcttctcttcctccatcacttcttcccccctccgagatggagtttca

SEQ ID NO: 169558 - DNA, 601 bp, Human
atacaaaaattgatctaaaatattgaatgtgtagaacctttatggggaaatgattctttgctcttttgtctgtactggatttttcaaaatctttattggtaaaaagaaagaatgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttraaagcagactgaagcacccactttcacaagacaggccagggctggattccatcctagatggccaagagaaccctctctaaacaataggggtttaaaatgtttttgaagtagcaaggcggtctccactcagggaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaa

SEQ ID NO: 169559 - DNA, 601 bp, Human
ttgaaaattttgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcrgccagagacactacccagacgaatatttatgggtgctgaaatttgaatttcatgtgtttttatatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacac

SEQ ID NO: 169560 - DNA, 601 bp, Human
tgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcagccagagacrctacccagacgaatatttatgggtgctgaaatttgaatttcatgtgtttttatatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttg

SEQ ID NO: 169561 - DNA, 601 bp, Human
gaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcagccagagacactacccagacgaatatttatgggtgctgaaatttgaatttcatgtgtttttwtatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttgcaagagatttatcttgaaggctttgctaatccccccattccaagtaccactc

SEQ ID NO: 169562 - DNA, 601 bp, Human
tttcaggcccttagtgattctattaatacagggctaacgtccttcacaaagtgattaaaataaattctgctaccaaaatcaattctgtgtcatgttacatcattgctgtgatgacattaacaatgaatttacctcaatctgcaaaaccagtccaaagcgctgatgagtgatggggacgactgtgccgtgtagcacctgtgtgtgctggggagcagaatgagaaaatgtctgtttgagcaggatgggcagcccctgtagcccagcaatgccaccccaatgagtgttccatgtacaaaggagsagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatctt

SEQ ID NO: 169563 - DNA, 601 bp, Human
atgtctgtttgagcaggatgggcagcccctgtagcccagcaatgccaccccaatgagtgttccatgtacaaaggagcagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtcctgttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggctttttttttaaagggagaatttgattagatatcacaaatggagaagta

SEQ ID NO: 169564 - DNA, 601 bp, Human
tactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtccygttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggctttttttttaaagggagaatttgattagatatcacaaatggagaagtaaggtggcattcacctatatggtatgaagctaggtagcaagggactccaagggacatgttcttgaccttaggcctgataaagtc

SEQ ID NO: 169565 - DNA, 601 bp, Human
gtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgrggaattttttggagcagctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatg

SEQ ID NO: 169566 - DNA, 601 bp, Human
agctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttctgcacatcactgccatgcccttcccc

SEQ ID NO: 169567 - DNA, 601 bp, Human
tccatcacctcaagcacttatcatttctttctgttaggaacattccaattccactcttctagctatttttaaatatgcaataaattattgtgagttatagacaccctactatgctactgaacactagatcttattctatctcattgtatttttgtagccattaaccaaaccctctttatccctctctggccccgccacaccacccttcccagcctctgatacccataattctactctctatctccattagaccaactttctcagctcccacatatgggtgagaacctgcaatatttgtctktctgtgcctggcttatttcacttaacataatgtcctgcagttccatctgtgttgttgcaaatgacaggatctcattcttttttgtatgctgaataatactccattgtgtataggtaccacattttctttatcctctaatctgttgatggacacttaggttgagtccctatcttggttattgtgaagaatgctgtaataaagattcctcctagttgaatttaaattcactttcataatatttttattcctaaatctctttaggactaaaatcctaacgatattttctttgcctgacacagt

SEQ ID NO: 169568 - DNA, 601 bp, Human
tttttttttttttttttgtgacagtctcactctgtcacccaggctggagtgcagtggcgcaatcttggctcactgcaacctccgcctcccagattcaagtgattctcctgcctcagcctctctagtagctgggataatctcccctttttataaggacatcggtcatgttggattagggcccaccccaatgacttcgtttaaccttccttacctctttaaccacccacgtctctaaatacagtcccattctgaggcactgggagttagggcttcaacatacattttatggggacacattttwtggggacacagttcagtccataatagtaagataaggagaactgaaatttcaaaaccaaggctctagcatgacatcccccactctaggaccaattccattctccatataaaaggagacattgatgtggcatgccccatgtgcctggtgtgttcatctattgactaggttaatcctcacaacaaatttatgagatctgctatggcttgtcccttttgcaaatgagggaactgggggaggaaaagggttcaaacaactcaccccagcctcccagacagctggtactaggaggttgggctctga

SEQ ID NO: 169569 - DNA, 601 bp, Human
cttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggaycctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattc

SEQ ID NO: 169570 - DNA, 601 bp, Human
gtccaaatctcagctctttacatcatattttcccaccaattgcctcttcctattgtcttttttatgctctagtatcagggggtggcgggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatagagagagacagggtctcactrtgttacccaggctgatctccaactcccaggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttccccca

SEQ ID NO: 169571 - DNA, 601 bp, Human
tttcccaccaattgcctcttcctattgtcttttttatgctctagtatcagggggtggcgggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatagagagagacagggtctcactatgttacccaggctgatctccaactcccrggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttcccccaacaaagggtgattcagctgcaacaagcg

SEQ ID NO: 169572 - DNA, 601 bp, Human
ctcctgttttctgttatgcctgaaaacccttgtcctccttgtgtctagtgacttctgctaaggccctgcaggaggttcccccaacaaagggtgattcagctgcaacaagcgcttcaggagctggcccttgctgagagttggacacttttcttttctcgtggtttcccagggctcagacaggctgaccccaaggacacctaagccccttgggtcagaatcttcccctttccctagcctactgctttcagcctagtctcttttcccatggcataaccttccagctgctttcattgtcactcaygatattaatcataatattaactagcatgttttgagtgcttactgtgtgccgggccctgatctaagcatgtataatctcagttaacgtagccctcatttaatgtaatgtagggtgaagtcaatcctgtgagggaggtagttttgctgtctccatattacacatgagaaaacagaagcaccaagaagttaagttgctcaggtcacttagctcttagagatcacagctgggattcgttaacaaagttactaaaacattcttttctttttgtccaggtctctgaatattgtgtggcgacttact

SEQ ID NO: 169573 - DNA, 601 bp, Human
acaagggcctcttcagcacactctgggtagcattagaatcagatggagaccagataatctctgggtcatgggctgcttccttcaccatgaagtcatactttctgcgattaatcttttcccagatatgtttgggggacggatcactgctatatttatatcccataataaagatgtgagaccactgagaagggaaacacattagaagtcaccctttatagtattcatgccgtatgaggctctgtacagcctatataaattcttcttgatctatcatcataaataattggataaaagacaatgmaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctccgcttcccagttttaagcaattctcatgcctcagtcacccaagtagctgggattacaggtgcgcaccaccac

SEQ ID NO: 169574 - DNA, 601 bp, Human
tatgaggctctgtacagcctatataaattcttcttgatctatcatcataaataattggataaaagacaatgcaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctcygcttcccagttttaagcaattctcatgcctcagtcacccaagtagctgggattacaggtgcgcaccaccacacctggctagttttttctatttttagtagagacggagtttcactgtgttgggctggctggtcccaaactccttgcctcaagtgatctgcctgcctcggcctcccaaagtgctggcattacaggtgtgagctaccgcgcccagccaatagtaagttttaagtcaggaataacaactaggctgggagagacaactcaagcctataatgccagcactttgggaagccaaagc

SEQ ID NO: 169575 - DNA, 601 bp, Human
aattaagactctgagggtctagtccagcatgtgtcaactgacatttcaggaaactgaggcacagtgaatattctggatttgcccaaggacacatagctaatctgccacagaaatgagagttgaactcagatatcctacccagctcactgcttctttttgtattgtgaagccattttaggggggaaattatgtaaataaatacagtccccaactcaattgggtctaatgacattctttgtcccatcaggtcaagctgggaaacctggagctctacgtcgagcaggagtcagttccttccacrtggtattttctgattgtgctccctgtcttgctagtgattgtcatttttggtaagtgccctgtttaattttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgagg

SEQ ID NO: 169576 - DNA, 601 bp, Human
ttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgaggtcaggagttcaagaccagcctggccaacatggcaaaaccccgtctctactaaaaatacaaaaattagcygggcgtgatggcaggtgcctgtaatcccagctactcaggagactgaggtaggaagaattgcttgaacccgggaggcggaggttgcagtgagccgagatcacaccactgcactccagcctgggtgacagagcaagactccatctcaaaaacaaacaaacaaaaaacaaaatttttttttaaaggatgcttcattaatagaaggctggattacacagatggtatcttgggatttgagggatataatctactttgcttctccattccttcaaattgtggtgacaaatgttcatttatgtaatt

SEQ ID NO: 169577 - DNA, 601 bp, Human
attccccaagaacttctctgggattttgggctcccaggacttggttatttcatcttgaccaccccccaccacccatcaccccagcctcatttcagtcttgattttctgggcagaaccacactttagaagtgtggtcatgcctgggcacagtggcacacacctgtagttccaacactttgggaggccaaggagggaggacggcataagtccaggagtttgaggttacagtgagttatgatcgtgccactgcatgccagcctggacaacagaatgaggccctgtgtctaaaaagtaaatgatkttttttaatagaagtgtgatctatgtcatctcttaaagtggtcccgggcccatccacacacagtgagcccatggtggttgctcattggccaaatctggtccaccaatatattttgttttgccgtgtagcattgtctaaaactattaagtagcttataacatttaaaaattagtgattcacatttggaaacgtctcttgaaaatgtgaaagatttggatcattggatcccaaatttccatagcatcagtttattagagctgagtagcagctacgccctagagagagggaatgtgctcccta

SEQ ID NO: 169578 - DNA, 601 bp, Human
atcacgaggtcagcagatcgagaccatcctgaccaacatggtgaaaccctgtctctactaaaaatacaaaaattagctgagtgtggtggcacgtgcctgtaatcccagctactcaggaggctgaggcaggaaaatcatttgaacccgggagctggaggttgcagtgagccgagatcgtgccactgcactcccgcctggccacagaacaagactccgtctcagaaaaaaaaaaaaaaaaaaaaaaaaaaagcactttgtatttcctgatttaacataggtattgactttctgaaatttgacrgctagtacaggcagttgccagtgtctccttctatacactcatttattcactcattcatccctgcatctatttaccttatgttcattgagcacctgttatgttgctgataactgtgcaagtctctggagctagaaaaaaatgagcctttgcgtgcatgagccagtgttgctcaaactgaggcctgaggaacagtggtcccaagtgactgtcctggaaaaaggggttccatggtcaagtaagtttgggaatcactacatcatactccaccctttcttagacatgcacaatgcatgttattaa

SEQ ID NO: 169579 - DNA, 601 bp, Human
atggaacaatgcaagtggctgcagctgtggggaagaaacttggcttgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagrttgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagg

SEQ ID NO: 169580 - DNA, 601 bp, Human
tgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagggcctgggcctggctttgtgttttatttcagctcttctctgcagcc

SEQ ID NO: 169581 - DNA, 601 bp, Human
aacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctcttyggtagtttttctttagctggtcagtttgtattgtcctcatttagtagacgtagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcc

SEQ ID NO: 169582 - DNA, 601 bp, Human
gaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaraggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaa

SEQ ID NO: 169583 - DNA, 601 bp, Human
gtcggttttggcttttaaagccttgctttttattttattgactcttctttgctttgcataaagtaggagaagaaataagggtaggcagaggatctaagctgaagaaaagggaaatttgaatgaaaggaggaagcagccttaaaactcagagagccacgggtccaggcgcggtggctcaagcctgtaatcccagcactttgggaggccgaggcgggtggatcacttgaggtcaggagttagggaccagcctggccaacatggtgaaaccccgtctgtactaaaaatacacaattagccaggsatggtggcgtgcacctgtaatcccagctactcgggaggctgaggcagagaattgcttgaacccgagatcaagaccatcctggctaacacagtgaaaccccgtctctactaaaaatacaaaaaaattagccaggcatggtggcgggcgcctgtagtcccagctactcgggaggctgaggcaggagaatggtgtgaacctgggaggcggagcttgcagtgagccgagatagcgccacactgcactccagcctgggcgacagagcgagactctgtctcaaaaaaaataataaataaataaaaa

SEQ ID NO: 169584 - DNA, 601 bp, Human
tttcttgaaagctgaataattatttattatgtattagagaatacgcagccaccataaacccaggggcgcttcagattagcaaatagtgtctctactttattaaaacggacttgggtattataacaaaaatacactcttcatttcctttggatgttatgaataataaaagtgtctccttcctctcagtcaggtggcttcacccacatcttcactgaagatatgcatgtaagtctctacgttttcatttttagcccagtgactgcctgatgttcatagtgttatcatcatcactatcatctcyattattattactttgaatttttattgtgggttttttttggatcatgaattcaatattgaataattcattgtcttggaaaacccattgtgggtctactttctaactttaaacttatatatgattttgtattatactatatatttttttctttttatcagaacagagacgccaacgacaagaatgaaagtctcacagctttggatgccctaatctgtaataaaagctttcttgttactgtcatccacacccttgaaaagcagaagaacttttctgtgaaggacaggtattagtccattcttt

SEQ ID NO: 169585 - DNA, 601 bp, Human
gaacatgcacttttccaaaggctatttgattgggagtttatgcagccttctctccattttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaaytcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagtttaaatgctgaaaacacagaaaatgttctagagatagaagtggttagaatctaaacattaaaaaaaaaaaaaaaaaagctcccaacccaacaggccagctccctgccctgccagtgagcttccatggaaac

SEQ ID NO: 169586 - DNA, 601 bp, Human
acagctgctagatggaggcaccaggactctcacccagttccctggtcttggtcttcaaaggccaactcctgccccaccacagtctcactggatcagaagctccggaagtggagcccagtaatccatgattttcacaagtccctgggatagtagagagagcaccacactaggggtcttggttagaagcagcaggtctgggctctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgttcagaaaatctgggctgcgagcccaaacagcctccttgagcaaagcattctgggtcaagacttcacagtgctgattcaagagcgtctcgagcactctgagtggtgagggggcggctcggctcgccaggaggaagtggcatccagccagtcggcgatactttcactttcagtggaataattcccgctggtgcaggggtctga

SEQ ID NO: 169587 - DNA, 601 bp, Human
ccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcattycagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggta

SEQ ID NO: 169588 - DNA, 601 bp, Human
taaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggcgggaggttgggggcagattctttcaaggaaaggaaagtcggaaatcaagagyatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgc

SEQ ID NO: 169589 - DNA, 601 bp, Human
ttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgakaataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgcc

SEQ ID NO: 169590 - DNA, 601 bp, Human
aataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatyggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctt

SEQ ID NO: 169591 - DNA, 601 bp, Human
tattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgytgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttgg

SEQ ID NO: 169592 - DNA, 601 bp, Human
gagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggargccaaggtgggaggatcacttgagctcaggagttcaagactagcctgggcaacacagcaagaccctgtctctaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctggg

SEQ ID NO: 169593 - DNA, 601 bp, Human
catgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccac

SEQ ID NO: 169594 - DNA, 601 bp, Human
agggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcytgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacag

SEQ ID NO: 169595 - DNA, 601 bp, Human
aaaaaatacaaaaaattagccgggcgtagtggcgggcgcctgtagtcccagctacttgggaggctgaggcaggagaatggcgttaacccgggaggcggagcttgcagtgagccgagatcccgccactgcactccagcctgggcgacagagcgagactccgtctcaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttrcctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagat

SEQ ID NO: 169596 - DNA, 601 bp, Human
gtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccrccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctg

SEQ ID NO: 169597 - DNA, 601 bp, Human
atctggcttcaattcctggttctgccactggtgagctgttcctggagcaagttactcagcccctctgtgcctcagttccctcactctacaacagggatgggaataataatccaggaaacatttctagaaaagagaggtgaggagagggctcgggtgtgaggcttcacatgttggttccttctagacactctgcccaccagctccctgccttctctcctgtctggtattttttgtttcttgtttgtgagcagacaggcctttgaaccccttcctagtcggtggctggcccagaacataaagkttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctg

SEQ ID NO: 169598 - DNA, 601 bp, Human
ctctttgcagatgagaaagcgacatacacagaggttacacagctggttagggatgggctcagaggtcacccagctggcttgcggtggactgggatgaaagccaggagtctactggcttctactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcgtcaagcctttcccagcagcctggcccygtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctacgcaaatcagacattgcctcctgcagcctctgcatatatacctggctagtgtccacagtacttggggacctcctctttcggctttggagccccccctccctctgtctctgtatgggcgagcatcttccttctgtcttctcccttccttct

SEQ ID NO: 169599 - DNA, 601 bp, Human
gcatgatcacatttaatctccctaacaatgctagaaggccggtactgttattacacccatttttaagttgaggtaggcctgagggttcccatcttccatatgatttgtgttttcatctctcccctgagccctacgcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccrctccttaaaaccaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttg

SEQ ID NO: 169600 - DNA, 601 bp, Human
ctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacgaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcct

SEQ ID NO: 169601 - DNA, 601 bp, Human
aaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggckctcacagtgtacttgtcacgtattcccttctcagaaggctatgattttctatctcctgaactctctccaccctgaggttcagcagaaaagaacctaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatac

SEQ ID NO: 169602 - DNA, 601 bp, Human
atattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaagggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatg

SEQ ID NO: 169603 - DNA, 601 bp, Human
actgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagaygggagttttattattactcaaatcagtctccctgagcgttcagggatcagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggt

SEQ ID NO: 169604 - DNA, 601 bp, Human
ttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctaygagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagt

SEQ ID NO: 169605 - DNA, 601 bp, Human
tggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccasaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttg

SEQ ID NO: 169606 - DNA, 601 bp, Human
ctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcrtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccc

SEQ ID NO: 169607 - DNA, 601 bp, Human
aatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacaggrtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaatt

SEQ ID NO: 169608 - DNA, 601 bp, Human
cagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcrtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaa

SEQ ID NO: 169609 - DNA, 601 bp, Human
gctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgmagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagg

SEQ ID NO: 169610 - DNA, 601 bp, Human
tgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcraataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgc

SEQ ID NO: 169611 - DNA, 601 bp, Human
tattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagc

SEQ ID NO: 169612 - DNA, 601 bp, Human
ttgtgaactttccccaaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactmctgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatct

SEQ ID NO: 169613 - DNA, 601 bp, Human
gaacacctcattgatcaccaccagcagtagaaccaaggcacctactctgtctctgaatagtggcaattgaaaaggtaaagaattaagcatttatcctgcctttcctgtaaaaactgcttcttagggtatttagaaccctagttgatggttggggtggcaggacaggaattctttttttttttttctttgtgacacgctctcgctctgtcacccaggctggagtacagtagtggtgtgatcacagctcacttcaggctcaacctcctgggctcaactgatcctcccacatagctgggactamgggcacatgctaccatgcctggctaatttttttttttttggtagatatggggtttcgccatgttgccaaggctggtcgagaattcttgggctcaatgatctgttcacctcagcctctcaaaaagttgggattgcaggcttgagcctctgtgcccgaccaatgaatgaggggacttctttttttatttttattattttttttttgagatggtgtctcactctgtcccccaggctggagtgtagtggcatgatctcagctcacttcaagctccatctcccgggttcacggcattctcctgcc

SEQ ID NO: 169614 - DNA, 601 bp, Human
ctctcgctctgtcacccaggctggagtacagtagtggtgtgatcacagctcacttcaggctcaacctcctgggctcaactgatcctcccacatagctgggactaagggcacatgctaccatgcctggctaatttttttttttttggtagatatggggtttcgccatgttgccaaggctggtcgagaattcttgggctcaatgatctgttcacctcagcctctcaaaaagttgggattgcaggcttgagcctctgtgcccgaccaatgaatgaggggacttctttttttatttttattattwtttttttgagatggtgtctcactctgtcccccaggctggagtgtagtggcatgatctcagctcacttcaagctccatctcccgggttcacggcattctcctgcctcagcctcctgagtagctgggactacaggcacccaccaccacacccggctaattttttgtatttttagtagagacgtggtttcaccgcgttagccaggatggtctcgatctcctgacctcgtgatctgcccgcctcagcctcccaaagtgctgggattataggagtgggccaccgagcctggccgaggggacttct

SEQ ID NO: 169615 - DNA, 601 bp, Human
tgcctgtaatcctagcattttggaaggctgaggcggatggatcataaggtcaagagatcgagactctcctggccaacatgttgaaaccttatctctactaaaaatacaaaaaattagccaggcatggtggtgggcacccacagtcccagctactcgagaggctgagggaggagtatcacttgaacttgggaggtggaggttgcgccactgcactccagcctagcgacagagcgatactgcgtctcaaaacaataaaacaaaaaacaaacaaacaaatagcattattgaggtataattaacytaagataaacaacatattacaagtgcacagtttggtgagtttatctacattggcaaaaccattacccaaattcagataatgaacgtctcaattgtcttaccagctgggcgttctacaattcaatttgattttgacaccaccttaagttagcagagaccccctccccactgctaggttaagggctcattcccacaagactgccccaattcagatgccagctaggaatggggttcccagtctcccatacttctgcctggctgaccacaaattcacgggctcccatgaccatcctctccggtg

SEQ ID NO: 169616 - DNA, 601 bp, Human
agtatcacttgaacttgggaggtggaggttgcgccactgcactccagcctagcgacagagcgatactgcgtctcaaaacaataaaacaaaaaacaaacaaacaaatagcattattgaggtataattaacctaagataaacaacatattacaagtgcacagtttggtgagtttatctacattggcaaaaccattacccaaattcagataatgaacgtctcaattgtcttaccagctgggcgttctacaattcaatttgattttgacaccaccttaagttagcagagaccccctccccactgmtaggttaagggctcattcccacaagactgccccaattcagatgccagctaggaatggggttcccagtctcccatacttctgcctggctgaccacaaattcacgggctcccatgaccatcctctccggtgtgctgtgtcactagaacaactcacagaactcaggaaaatgctatccttatgattagttttattatgaaagatgcaactcaggaatagcaaaatggaagaggtacatggtgcagggtcttgcagggaggggtagagagcagagcttctgtgccctctctgagtgcaccacct

SEQ ID NO: 169617 - DNA, 601 bp, Human
cacacccacaaaatacttaggaatacatcaaattactttttgtgtgtagtattagacaaccagccacattctttgagctaaaaataaaaacatgcaagatattaaaaatacaaatagggactgaatagtacagtgaagaaaattacaagtagaacataagggaatagtcaagaattgtaggaaaaaataaaaatataagtacagactagatttctcatgtttaggaaattagactttttaaataaataaaaaattgccaggcatggtggcttgcaccaataattccagccacttgggaggytgaggtgggaggatctcttgaggccaagaatttaagaccagtctgggcaacatagtgagactctgtctccaaaaaaaaaaataataattactgggtgtggtggtgtgcacttacagtttctgctactcaggaggctgaggtgggaggatggcttgagctcaggagtttgaggccgcagtgagctatgatcacaccactgtactccagcctggatgacagagcgagacccgctttgtatgtatgtgtgtatatgtaatacacatgtatacgtgtatatatatgtataaaatgttctacttc

SEQ ID NO: 169618 - DNA, 601 bp, Human
tgatcactatgcatcgtatgtatcaaaatatcacagtgcgccccatgaatatgtacaattattatgtgtcagttaacaaagttaaaaaaatgttcagagaaccccaagcagggtaaaggtagggagagaaagcatacctctagatgcattatagttaaactactgaccaacaataaagagaaattcttaaagaagctagataaagaaaggcagccggattaaaacaaaatgtatgtacagaggaataaagataaaaattatagcacaattcttatataacctatgcacgcagaagacagtrgagtgacatcaagtgctgagagaaaacaaaacaaacctgccaacctgggatcctatacccaataacaatatctttcaaaactaaaggcaaaacaaagactttttagacaaacaagagctgggaaaattcattgctagttaacctgcactacaagagatggaggaagtgtgttgggcagaaggtgtatggtaccaggtgacatttggatctccacaaagaaatatagagtacctgcaataatgtaaaagccatcgaatgtaaagacattgcatgtctaaagccaaaacaatgcaaatatat

SEQ ID NO: 169619 - DNA, 601 bp, Human
tttcgaactcctggcttcaagtgatcctcctaccctagcctcccaaaatgctgggattatgagccactgagccagaccaaactaagtatttgaaatgtcttaaggggcagcagcaggttaggtggtgctggaacatctatgaagtggttggtttcttcctgaggtagctacttgttgccaggagaaagcattatgattcatttctcacagaaagtggttccctctcccccttctctcttcctttactctctcctgctcctcacattccttcctttactcttcctttcctttgtcttttttktgtgtgtgtgtgtgtgtgtgtgtgtgtgtgtgtgtgtgtgtgtgtgtgtggttttaaggagtggagagtttaataggcaagaaggaagggagaaggaagaagctcccctgtacagagacagagggaggggcgcttcaaagccaagagagggaaccccaaatggggcggaaaccagccaggtgtatatatagagaggctggagaaggcagtgtctgttttgcacagggctcgggattggtttgaccaggcctgtctttcacatagcccgcgaaaaagctggccctcccaccctagcctttt

SEQ ID NO: 169620 - DNA, 601 bp, Human
ctgggcgacagagcaagactccatctcaaaaataaataaataaataaacagacagacattctgtaaagattcagaggatgatcttttatttctatggatttagggggtacaagtgcaattttgttacctagatacattgcatagtggtgaactctgggcttttagtgtacattgtactcaatctgtgatttttcatggcttactcctctcccatcctcctgccttttggagtttccagtgtctattattttactccctatgtccatgtgtacccattgtttagctcccacttgtaaatgaraatgtgcagtatttgagtctctgtttctgactgacttcacttaggataatggccttcagttccatctgtgttgctgcagaggaccatcttgaagaactctatcaagcccacttggtttaattgcctttgtattcttttaaatgaaacactccaccctataagaacagaatgcaccctttcttcaagtgccatacagcattccgttagatagaccaaaagtttcaatgcatttaaaagcattgaaatcataccaagcatgttctctgaccacaacagagctaaacagaaaatcagtgtctg

SEQ ID NO: 169621 - DNA, 601 bp, Human
taagaagtaactgttttactgatgcttttctttcaaaagcatatttaaactgtactttggaacatattaagactacttaatatcttacaaatatttagaaattcattgaaagtaattagtagtgcaaaatatagtatcaagtttgagatgctaacaggtatgaaaagctgagtatgccataaaagtcgcattcttaaaggcttcagagtgctatggaagcaatgagggacagttggactaaagttccagagatgggaggctcatccagagctgcaccaaggaggaccagttattttattttctgtggaagcgtgctagttctggagatgtgagcagaggcagaggactgctactagctttgaaagagatactagccaaggttttctggtcataatggactgacaaattggagatttggtggggggtgtggtggggtgctcaaatgcatgactgattttccccataagaaatttggtgaaatctgaggttggaggggagctgaagagagaggccagaaacttccagaaggcacattgaaatctcctacagccttacagtgcctaggaaacacagacctgctggagtctggagtctgaaaaca

SEQ ID NO: 169622 - DNA, 601 bp, Human
tataatattgttttgtggataattgaaataaaaaattctcattaaaaaatgaagtgatataaggatatagttagacaaacaaaaactgagggatttgtcaatagtggacctgcatgacaagaaatactaaagggaggtactttagtcagaaggaaaatgatctggccaggcatggtggctcacgcctgtaatctcagcactttgggaggccaaggcaggcggatcacgaggtcaggagaccgagaccatcctggctaacacagtgaaactctgtctctactaaaaatacaaaacagccgggtgtggtggcaggtgcctgtagtcccagctactcaggaggctgaggcaggagaatggcgtgaacccgggaggcggagcttgcaggaaaatgatccagatggagatgcagggagaaatggagagcatgaagggtgaatatgtatgtaaaatataaatgaatgttgactgtataaaacaataatgtcgtgtttctcgagcttaaaataatctagaactaaattgcatgacagtagcacaaaatgcaggggaggttaatgaagttaaaatattttaagtttctaggattattgggggttagtgt

SEQ ID NO: 169623 - DNA, 601 bp, Human
aaaatttgaaaattggaggaatattcttttctttctcatttatatatgaaaatatacataaaaatatacatacacatgaaaacttagaaaattatgttaatgtatttttaggaagaagggtcaaattatgatgtacgtttaccataatgtaaaaacgtaagctaaatccaaaaggattttactcagtgaccttattatttcagtctgaatcataatcaggcattttacctggatacgtatcccagcttgatctgtcataaaaaatttctttcttgtgtttctaaaaacttcaactctccartttcagcatttactaagtcaccttgtcaaacacagagaaatctcctttagcagataatttttgctgggttgaaacagatgggcaatctacttgtggttatttcctaagtacttattgcagatatggtggtgattgctgctcatgcatttccatttgaacttgaagcattggtgtttctcttagctggcatcctccccagctcttctcacctctcttctggcttggcacatggtgggtctggctcatcagatgatccccttggaggatgctgcaaaactcctcagcaacctgctctgtatt

SEQ ID NO: 169624 - DNA, 601 bp, Human
ctaaagaggacgtctctttcttgcggcatgcactgctctgttccttggacccacctggcttgatgaaggaatttctgggcctaggactaattgttgctactccatgccttgctgcctcagtagggaaggactgaacccttgaagaatgccagatgttcaatgggaaagcctccgtaaacttagtttttatgtagttcagcagtttagagggtgtttattcgtatgatggtacttttaagcctttcttcttattgtacattattaaagaagacacaatttgaagtttggagaggggaggatrccattttaatttttatcagtgggagctccatttttttccccctagttcccctcgctgtggttacagtaagactttccttaactagagccttttaccactatggcttgactttgtaatcctgacattaattcttaggggtatttttgtgtattttctcttatttgatggaaattttatctttttacaaccccattatcagtttgttgatgaatgtatgcatttagggcccaaacaatcctcccatctcagcctccagagtagttaggactacaggcgcacaccaccatgcctggctcattt

SEQ ID NO: 169625 - DNA, 601 bp, Human
cttagtttttatgtagttcagcagtttagagggtgtttattcgtatgatggtacttttaagcctttcttcttattgtacattattaaagaagacacaatttgaagtttggagaggggaggataccattttaatttttatcagtgggagctccatttttttccccctagttcccctcgctgtggttacagtaagactttccttaactagagccttttaccactatggcttgactttgtaatcctgacattaattcttaggggtatttttgtgtattttctcttatttgatggaaattttatstttttacaaccccattatcagtttgttgatgaatgtatgcatttagggcccaaacaatcctcccatctcagcctccagagtagttaggactacaggcgcacaccaccatgcctggctcatttttatttttatttttatctttatggaaatgaggttccactgtgttgcccaggctgatcgcgaacttctgggctcaagtgatcctcctgcctcaacctcccaaagtgctgggattacaggcatgaaccagtgcacttgacctgataataggattctttacactttattatcagagtgatc

SEQ ID NO: 169626 - DNA, 601 bp, Human
agaggaacaagcatttgctgcgattgcctataaatactcaacagatttttaaagaatgtttgttaatataattaccgtaggttactgtttagtaattgctgtgttaaatttatctgttgtgatattatataacatacacagattggttacattttattatttaaaaatattatttttgactttgatagcctttctcaaagcaagctgtagaacacgtacaaagtcatttatccaagaaacaagtgacatcaactctttttcaggtaagataaaattattccaaaataaatagataatatttgcttaacacttggccttggtgacattctttttgcatgtgcaattacactagaggacttgctttgtaaagactgtgttctattctggagctttgtctgggactatttgagtttattatcgcttatcttcccattgcaaagtgtccttctaccaacgtgcttcctaaagccttttctgaaaaaggtcattagagctttgtcgtaacattatgttctagaaatcagtcaagataagacatcagagaagcaagtttttgcccatttgacattccagcacctgtgatgagcaatgactctacaag

SEQ ID NO: 169627 - DNA, 601 bp, Human
aatcatttagcaagtattcactgaccatgtacgatgtgccaggctttgtgttaaactgtttcctcagtactttacattataattttagggtttgtctatcttaacatctctttgaccttcaatttctcagcttcaatagagtctaaaatatacactgaggaacctcaattttaaaaagtatcttattgagagacctttgctaataatgcaaacttgactataatttatctgattcatttgcttggattttggaaacatgtctcccaaagcaggacaagcctgtacttgattcttcatgtargagtagaatttaaggacataggtcaatgtctgtttatgatcgtgtacatcattaaatacctaataaatatgtcccttggttactcaaactatagatctactggtcaattcttcagttttttgagtatgtctctgtgacaatgcaccactgaaattggaccctctaaaacagaatctgcattgacactgactttatcagcttggctaatttctagacaatatacgtgatgataatatctcatgctagagctttctgcagctgctcagtaattgcactttaagaacaaatgctactttactg

SEQ ID NO: 169628 - DNA, 601 bp, Human
taatatcggccgggcgcggtggctcacacttgtaatcccagcactttgggaggctgaggtgggccgatcacgaggtcaggagatcgagactgtcctggctaacacagtgaaaccctgtcactactaaaaatacaaaaaattagctgggagttgtcatgggcgcctctagtcccagctactcgagaggctgaggcaggagaattgcttgaacccgggaggtggaagttgcagtgaaccaagattgcaccattgcacttcagcctgagtgacagagcgagactcagtctcaaaaaaaaaaaaaggaaataatatcaacttatctctttgtacacatttactatttcacataactctcaaaaatagccagtgggtagtaaatattcttctattctatagatcaagtgtagatacttctcaggagccatatagctagaaaggggtcaagtcttaaggcccacgaaccctcactcatgtctgttcctgtcaccaggctgccagttgcatgcacactggctctgcgagcccatcagtgaaccacaaggtgcacccctaggagcctgttaggtagctctttgataccttctaaacagaggcccaagaa

SEQ ID NO: 169629 - DNA, 601 bp, Human
atcccatctactcaggaggctgaaataggaggattgcttgaggacaggagttcgagaccagcctggacaacataatgagactctcatctctaaaaataatattttttaaattagatgggcctggtgacaggtgcctgtagtcccagctatgctccagctactctggaggctgaggtgggaggattgcttgagaccaggagtttgaggctgtaatgaggtacaatcatcccactggactccagcctgggcaacagaatgagaccccatatcttaaaaaaaaaaaaaaaaaaaaaaaagaaarggaaaaaaaaagaaaagaaatcaactccacatggaagagagtggtgatagaggtagtgtaaaacattttgaaaattcttttaaataaaaataagatatttgaagaacatatcacttcatgtgtttctaacatttgatcccacatgtaagcaaattaatgtcttgccaattgatttgttgtaagaactcgtagaaaagtggataaaaacaccaaatttgaacatttatcttgtttttatataacttaaacatgataagttatgatcaacaagaaaaaggtagattttctgtgtctgctaca

SEQ ID NO: 169630 - DNA, 601 bp, Human
tgaatggtcctctagaagtccccttctatttcatagagtcctgtcattttcctcatagccctcatctcagccctgatgaagtcattagctatatgacattttatctcctctagaccagactctgcggggacggagcgcatgtctgtccctgtcattattataaccctggtgcctactacagtgcctgctgcagcacgtatactaagccaaatatttagttgattagttaatgaaaagcaatttaggccaggtgcggtggctcatgcctgtaatcccagcactttgggaggccaaggagggyggatcacaaggtcaggagatcaaggccatcctggctaacacggtgaaaccccgtctctactaaaaatacaaaaaattagccgggcgtggtggcaggtgcctgtagtcccagctactcaggaggctgaggaaggagaacggagtgaacctgggaggcagagcttgcagtgagctgagattgcaccactgcactccagcctggacaacagagcaagactctgtctcaaaaaaaaaaaaaaaaaaaaagcagtttaggagcccttttggtgtcacccatttcatagttaattataattcagct

SEQ ID NO: 169631 - DNA, 601 bp, Human
agtggtgattttcaatatgtcaggaagatccaacatcacaggtcgtgggaaaggagataagaacaggatgccttcctcactgtctgcggagagcaggaattaacccacagtggagttgaacctgctcagggaccagggtggcctctcagaaacagtcaggacctcagcaaaaaatcagaatccatgctacctgtgtgaccctaaaagtcagtcagttacttagtctgttagtaatggtagtaataaacccctcaaagttgtcctaaggataagtgaaagagactgtgcctagaaaggcacyggggcagctgcgtggatgtggtcaagggaggtcctcggggccaagtttctgtcttcatctacttttccttctttttcaaaaaggcttttcttcttttttttttccctgaagagaaattaggaatatttctttctttcttttttaattaaagaaacaaatcatctgcttgcagtttaggctttcactgcaggccatattgttagacttgggtcttgcaccaggtcctctacgtgatcacccagagggaactcttgaggccacagctctcagccagcacctgacacctcggggacaccagac

SEQ ID NO: 169632 - DNA, 601 bp, Human
tctttacgctgtgtggatgaactccctgaggctttggcatgatctatttagtacaagacggaagatttttagccacaatttcaccctgaacttggtttctcagatcttttcaaagctgtagatgtgattcttagatttcttccagcggctggcccatctccaaagtagtattgtagttgaggtttttgatttgagcttagacttagtccatttaacgaaagaatcgcaaattattgtaaactagaagttaactgtgaagtagccatgaaaaaatcgcaggaaaacttttggagctgagcagattgtcagtgactaatttgagtactagcttattttatctaagaacacaaagctgtgtctcatgtcacagtgtcttaaaacgtccaagtgttcgttcagtattaatagtagtacagatctttagcagaatgcgtcaggaagcattagcagctgccttaggcagaatcagaaaacctcagcagcaggcagtccaaggttgagttttccttgtatgtggtaaaagcatggggggctggtctgcattcatttatcttatttatcctgtagatatctattgtagatatctttccattccagaact

SEQ ID NO: 169633 - DNA, 601 bp, Human
cggagcagtggcagggttgggtggcttttcagtaagatgattctggaagcagcctggagcaatggaggaaccgagacaggaggcaggcagaagaatgtgagcaaaaggcagtgagtttgcgcagcagccctggaacctgacaggagcaaatgacatggcggcattgcagagttagcttctgtaacgcttcagtgttttcgtggagtgtgttttgtttttgtttttttatagatggttggatatggaaggatagaagttaaacatgctgcaatttagattcaagatgattgggagaataacratgtcattactaaaatcagcgtctgtaaaatttcagtggttcacatgaaactgaagtgtacggagggcctttcaggagcaaaaccctgtggcgaggcgggcaggaggtgggactgtgtgcaggagccctcactgcctcagctgtgaacaaggggataatgccacctgttctacttcctcacaaagttgcatgtgggagaacctcaaaaatatgcctgtcagcctcctgtgcatttttcctgtgttgtatagaagggagcccctggcagctgtcttttctcaggcacacggggcctaagaa

SEQ ID NO: 169634 - DNA, 601 bp, Human
ggatggtcccgatctcctgatcccgtgatctgcccgcctcggcctcccaaagtgctgggattacaggcgtgagcccccgcgcccggccgctctgttttctgttttaatcctccttgctgtgaccagcgtgcccccttgcttctgctgaaacacctttctgcacacttcattttgtctttatcccctacaagaatactgcaaggcacttggagaaggagtctggatgggagaaagatgtcaaggcttcagaaggtgttttgcatccctggactcacagtgattgactgagccgctcatatgygctatctttgagtgctggtcactacttctatttcagatgactttgtcagatacttaagagcgtctgtgtaggaagatgcatccatgttgcaaatctgtggagctgccatcatgatcttcacctagatttaagatgtctgttaaggaaatcaattgatgtgacagtggcctcgatcttaagcttgtcaccgttgattgtctccccgtggagttgtcagacatgagggagagcctgggcagtggcctagggagaactgagtgctgctggcgctattgagtttgttccaggaggggaaaaagg

SEQ ID NO: 169635 - DNA, 601 bp, Human
acaaagaataatcaagaatatattggaaacagatgtgcatcaagatttcaacttgaaagaccaaactgtctgaacatggcagcatagacttgaatagctgaagagcattttctgataatttctcattgagccggacatggaatcgctatatttataaatggaatttgtagcaatggggcccatgtgctggaaatggttttggcaccactaactttaactccaagtcccctcgcaagcctccctgtggtctcatgaaagactttttaaatttagcacagagcgcttgtgtcagaacacagcrggctgcaagtacatcgggaccagatgcaggagtggggtcctctggctttgcacgcaggagccaggtccgagggatttgtcaaaacaccaggagatcttcacttaatccctttttatacattaaggaacatcgtcgggtggaaacagctaagtgtcaagcagggagactaaggttttcataagatttgataaactttcattccttttctctgcaacctcaaacatgttaatatttctgtgcattttgtataaaagaatgatacaagtatgtttttaaaaattataaataacagatattgtt

SEQ ID NO: 169636 - DNA, 601 bp, Human
gaaaaagaggtgctctatttctgctgattggcatcatctcacccaacacttccctttccagtcttctggactgaatctgccattcacttgattccctgcctcctgctatatttaggctagatatagaattctaaggaagtaataattttcccccagagctttgaaactcttactttattgtgtacaagcaagcagtcaatgcaggtcatggagctaggttaccactcgcgatggcagacaggtagcatcccttgtgctcggagactcgtgttcttcagcttggagaccaccctttatttayttgacatttatcctcctctgtttctcatagaactcttattagctggatgctgggattcctttctagatttgggcctctgcacttctgatcttgtatattacctgcatctttgctttaattctttgttttacttgccgatagcacaaattttcaaccctttcgttgatttctttctaaaaatctttagcaggtttaatttcttaaaagtagaacctttcaggggttttaccccatgttaaacaccttgctgcaggtgttctggagttgggtgtcagggaagaagtacggcgggtatgggtg

SEQ ID NO: 169637 - DNA, 601 bp, Human
ttattagctggatgctgggattcctttctagatttgggcctctgcacttctgatcttgtatattacctgcatctttgctttaattctttgttttacttgccgatagcacaaattttcaaccctttcgttgatttctttctaaaaatctttagcaggtttaatttcttaaaagtagaacctttcaggggttttaccccatgttaaacaccttgctgcaggtgttctggagttgggtgtcagggaagaagtacggcgggtatgggtgtgcatttgtgtgcaagtgtgcagctcaatgcccagkcctgtgtctcatcccccagccacacacactgtggtgagctggagctcagcatgctggctccgtccccagggcagtagctctgccctgctttgctgtcagtcactgcccctgtgtcagcaccccctcttgtctgctgatggccctctctctctcgtggtggatttatttttttaatatttatttttactttttattttttatttttttgagattgagtctcgctctgttacccaggttggagtgcagtggcacaatcttggctcactgcaaactctgtctcccaggttcaagtgattctcc

SEQ ID NO: 169638 - DNA, 601 bp, Human
tttatttttttaatatttatttttactttttattttttatttttttgagattgagtctcgctctgttacccaggttggagtgcagtggcacaatcttggctcactgcaaactctgtctcccaggttcaagtgattctcctgcctcagcttcccgagtagctggggctacaggtgtgcaccaccacgcccagctaatgtttagtagagatggggtttccccatgttggccaggctggtctcgaactcctgatctcaagtgatctatgtgccttggcctcccaaagtgctgggattacaggcrtgagccaccatgtctggcctatttttgttttttaaaagtgatagtatctcactctgtcacccagactggagtgcaatggcatgatcatagctcactccagctccaaactcccggcccaagtaattctttggccccagcctcccaagtagctgagaccacaggcccacattaccatgcctggctaactttttttttttttatagagaaggggtcttgctatgctgcccagacaggtcttgaactcctggcctcaagtgatcttctcctcttagcccccaaagacctaggattacaggcatg

SEQ ID NO: 169639 - DNA, 601 bp, Human
cagcacacaaataagtctatggagacaggtggccgggtttctttagtatgcccttttatcttggagtgcttggggactggtttggacgttttttccttccagattgagtatgacagtgtctggagtggggttggtgtcattggtgtgtgccctgtgcggtcatctgggcacctgactcagtttagtcctctgttgtcatcaccttgagactcttagtcatttttgaacaaggggcctgccttttcattttgcactggggcccgagaagtatgtagctggtcctggcgaggaacttagcacracatgtcacttgtcaagagaggtaaatgtctcccattcaagtactaaccaggcccaaccctgcttagcttccaagatcagatgacatcgggtgtgttaagggttgtatggccatagacaaaagagttaaatatataaagacatttatattacaaacagcattttaaaaattgccaaatcaggccaggtgcagtggctcatgtctgtaatcccagcacctcgggaggccgaggcaggaggatcacttgagtccagaagtccaagaccagcctgggcaacatggtgaaaccccatctctaca

SEQ ID NO: 169640 - DNA, 601 bp, Human
aggttcgggaccactgctacacagtgtaacaactatttatgtagcatttacactgtattaggtattataggtaaactagaggtgatttaaagtttgtaggaggatatatgtaggttctatgcaaacaccatgccattttatattgatgacttgaacatctactgatttcggtgtctgctggggtcctggaacctaccccttgtggctaccaagggatgactgtgctcgtattttaaacagatttcggaaatgcaagcacttctcagtgaaaaggacgactccatccttccccatcaccackgaccctccctggccctccctctcctttgttctttacctgcttgtctccagatgacttgacatgggttttacgtgtttacttatggtctgaaacactcactagattgtaagctctctgaagcaggggtttttgtctcttgttctctgctgaacccagaatatctggaacatgcccagcacctgggcattcacgtgccacttgttgaagaaatgagtgtgtgactgaatgactttaggacaatcaccaaagcctttaatacagactttaaaattaaccttttctttttttaaggacacagtc

SEQ ID NO: 169641 - DNA, 601 bp, Human
ctggtggtgctggtactttctctagcttattttttactcctgtctttgatcaaagtaaggaaaggtctaattcagttagttcttgtacacaaggaaaggccaccgtgaggtaattagtgagaaagaaaacaatttggaatgaagttgtgagcgtgcatacattttaacattgacttttttcccgcaggatattgaagtaacatcatctcctgatgatagcattggttgtctgtcttttagcccaccaaccttgccggggaactttcttattgcaggatcatgggctaatgatgtaagtgcyccttaaatacgtgttctagaaatcatctctctttgtatggccaaggttagctttagctccgttgtttcccaagtaaatgaatcagttggacttatttatggccttttttgagaaatcaatttagggggtgtgaacccttctgaatggcagacattattcttacacccgtttttgttaggaaagcacaatcatatgtgttgctcgaaattttctactttagttcagtctcttgaagtttattcccaaatcaaatatcatattcatccagagtgaacattatacccagtggcacacaccaac

SEQ ID NO: 169642 - DNA, 601 bp, Human
attggttgtctgtcttttagcccaccaaccttgccggggaactttcttattgcaggatcatgggctaatgatgtaagtgctccttaaatacgtgttctagaaatcatctctctttgtatggccaaggttagctttagctccgttgtttcccaagtaaatgaatcagttggacttatttatggccttttttgagaaatcaatttagggggtgtgaacccttctgaatggcagacattattcttacacccgtttttgttaggaaagcacaatcatatgtgttgctcgaaattttctactttakttcagtctcttgaagtttattcccaaatcaaatatcatattcatccagagtgaacattatacccagtggcacacaccaacaaattccctttcttggcatcctgacagtgttcctcaggcatgtatgaaactttttcaacattaaataatagcacagatttgcctagatacttactcatcatgtacaaaaagaaagacaaaaaaattacagtttactaaaagaaagaaaactctggtagaaaaataagcaaagggtgtaaagagggacttcacaaaagaaagaataaacctgaaccattca

SEQ ID NO: 169643 - DNA, 601 bp, Human
accctgcatgtatggctggtaggtatgtaagttggcttttccacaggataattggcaatagttatcaaaaatccttcagcttataccctttatctcactgatacccttctgggacttgagtaggaaatctgataatgtacttcatctgcattatctaaattaacctttataacagccaaagcactgtgaacttgtgaaaattttgaaaattttaatatccagtagtaatggcaatgtatagtatgtttgtatgatggaataccattgtaagtttttggaaaagcttttgaactgtagcctrcagcacaggggcagcaggggttaggagaacaggagggaggatggtagtcaaggttgagcaagcttgctttctacatgtaatttttagaaagatttcagattatttgctgcttaaaaaaaggatgtttcaagttgaacaggctagtgatgcaggtgaggaaagctgtagctgcaaaagtgaagacactgtataatctagtgtcttccagaaaatatgcgtacatggaaagaagactaagagcacacagaaccattagctgtggttgtctgtggtgtgattagggtgatttttatttttttg

SEQ ID NO: 169644 - DNA, 601 bp, Human
ataattagagtatggttgatttagggttatggtgtactggggcagcactttcagagggttatgctcaaggtatcatatcagtattagggcagaagtttagttaatctattatacatagtggaggatttattgggtaggaggagccttaagattttttagaaaattacatcaatcgaggggtagctgttggggtgttcgtggttaaaatatgtctgggctctgactgggttgcattttagtttcttgtgtttggggtttggcaaaggtatgtttacctaggttgatggtaaagtcagattakgaggggggagtttgcggatttattcggaaatagttcttgaaattgagcatacgtgcatgcgtgagcatctattgattaattgttaagtccttcaaccatgaattaacaccttatggttgttatgtcagtccggaatattcagtataagttcagctacaatggatttggcaggagtcaggctgttgccatgctgagtcacagcatcccaaagttaaaaaataccaaatgcatgacagtgctcccgtgactggctaatagggtggtagtgattaatccatcaagatgtcttatttaaaggga

SEQ ID NO: 169645 - DNA, 601 bp, Human
ttaggggccacagttgctcccattttattcagtagcaaggatcagcttctctgaggcatttttatcatctgtaaaatgtcttcctgacatacctgattaagttattgtgacactacattaatagatatatgaaaagtttgaaaagtgaagcattcatttcatatgcaacttatttttagtttacacacagaaaagtagcagcatgagtagatttgaaacatttctaatgtattttgtctgtctttactgatcgggcaacgggtcagaattagaaagtttcttataaagtacggcaagaaatagaattaactaatgcaggaatccttttgctcaaatgttatctaatggctattggaatttataaaacggaatctaagtttcatagcatctagtgggaggatcagacacaggaatgagagttgtacgttctgacggggaggcaggatgaactggtgctgggtgggaaaaacaatacagaaagcagctgtaaagtttggaaaggcttctgtgaatgctttacagaagacaagaatagaggtaaatttttgtttgtttgtttgtttttgagtgttgctctgtagcccaggagtgcagtggtgcg

SEQ ID NO: 169646 - DNA, 601 bp, Human
ttagacaatataacagaaacctctttagcacaaaaataacaattttataaccattctcattcttaactagtgttcacagattgtcttgtcatggatcttcatatatgtatggatggagtcataaggagttagtgacattaaaatctatgaaagacaggtcataggtggtccttgccattcacaggttggacgttgtgacctcgtgcatggctggtcttctaccaactgcatttggtcacttactcattcagcaagtgttctgtctatgggccagtaatagagcagcgagtaagaggggcayttccccacacgtgtggaacttttaccgttactcagggaccactggcaggtactgtgtgaagaatgccaagggcagaagtaatgaagataagagaacttagaaccagagggtccagcctgctaagggggcttcaggaagagcacagtgctgaaacattttcaggaaggcactgcatactcaggtcacagtgctgtgtgctagaaacatctcattgatctcttaattcccatcacctcagtgagtaaaactgtggtggaatcccctgcttgttatttctgaatatctccctaaggaggagct

SEQ ID NO: 169647 - DNA, 601 bp, Human
gggcatcttggatgaaatgtcctttattccctcacctcccactcatttctaactcagtgagacctttgccccccattgttccaccagaactgtttttggcgtgactaccagtggcatcctcattggtaattccaggggaccctggacacccatcctcttactggaacagagcttcattcactgttcttacaagaaacatttcccctggctgctgtcttgccagcctcttacccgctacctctgtggctcttctatccttgctggctcttggctgaatgtggaggttccacagacatctccmtaagccgctgcctcctccacccaagcacaactgatctcccatccactgtcgctcagccacgccctgtggactggagactcgtacctcattcctgtgctcctgacatggacacccagtcggacagctccttggtgtgtctcccaggcgtctgaagctacggtatcccacaccaaacccaagactacattctgtagctctttattcacatgttacccttgcctcaggattctcccttgctactgccaccagtaccatctactttatacgtatgtatggatgtcatatacatactaaatattt

SEQ ID NO: 169648 - DNA, 601 bp, Human
cttaatcaatgggatgaaatttcattaaacaagatgagaatgttctagagatatgccgtactacatggtacctgtagtcaacaataatgtagacttagaaatgtgttaagcggtggctctcatgttcactcttcttaccacagtaaaatcagcacttagaccttggccctggttcaaggcgtcctccggagctgaggcaggggctcttgtaagcggcaccactggccttgccggaccccagcctaagcccttccctgcctccccatttccttttggttgaatccaaaaaaaacctggtccyatctggcttcacttcctgccacccggtgctagcgccctggcctctccgttgttgagaactgattgccatcggcctttgcacagggccagtgcatgtggctcttggtgcaagtgacacccctggcattgtgcagttcctggtgtgccgcacagtagaccctgtgctgatgaccagccatggccttttctgtcatctaagaacttacagatgtttgtcagtttgctttactttttttcttcgtactcacaaaagtaatggtctggcagtttttaaaaaggcaggggagcaaacagtacagga

SEQ ID NO: 169649 - DNA, 601 bp, Human
ctgtgctgatgaccagccatggccttttctgtcatctaagaacttacagatgtttgtcagtttgctttactttttttcttcgtactcacaaaagtaatggtctggcagtttttaaaaaggcaggggagcaaacagtacaggaatgaaagaggaggccgttttccttcgtacttaggaaacgtgcatcaccagcagctgtcacgatgccagaggctgcttctcccttcgtcttgcctggcccctgcctgggtcctgccaggcttcccctgaactcacacggaagctcagatgaccagcttargcagggtggatggccctccaagctttggccaggttgccacgactggaaggaggaagtggtaactccaaagttggcttctcctcggggtggtcggcttttctgcccaggaggctgggtagtggaatttctgggttcttctgtagaatagagacctgcccttgggccctcacactcaacactgggcgaagtgcagcgtgttgcttgtctgtagcatggccactgcacccaccgtccccttcaccctgttaccctgtgagacgggtgcggcagagcctgcatccctcctccagctggggaggc

SEQ ID NO: 169650 - DNA, 601 bp, Human
aggacatttatgcggtacgtttttagacactttaaccgtggtaatacatctggaaaccagacttggaggtggctgaggaattgtgggatcagaaaagactcatcactgaagagcttgtgtgttcatgtccggagataagtggcttatgctgtaggcttcaggtttctgtggatttttgttgttgtttttgagacggagtcgctctgtcgcccaggctggagtgcagtggcgtgatatcacctcactgcaacctccgcctcctgggttcaagcgattctcctgcctcagcctcccaagtagytgggactacaggcgcccagctaatttttgtatttttagtagagacggcgtttcaccatattggccaggctggtctcgaactcctgaccttgtgatttgcccgcctcggcctcccaaagtgctgggattacaggcgtgagccaccgcacttggccttgttttctgtgttaacgtgccgcctaactagcagtgttgtgtatttgtttctgaacataagcttaggatgttttgccgagagtcttctccctccctcaggagcgctggtagacagttcacacccacagctcagactgagaaatct

SEQ ID NO: 169651 - DNA, 601 bp, Human
aggccccgaacttagacacagaagtccagctgattgccttccatccctctgacccctccaggcctgctgctgcttctgtgtttccctgtttgagggtttgctgtgtgagccatgaagctgtgttctttttttaaagcaactttattgaggtacaattgaaatacagtcattgtttaaagtgtacaatttgatcagtttcaacatctgtaaatacccatgaaactatcaccatagtcatctccccgaaaggtttttgtgtatattactgtaatcttcccttacgcacacacaaaaccatggrtctgttttctggcattatggactagtctgaattttctagaattttatataagtggagccctacgctacattttcccctcgccccagcttctttccctcagcataaggattttgaaattcacccatgctgttgagtgaatcacttgtccgttacttttcagtgctgggtagtattcccgggtggggtgtgccatttgtttatccattcacctgtgtaagccatgcactcagttttgtgacaagagtgtacttttttggttctgcctggctgggggtggacaggctgtggcgtgcgtggagc

SEQ ID NO: 169652 - DNA, 601 bp, Human
cgttatacgcgttaaaaaatgtagtaaattgaaagcagtgagaaaggtaattgctttgagtgctgtttaaaaattgaagtaaaatctcattcatttaagcagttaatgtcagcttattgtgggggttacataaattagcatctttttagtttaaaagagaaatttgcttcaggggtttttcattgttcttagttcaaggacagttatctccagtgcaaagtcatgatcacatatgattgatgttattagcttgctgcttgagttactgttcagaaaaactacactttgtatattatgagarttagtggtcactgttgagcaaaacttctagagctttcttggcatgcctgttgggaagagaataaaaatgtgtcatcagagtacaggtgacagagtgcacccagcgccatgccccacctccctcttccagtcctttggcccacctgcggctcctgcctgctgtctttcttccggatcatctgcctggcccaccccactcacctctcttcttaaaacttaaatgtgatcacatcactgacctgcctacagcctccttttccctggggaataacgttcaaaggcctccctctgccattcacag

SEQ ID NO: 169653 - DNA, 601 bp, Human
cgccatgccccacctccctcttccagtcctttggcccacctgcggctcctgcctgctgtctttcttccggatcatctgcctggcccaccccactcacctctcttcttaaaacttaaatgtgatcacatcactgacctgcctacagcctccttttccctggggaataacgttcaaaggcctccctctgccattcacagccctgtagtctggcctcatcctgatttcgggggtctttcgatgctgtatagccctgcatcccctccggtgtgggcccgggcagacgtgcacacctccgcacacrcctctggctcactcaccaccgttcatgcctctgctgtgctccgtgtctgttgctccttccatgtggggcggggtgtcctccttcatccccatgataccccgcaggtcagatgtcctcctttctgtgaagcattctcaggtcagaactaattctgaccaagggacccaaggcagttatcctggcgttaaagtcctggggtgttaaaagggggctcagtgttgaaaaggaactcacaggttcctactcacagactctctcagtaggacattgatgacacactggtaccaaccacatccttag

SEQ ID NO: 169654 - DNA, 601 bp, Human
cttaaatgtgatcacatcactgacctgcctacagcctccttttccctggggaataacgttcaaaggcctccctctgccattcacagccctgtagtctggcctcatcctgatttcgggggtctttcgatgctgtatagccctgcatcccctccggtgtgggcccgggcagacgtgcacacctccgcacacgcctctggctcactcaccaccgttcatgcctctgctgtgctccgtgtctgttgctccttccatgtggggcggggtgtcctccttcatccccatgataccccgcaggtcagawgtcctcctttctgtgaagcattctcaggtcagaactaattctgaccaagggacccaaggcagttatcctggcgttaaagtcctggggtgttaaaagggggctcagtgttgaaaaggaactcacaggttcctactcacagactctctcagtaggacattgatgacacactggtaccaaccacatccttaggcctttctctgaggactgaagttctgcttcgcatttgactttatctttgttgttttatttctctgagagattatatgtttccagtattgtagcacaggacttcacctagaa

SEQ ID NO: 169655 - DNA, 601 bp, Human; identical to SEQ ID NO: 36828

SEQ ID NO: 169656 - DNA, 601 bp, Human; identical to SEQ ID NO: 36829

SEQ ID NO: 169657 - DNA, 601 bp, Human; identical to SEQ ID NO: 36830

SEQ ID NO: 169658 - DNA, 601 bp, Human; identical to SEQ ID NO: 36831

SEQ ID NO: 169659 - DNA, 601 bp, Human; identical to SEQ ID NO: 36832

SEQ ID NO: 169660 - DNA, 601 bp, Human; identical to SEQ ID NO: 36833

SEQ ID NO: 169661 - DNA, 601 bp, Human; identical to SEQ ID NO: 36834

SEQ ID NO: 169662 - DNA, 601 bp, Human; identical to SEQ ID NO: 36835

SEQ ID NO: 169663 - DNA, 601 bp, Human
tctcccaccactacgctgtaaaggctaatccgcacattccttctgacaataacatgacaggtcccacacatccctgcctgtgccctaaccccggtgacagtgccagagtgcattaaggcgaagccttgcagtggcttgccaagaaaccagtgtgccaacagcccccccgctaagactgaagagtgagcgtgaaagaattaatgtggccagaagcatggtgcaaagggctccccattcaaaatattcaggctgttacacggatgggcagatggggaagggtggagacgggggagacttaggrcacgctgattcttgcaatgggccaaatatgaccttaccaaatgagggagagatattaaagtgataggagtgatcaatcaacttagatgggactctccctggaatgaagtcaccagttgtctctgagttcagcggacacgtgatattcactcacatcgcaggcattccggtggtgaggggatcgcgcaccagctgtgtttatctcggcaaaggcttgagagcctactacgccatggtaaagccccaaaccgtagcttgagagggctgcatctcaaaagcggtttcgtctgtctgtgcattc

SEQ ID NO: 169664 - DNA, 601 bp, Human
cagctgcagtgctctcccaccactacgctgtaaaggctaatccgcacattccttctgacaataacatgacaggtcccacacatccctgcctgtgccctaaccccggtgacagtgccagagtgcattaaggcgaagccttgcagtggcttgccaagaaaccagtgtgccaacagcccccccgctaagactgaagagtgagcgtgaaagaattaatgtggccagaagcatggtgcaaagggctccccattcaaaatattcaggctgttacacggatgggcagatggggaagggtggagacggrggagacttagggcacgctgattcttgcaatgggccaaatatgaccttaccaaatgagggagagatattaaagtgataggagtgatcaatcaacttagatgggactctccctggaatgaagtcaccagttgtctctgagttcagcggacacgtgatattcactcacatcgcaggcattccggtggtgaggggatcgcgcaccagctgtgtttatctcggcaaaggcttgagagcctactacgccatggtaaagccccaaaccgtagcttgagagggctgcatctcaaaagcggtttcgtct

SEQ ID NO: 169665 - DNA, 601 bp, Human
aaatttctatttttgtctatgttttatgaagcacaagctatcctagctatcctgcagtagttatacaacttattactatttaaggtatgtacctgaaaaggtagtagtgggaattggagatcaaaagcatttagaagagactgcttagaatgtcttcatgccatatgtgcaccgaaacaaccaatatctgagcaccttctatgccatgagaattctgcaaggctgtgcatgggcaggagaataaggctgtctgaaaaaaaacaggaaaagtgtcctttattgaaggccaaaacacaagccmccaaaaaaaaaaaaaaaaaaaaacttgcctgcctttgtgtgtgtaagttgccagggggatgagcacttggaccattatatgccaactgtcatgctaagagcttagctttttctttttcttcatgtagtccaagctacatgaaagcagaagacaggctggaagcacaagacagggcaggcctaaacccaatgcttagaaacacacaagtcctcgattttggaaacggtgcaagtttttattcgtggccaattttaattaagccaggcaacaaaagattgaaacttgaaagctactccaggg

SEQ ID NO: 169666 - DNA, 601 bp, Human
agtcctcccagggtgaacatcttccacaaccacagggcatttgacaaaaccgagacgttcacattgctgtgtaactgtcaactcgactccagatttgtttcagactgtaccagtgtttccacagatgtccttgttctggcctaagatccagtccaggataccacattgtattttcttttggtttctttccttttttttttttttttttttttttgagacagagttgctctgtcacccaggctggagtgcagtgatgtgatctcggcttactgcaacctctgcctcccgggttcaagcgatactcttgcctcagcctcccaagtagctgggactaaaggtgtgtaccaccacaccccactaatttttgtatttttagtagaaacggggtttcaccatgttggccaggctggtctcgaactcctgacctcagatgacccacccacctcagcctcccaaagtgctgggattacaggcgtgagccaccgcgcccagcctcttttggtttcttcttattaaaagacagaaaacttgacagaaataggtgagatttatttgaaactctcatcaaaactatcctttccctcctccccacgggcagctc

SEQ ID NO: 169667 - DNA, 601 bp, Human
aaaaaaataaataaactttttattttagaataactttataagaacattgcaaagctagtacagagaatacttgagtacccttcacccagtcctcccagggtgaacatcttccacaaccacagggcatttgacaaaaccgagacgttcacattgctgtgtaactgtcaactcgactccagatttgtttcagactgtaccagtgtttccacagatgtccttgttctggcctaagatccagtccaggataccacattgtattttcttttggtttctttccttttttttttttttttttttttttgagacagagttgctctgtcacccaggctggagtgcagtgatgtgatctcggcttactgcaacctctgcctcccgggttcaagcgattctcttgcctcagcctcccaagtagctgggactaaaggtgtgtaccaccacaccccactaatttttgtatttttagtagaaacggggtttcaccatgttggccaggctggtctcgaactcctgacctcagatgacccacccacctcagcctcccaaagtgctgggattacaggcgtgagccaccgcgcccagcctcttttggtttcttcttatt

SEQ ID NO: 169668 - DNA, 601 bp, Human
tctgggcgtggtgatgcacgcctgtaatcccagctactcgggaggctgaggcaggagaattgcttgaacccgggaggcagaggttgcagtgagccgggatcgcgccaccgcactccagcctgggtgacagagcaaggctctgtctcaaaaaaacaaagcaaaacaaaacaaaactcaggcttttttactttttgcactttcccaggtaggggacatagcgtgtggaaagcagggatcaataaaccccatgaagagccagacagaaactattgtaggcctcggtcaccatcgtgtctgtggmaactgctcaaccctgtcgcagcggcagtaaagcagtcagagtgaatgcgtaagtggatagatgtgttccaataaaactttatttacagaccttgaaatttgaatttcatgtcattttagtgtcatgaaatatgattcttctcgagtatttatcacacttttaaaaaatgtaccagccattcttagcctgcaggctgtactaaaacaggttgtgggctggagttggcccgcgggctggggtctgaagcaagcaggtctccctgctccaagcagcatttaagctacagggagacacgggaaa

SEQ ID NO: 169669 - DNA, 601 bp, Human
tttgagtccagcctggccaacatgttgaaaccctgtctccactaaaaatacaaaaattatctgggcgtggtgatgcacgcctgtaatcccagctactcgggaggctgaggcaggagaattgcttgaacccgggaggcagaggttgcagtgagccgggatcgcgccaccgcactccagcctgggtgacagagcaaggctctgtctcaaaaaaacaaagcaaaacaaaacaaaactcaggcttttttactttttgcactttcccaggtaggggacatagcgtgtggaaagcagggatcaatamaccccatgaagagccagacagaaactattgtaggcctcggtcaccatcgtgtctgtggcaactgctcaaccctgtcgcagcggcagtaaagcagtcagagtgaatgcgtaagtggatagatgtgttccaataaaactttatttacagaccttgaaatttgaatttcatgtcattttagtgtcatgaaatatgattcttctcgagtatttatcacacttttaaaaaatgtaccagccattcttagcctgcaggctgtactaaaacaggttgtgggctggagttggcccgcgggctggggtc

SEQ ID NO: 169670 - DNA, 601 bp, Human
gttttgttttgttttgttttttttgagacagagtctcactctgtcccccaggctggagtgcagtggtgtgatctcggctcactgcaagctccgcctcctgggttcacgccattctcctgcctcagcctcctgagtagctgggactacaggtgcccaccaccacgcccagctaatttttttttgtatttttagtagagacgatgtttcaccgtgttagctagcatggtcttgatctcctgatgtcatgatctgcccgcctcggcctcccaaagtgctaggattacaggcatgagccaccackcccggctgactgctgaacgagttctaaatgaaacaccattcctctccacagaagcaggtagtggccattaggatgtgtatctcttatagtatctgctgtcccagagggtgttataggtccttaagtgtaagtataacacccagagggtccttaagtgtaggacctgtatcataccaaacttcttaccttctagtgtttgaaggcaagtgttttggtatgatacaggtcctacactcaagcagattatttcatcccatgtgcaacggaagaagcagtgatctgctgcaacactgggagaga

SEQ ID NO: 169671 - DNA, 601 bp, Human
ttgttttgttttgttttgttttttttgagacagagtctcactctgtcccccaggctggagtgcagtggtgtgatctcggctcactgcaagctccgcctcctgggttcacgccattctcctgcctcagcctcctgagtagctgggactacaggtgcccaccaccacgcccagctaatttttttttgtatttttagtagagacgatgtttcaccgtgttagctagcatggtcttgatctcctgatgtcatgatctgcccgcctcggcctcccaaagtgctaggattacaggcatgagccaccrcgcccggctgactgctgaacgagttctaaatgaaacaccattcctctccacagaagcaggtagtggccattaggatgtgtatctcttatagtatctgctgtcccagagggtgttataggtccttaagtgtaagtataacacccagagggtccttaagtgtaggacctgtatcataccaaacttcttaccttctagtgtttgaaggcaagtgttttggtatgatacaggtcctacactcaagcagattatttcatcccatgtgcaacggaagaagcagtgatctgctgcaacactgggaga

SEQ ID NO: 169672 - DNA, 601 bp, Human
acacacagtttagcccaagagacaaggagaagtcttccaaggaacttctaggaaaccaagaggtaggcaggcaggcaaggagagctctttgtgccattccccatcctcctgccttgaatgtgagattgcatgaggatgaactggctggggcggcagcagccattttgtaagcatgaggtaagagacatgaggaatttgaggatggtggtagggggaggtgggaagctcatggatgcttggacagtatcactgagctgcccctgcaaacgtgaactcatctccctgaagacttgctattagrggagataatgacatgtttttgtgctgaagccatgctaggcaggtgttctgtgaactgcagctgaatgagttttttgtttttgttttgttttgttttgttttgttttttttgagacagagtctcactctgtcccccaggctggagtgcagtggtgtgatctcggctcactgcaagctccgcctcctgggttcacgccattctcctgcctcagcctcctgagtagctgggactacaggtgcccaccaccacgcccagctaatttttttttgtatttttagtagagacgatgtttcaccgtgt

SEQ ID NO: 169673 - DNA, 601 bp, Human
tcttctgtcttctttgctccatcattgtctgcatgttgacttaattcttaggcctcttgtcccacagtcacaagatggctgctgtggttccaagcaacatgtcttcacaaaaccacattcaaggcaagacaatggggacgagaacagagagttccgtttgctcagcagccatttaatagaaagcaaaatatttttcagaaccacctctcagcttctcccctaatcatctcctccaaccaacgggcttaaggaggcacccagaccctatcacgttagtctcccacgggaataagcagaaggmatataggtgcccagaaccctttactagaaaacatttgatcaggctcccagtgtaagcatgaggttccaccattccaccagggcaggcaggcgtttctttcaagcagctctccacccttggctaacaaacactgacacagattcttaaaatgctttgagtctcttgctctgttcatcctccactcaggggaaacaggagccgcctgtcccacaagcagaactcaaaccaagctccaccccagcctctgcttcctcccaggggacaataattcctgacctcctcgggtcattttcaagaaat

SEQ ID NO: 169674 - DNA, 601 bp, Human
gttcaaacatatgactaagaaccccaatttcttctgtcttctttgctccatcattgtctgcatgttgacttaattcttaggcctcttgtcccacagtcacaagatggctgctgtggttccaagcaacatgtcttcacaaaaccacattcaaggcaagacaatggggacgagaacagagagttccgtttgctcagcagccatttaatagaaagcaaaatatttttcagaaccacctctcagcttctcccctaatcatctcctccaaccaacgggcttaaggaggcacccagaccctatcacrttagtctcccacgggaataagcagaaggcatataggtgcccagaaccctttactagaaaacatttgatcaggctcccagtgtaagcatgaggttccaccattccaccagggcaggcaggcgtttctttcaagcagctctccacccttggctaacaaacactgacacagattcttaaaatgctttgagtctcttgctctgttcatcctccactcaggggaaacaggagccgcctgtcccacaagcagaactcaaaccaagctccaccccagcctctgcttcctcccaggggacaataattc

SEQ ID NO: 169675 - DNA, 601 bp, Human
ttttagaggcaaatcaaatcaaatgagaatttataatccttcctgaggcctgggttccatcagcctaaactcattaggcccaggagatgcaggtgcagtgaaggaaaagatggttctgcctttcctccatgcccagcccctgtctccctttcaaaataagagtcttctttaaagccacactctgtccctggaccacagtaatcagcttcatttctgaaaacaggaaggtgcagagacgtacaaaagccgccccaggggctgatggggcagatttggtgggaactggaaatcttgaagagcctcactcatttcaagttcacattgtaagaactcaaacttaaatccctaagctaaacgatcaaaacacccttcaaattgcatggttgtcctttaaacctctttccggtgtgggaagcaggagaatatgagatcaaaacaaaaaagtggtgtttttttttaatttttattttttatagagatagggtctcactctgtcactcccaactggagtgcagtgatgtaattacagctcactgaagccttggactcctgagctcaagtgatcctcctgcctcagcctcccaaagtgctggaattacag

SEQ ID NO: 169676 - DNA, 601 bp, Human
tcccatagcctaactactgggattattttggtgagagacctgctgacctgtttctccactgtcctctcttctagattttaactccaggaaagtaagaactgagcaaaggagcaggactcaggaggtttccagagcagagccgggcgagagggcgagtctcggctctgccacttgctggggcgcgtcactcctcttctgtgaaatgcaggtgtagtaatagcactgactccactgggctgccagttaaagcccaggagtaaagtagaccaggcatgctccaccttcaggatgcccagagtcrcacgcgagcttattacagcacaggccactgggccccacttccagcatgtctaaggtgggtgatctagggtgggcccaagagcatgaatgtctaacacatgcccaggtgatggtgataatgcaggtctagaaaccccactttgagaaccagaggaaaggagagtgtccatggagtgcctggcacatgtaatagtcttggaagctattcgctctgattgctctgttgcttagcactgttcacacaccacctcccacgctcacttgctgggcactcagcagcttctccggagacttagtgaag

SEQ ID NO: 169677 - DNA, 601 bp, Human
agaccagcctggctaatatgccaaaaccctgtctctactaaaaatacaaaaattagctaggcgtggtggtgcattcctgttctcccagctactcaggaggctgaggcacaagaatcgcttgaacccaggaggcagaggttgcagtgagctgagatcgtaccactgcactcctgggtgacacagcaagactctgccctaaaaaaaaaataattaaaaaaattaatgaaatggcgttcccagtgtgagaaattcaggaatttaactcctgacttacgggtttgaggcctgggatgggggctgytgaacaggtacaaggatcctcactctgctcatggggtcacctagggagcaaacactccccaccaagcacctggcgagtggtatcctgctggtaattgttagacgtgccaagttcacgaccgcagaggctttgctccaggcctgcccgggcaccgcagcccctccccacggctgagttggtctcacccccactgacactctccctgggcctccttccctctcagcccctttcatttccctcccatagcctaactactgggattattttggtgagagacctgctgacctgtttctccactgt

SEQ ID NO: 169678 - DNA, 601 bp, Human
attccatctcaaaaaataaaataaaatctaaacagctgtatgtggctcatggccttcctagtggacagcccagatcacaggtgtccccatcattgaagaggtgctgtcgcccacactgctttgtagcaccaagggtttgcagggggccactgcaaatgagggtccccgactatgttctcagagatgtaggagaaagtttttctttaaaactgtgggattggtggctcacgcccataatcccagcactttgggaggtcgaggcaggtgtatcacttgagtccgggagaccagcctggctaayatgccaaaaccctgtctctactaaaaatacaaaaattagctaggcgtggtggtgcattcctgttctcccagctactcaggaggctgaggcacaagaatcgcttgaacccaggaggcagaggttgcagtgagctgagatcgtaccactgcactcctgggtgacacagcaagactctgccctaaaaaaaaaataattaaaaaaattaatgaaatggcgttcccagtgtgagaaattcaggaatttaactcctgacttacgggtttgaggcctgggatgggggctgttgaacaggtacaagga

SEQ ID NO: 169679 - DNA, 601 bp, Human
ctactgagcacttgaaatgtggcttccgtgactgagatctgaatgtttaattgtatttcattgtaattaatttaaatgtaaacagctgccaggcacagtggctcatgcctgtaatcccagcactttgggagggcaaggtgggtggatcacttgaggtcaggagtttgagaccagcctggccaatatgctgaaacatcgtctctactaaaaatacaaaaattagccaggcatggtggcacgtgcctgtaatcccagatactcgggaggctgaggcacaagaatcacttgaacccaggaggcrgaggttgcagtgagccaagatggtgccactgctctccagcctgggcaacagagcaaaaattccatctcaaaaaataaaataaaatctaaacagctgtatgtggctcatggccttcctagtggacagcccagatcacaggtgtccccatcattgaagaggtgctgtcgcccacactgctttgtagcaccaagggtttgcagggggccactgcaaatgagggtccccgactatgttctcagagatgtaggagaaagtttttctttaaaactgtgggattggtggctcacgcccataatccca

SEQ ID NO: 169680 - DNA, 601 bp, Human
tgaatttctctgaagtcccttttctcgcctattagactgtaccatgtaaaaagctgctgatactctaccagttttgacctgtatggggttcaccctaacacctcggggcagcttggaggctctatctgtgctgtctggtaaagcacactgagacacgtggggctactgagcacttgaaatgtggcttccgtgactgagatctgaatgtttaattgtatttcattgtaattaatttaaatgtaaacagctgccaggcacagtggctcatgcctgtaatcccagcactttgggagggcaaggygggtggatcacttgaggtcaggagtttgagaccagcctggccaatatgctgaaacatcgtctctactaaaaatacaaaaattagccaggcatggtggcacgtgcctgtaatcccagatactcgggaggctgaggcacaagaatcacttgaacccaggaggcggaggttgcagtgagccaagatggtgccactgctctccagcctgggcaacagagcaaaaattccatctcaaaaaataaaataaaatctaaacagctgtatgtggctcatggccttcctagtggacagcccagatcacag

SEQ ID NO: 169681 - DNA, 601 bp, Human
ggcagccagcattttagaagccctcccactggcctggctgccacttcacatgtatatatcatctcactgaatccttatgaaaacccctctcagaggcagggggacacatcgtgctcactttccagatgaggacactgaggctcagactgactcttgcccagggtcacacagctgatctgaatctttaaaggcccgtactcttccccactcagccataccaactctcttcctcacatgggagctgccagtgacctcttagctgtggcaacgattcaataaggacagctctgagctgaaccaygctctgctcttggcacactcgatgcactcgccacataaatctccaaagctaaactcaaagtgaaggttctgcatccgactcagctccctctcagacttgtaaattttgctcctgcctaatgccagtccttgagggagggaggctgacagcctgaaggttttgtagcattcacccatctcctcattacccctccccaggcccccagattggggggcagggccctgcctggcaaagggcacacaggcagcattgtctcccctgttcctgaactgcttcaactctcgaactttccaccaaatg

SEQ ID NO: 169682 - DNA, 601 bp, Human
tcagatcttgtgagaattagtcattatcaccaaaacagcatgggaaagactggactccatgattcaattacctccccctgggtgcctcccacaacacgtgggaattctgggagatacaattcaagttgagatttggtagggacacagccaaaccatatcagtgaccatcctgatggctgtgaggtgggcagccagcattttagaagccctcccactggcctggctgccacttcacatgtatatatcatctcactgaatccttatgaaaacccctctcagaggcagggggacacatcgtgcycactttccagatgaggacactgaggctcagactgactcttgcccagggtcacacagctgatctgaatctttaaaggcccgtactcttccccactcagccataccaactctcttcctcacatgggagctgccagtgacctcttagctgtggcaacgattcaataaggacagctctgagctgaaccatgctctgctcttggcacactcgatgcactcgccacataaatctccaaagctaaactcaaagtgaaggttctgcatccgactcagctccctctcagacttgtaaattttgctcctg

SEQ ID NO: 169683 - DNA, 601 bp, Human
ccaacaagttccttatctctatctgagaccacttcagcctggattttattgtccatatcactatcagcgttttgggcaaagccattcaacaagtctctgggcaattccaaacttttccacattttcctatcttcttctgagtcttccaaactgttccaatctctacctgttagccagttccaaagtcacttccacatttttgggtattttctcagcaatgccccactttactggtaccaattaatgtattagtccattttcatgctgctgaaaaagacatacccgagactgggaagaaaagggtttaattggacttacagttccacatggctggagaggcctcagaatcatggcaagaggtgaaaggcacttcttacatgacagcagcaagagaaaatgaggaagatgcaaaagtggaaacccctgatcaaaccatcagatcttgtgagaattagtcattatcaccaaaacagcatgggaaagactggactccatgattcaattacctccccctgggtgcctcccacaacacgtgggaattctgggagatacaattcaagttgagatttggtagggacacagccaaaccatatcagtgacc

SEQ ID NO: 169684 - DNA, 601 bp, Human
tgaccatggcttttccaggcacacggttcaagctgttggatctaccattctggggtctggaggacagtggccctcttctcacagctccactatgctgcaccccactagggactctgtgtgggagtcccaattccacatttcccttccccactgccctagcggaggttctccatgagggacccactcctgcagcaaacttttgcctgggcatccaggcatttccatacattttctgaaatctaggtgcagattcccaaacctcaattcttgacttctgtgcacccacaggctcaacaccacrtggaagctgccaaggcttggggcttctaccctctgaaatcacagcccaagctgtacattgacccctttcagccatggcttgagtggctgggacacaggccaccaagtccctagggtgcacacagcagggggacccagagactggcccatgaaaccactttttcctcctgggcctccaggcctgtgatgggaggggctgccatgaaggtctctgacatggcctggagacattctccccatggtcttgaggattaacattaggcttcttgctacttatgcaaatttctgtagccagcttgaa

SEQ ID NO: 169685 - DNA, 601 bp, Human
catctgagacaaagcaagtcccttctgcctatgagcctctaaaaccaaaagcaagctagttacttcctagatacaatggaggtacaggtatcaggtaaatacggccattccaaatgggagaaattggccaaaataaaggggttacagggcccatgcaagttcgaaattcagcagggctctcaaactttaaagctccaaaatgatctcctttgactccaggtctcacatccaggccacactgatgcaagaggtggcttcccatggtcttaggcagctccacccctgtggctttgcagggtayggcctccctcccagctgctttcatgggctggcattgaacgttgagtgaccatggcttttccaggcacacggttcaagctgttggatctaccattctggggtctggaggacagtggccctcttctcacagctccactatgctgcaccccactagggactctgtgtgggagtcccaattccacatttcccttccccactgccctagcggaggttctccatgagggacccactcctgcagcaaacttttgcctgggcatccaggcatttccatacattttctgaaatctaggtgcagattccc

SEQ ID NO: 169686 - DNA, 601 bp, Human
cacctataaatggaatcacacagtatttgtccttttgtgaccggcttatttcacttaacaaaatgtcttcaagtttcatccgtgctgtagcctgtcagaatgtccttcctttttaaggctgaataatattccactgtatggatgggccacattttgtttattcatccctgaatggtatgcagcttccacatttttgtgattgcgagtaatgctgctgtgactatgggtgtgcaaatatctcttggagatcctgctttcaaatctttcagggacatacccagaaatgaaatcgctgtgtcayattgtagctctattttcaatatttttgaggaagcaccattctgttttccatagtggctacagcattttaccttcccgccggcagtcgggaagggttccaatttctccacatgtccaccaccattgtgattttctgttctgttttgttttgtttgatggtgactgtattagtctgttttcatgctgctgacaaagacatacccgagaccaggaaaaaaaaaaagaggttaaattggacttgcagctccacatggctggggaggcctcagaatcatggcgggaggcaaaaggcacttcttac

SEQ ID NO: 169687 - DNA, 601 bp, Human
ttgcacatccagtctccaggacttttttcatcttgcaacgccaaaactctgtccccattaaacactaactcccctttcttcctccctcctccagctccaggcacccacccttctactttctgtctctatgaatctgactgctttgggcaacacctataaatggaatcacacagtatttgtccttttgtgaccggcttatttcacttaacaaaatgtcttcaagtttcatccgtgctgtagcctgtcagaatgtccttcctttttaaggctgaataatattccactgtatggatgggccacrttttgtttattcatccctgaatggtatgcagcttccacatttttgtgattgcgagtaatgctgctgtgactatgggtgtgcaaatatctcttggagatcctgctttcaaatctttcagggacatacccagaaatgaaatcgctgtgtcacattgtagctctattttcaatatttttgaggaagcaccattctgttttccatagtggctacagcattttaccttcccgccggcagtcgggaagggttccaatttctccacatgtccaccaccattgtgattttctgttctgttttgttttg

SEQ ID NO: 169688 - DNA, 601 bp, Human
tagtaaataatcacccagcagctccttccaaaactttatggtcttcagaaaaaatttggttaaccttccagactatgcggccctctcactgcccccaaagatgccgctaaactatgaggcaggaacaaatattttatgagcaaagggatgctttccaggcaaaaaccacaagtccagcattagaattccatgttcctcactcagagtctggtttctgtgagcacagactagtccaaagcattcttcagctccagttaggggccggggacagacccccacaccccactttaatgaggatgargctcaaggggctaaaagaactaatcgaagtccacattataaccagaagtcagaactgggttttcacagacccgaggactgctcagggccccatatcccggaacgtccccggtacccatttaactctgaaactaccaaccctggctcgctctttccctggagggctacagctcatctggaaggttctggcacacaccagaactcactggagctgacttatcccggctgctgttaggaggcagtttacgacccacagtttcagggatgtgaaatttgatgatggctcttcattcattcattc

SEQ ID NO: 169689 - DNA, 601 bp, Human
ggatttggtcactggttgctcagagacctcaggaagcagctctcatggggacagccatgcataaaaaaaaaaaaaacacctgacgagcaagactgtggccagttgcacatgaaagatatttgtatccatgaaaaggggaaccgtcagcccaggcaaagccgccttcatttcctcctgaagccgttctcccagccagggctggaaagagttgataaatggatagtaaataatcacccagcagctccttccaaaactttatggtcttcagaaaaaatttggttaaccttccagactatgcggycctctcactgcccccaaagatgccgctaaactatgaggcaggaacaaatattttatgagcaaagggatgctttccaggcaaaaaccacaagtccagcattagaattccatgttcctcactcagagtctggtttctgtgagcacagactagtccaaagcattcttcagctccagttaggggccggggacagacccccacaccccactttaatgaggatgaggctcaaggggctaaaagaactaatcgaagtccacattataaccagaagtcagaactgggttttcacagacccgaggactg

SEQ ID NO: 169690 - DNA, 601 bp, Human
ggtttatggataaagttatgcacgaaaaatgcatttatgatgagaaagactagcatggccttggatcaatatttggggctacctgggagggggagaacgatgccaccagaaggacttggtccaaaggaagggaaggaccagaggactggcagggcaagatggcgcaacagtggccagattcagagaaagggggcagggagacccctcttccagggaccattcactggatttggtcactggttgctcagagacctcaggaagcagctctcatggggacagccatgcataaaaaaaaaaaaaacacctgacgagcaagactgtggccagttgcacatgaaagatatttgtatccatgaaaaggggaaccgtcagcccaggcaaagccgccttcatttcctcctgaagccgttctcccagccagggctggaaagagttgataaatggatagtaaataatcacccagcagctccttccaaaactttatggtcttcagaaaaaatttggttaaccttccagactatgcggccctctcactgcccccaaagatgccgctaaactatgaggcaggaacaaatattttatgagcaaagggatgctttcc

SEQ ID NO: 169691 - DNA, 601 bp, Human
aagctgggagctgttgaattgggtttatggataaagttatgcacgaaaaatgcatttatgatgagaaagactagcatggccttggatcaatatttggggctacctgggagggggagaacgatgccaccagaaggacttggtccaaaggaagggaaggaccagaggactggcagggcaagatggcgcaacagtggccagattcagagaaagggggcagggagacccctcttccagggaccattcactggatttggtcactggttgctcagagacctcaggaagcagctctcatggggacagycatgcataaaaaaaaaaaaaacacctgacgagcaagactgtggccagttgcacatgaaagatatttgtatccatgaaaaggggaaccgtcagcccaggcaaagccgccttcatttcctcctgaagccgttctcccagccagggctggaaagagttgataaatggatagtaaataatcacccagcagctccttccaaaactttatggtcttcagaaaaaatttggttaaccttccagactatgcggccctctcactgcccccaaagatgccgctaaactatgaggcaggaacaaatatttt

SEQ ID NO: 169692 - DNA, 601 bp, Human
ccttgatctctaaggatgtaatccagtgctctgggaagccccttgccagcaccttgcagggaaggctggtctgtgagaaagaagcttccaagcacggaggactgaggttggaattgaggagagagacctgctgggttgatcccctggtctggtagtccctgcccttcctgaagtttggggtttcagctcttccaatctatgagttacgttgagatgcttcaaagaagtcccctttaagctaactctagtcagactgctgcctgactgcaaccaaggcagttctgagcaaaacacacacaarcccaattgtatacacacccagaagtggaaatggatgggcaggaaacactcccaggtagctgtgttctctccagatgaccattcaccatgaaaaccgctttcttcagacttggatcattcccaaatgtaaggcatcccccttgactgagctctgtaagaacagggcccatgactgtctcagctctggatcgcatgccctccacagcctgatgcttagcagggcctcataaatcttctgcattgaacacattactcttcacgcaattcctttctagtttaagtaaactactttgttgataac

SEQ ID NO: 169693 - DNA, 601 bp, Human
cctcgtgtatctgtctctcttggagagtccatcatcactgtcccagttgagccatgggactccaagggagccaccatcttgttccatgaccctcttctccccagttgagggatgggaggaagccagccttaaccttggccacacataggccttcttttatttttattggaacctggtatgaaagagcccctgttcgctctccccgccttgatctctaaggatgtaatccagtgctctgggaagccccttgccagcaccttgcagggaaggctggtctgtgagaaagaagcttccaagcacrgaggactgaggttggaattgaggagagagacctgctgggttgatcccctggtctggtagtccctgcccttcctgaagtttggggtttcagctcttccaatctatgagttacgttgagatgcttcaaagaagtcccctttaagctaactctagtcagactgctgcctgactgcaaccaaggcagttctgagcaaaacacacacaagcccaattgtatacacacccagaagtggaaatggatgggcaggaaacactcccaggtagctgtgttctctccagatgaccattcaccatgaaaacc

SEQ ID NO: 169694 - DNA, 601 bp, Human
gcccggaagtacaaagcacatgtttgctgagtgctaactctgtgagtcctgcactgagcaagcactctttgccatcatctgatggaaccccatgagacaggactgatccccattttacagatgaggacactgaggctcagggaggccgggtaactttcaaaggtcacaaatcaggtgagcggctgaactccaaagctcaccctcttgaccttcacactctctagagccaggtggcctgagtttgatcttggctgtgccacttaccagctgtgtgaccttccccaatctacttaatccctgkgtgttcccctccccctggagatagtaacaatggccctttctcatggagttgttgggaagattacagaagccatttgctgacaggagaaagccacaggtgagccatttgagtctgccattgttacagggcctctaaaacaatgagccagaagaatgacaatcaatgcagaagaagcaacatgtgctgtgggcatttacacagtgcacttatgattacatttgaaaaaaaaagtgcaatagaccgaacaataaagatacgtttgaataagcatgacataaacacaggtacaatcattagagt

SEQ ID NO: 169695 - DNA, 601 bp, Human
accaggaagagcccttgagtcgtgccatgattcaactttcagcagagagggttgctcccacaatcatgcacaggtgcaaagtccaatgccttgaacacagtggctccccgcaaacctcagttccctgctcccagtgctggatgaacccagcttcagagcagccccactggcagatacgcaatcagcctgagcagagaaaggggctggggaacatctgaggatgtacaactaaggatggctgaagagcccggaagtacaaagcacatgtttgctgagtgctaactctgtgagtcctgcactsagcaagcactctttgccatcatctgatggaaccccatgagacaggactgatccccattttacagatgaggacactgaggctcagggaggccgggtaactttcaaaggtcacaaatcaggtgagcggctgaactccaaagctcaccctcttgaccttcacactctctagagccaggtggcctgagtttgatcttggctgtgccacttaccagctgtgtgaccttccccaatctacttaatccctgtgtgttcccctccccctggagatagtaacaatggccctttctcatggagttgttgg

SEQ ID NO: 169696 - DNA, 601 bp, Human
agaactttttaactgcactgttgtatacgtgtagcgtgtgtgtaaaccaaagtaaacccagtcacggagattcctccaggtcaagagacagaacattaccaaccccctttcccaccctggacttctcaaactataggttagcttcgcctgtttttgaacagtcgctgcagggcctcatacactatatcatcttttgtatctggcttcttccatttcacagtgcttgtgtaattcatccacgtcaccgtgcatgttcattcatcctcattgtcatatgatagtccatcgttgtattagaccrcaatccatgtatccattctacagttcataggcgttcagggagtttccagattggggctctgaaagcagtgctgctatgaacatcacaggacacgtgtttcatgcctagaagtggcattgtgcattgcagctttaatcaccctggaagctgttctcccaaagcattgcatctgagaggttttcatgagtatgctaggagagaggtggaagagaccaggtctgccccctgaaggaggtggcacagtcttgggacaactcatggcttctcgagtgcttttctccaggggaccaggagcggtga

SEQ ID NO: 169697 - DNA, 601 bp, Human
gcctcggcctcacaaagtgctgggattacaggcgtgagccaccacgcctggccgtttgccagaactttttaactgcactgttgtatacgtgtagcgtgtgtgtaaaccaaagtaaacccagtcacggagattcctccaggtcaagagacagaacattaccaaccccctttcccaccctggacttctcaaactataggttagcttcgcctgtttttgaacagtcgctgcagggcctcatacactatatcatcttttgtatctggcttcttccatttcacagtgcttgtgtaattcatccacrtcaccgtgcatgttcattcatcctcattgtcatatgatagtccatcgttgtattagaccacaatccatgtatccattctacagttcataggcgttcagggagtttccagattggggctctgaaagcagtgctgctatgaacatcacaggacacgtgtttcatgcctagaagtggcattgtgcattgcagctttaatcaccctggaagctgttctcccaaagcattgcatctgagaggttttcatgagtatgctaggagagaggtggaagagaccaggtctgccccctgaaggaggtggca

SEQ ID NO: 169698 - DNA, 601 bp, Human
catgttagccaggatggtctcaatctcctgacctcgtgatccacctgcctcggcctcacaaagtgctgggattacaggcgtgagccaccacgcctggccgtttgccagaactttttaactgcactgttgtatacgtgtagcgtgtgtgtaaaccaaagtaaacccagtcacggagattcctccaggtcaagagacagaacattaccaaccccctttcccaccctggacttctcaaactataggttagcttcgcctgtttttgaacagtcgctgcagggcctcatacactatatcatctttygtatctggcttcttccatttcacagtgcttgtgtaattcatccacgtcaccgtgcatgttcattcatcctcattgtcatatgatagtccatcgttgtattagaccacaatccatgtatccattctacagttcataggcgttcagggagtttccagattggggctctgaaagcagtgctgctatgaacatcacaggacacgtgtttcatgcctagaagtggcattgtgcattgcagctttaatcaccctggaagctgttctcccaaagcattgcatctgagaggttttcatgagtatgcta

SEQ ID NO: 169699 - DNA, 601 bp, Human
ggctgcgtgaacagctgaagagctcaacaagggccgttcctctgcttgtttgtagaacttttttttttttttgagacagagtctcgctctgtcacccaggctggagtgcagtggcgcgatctcggcttactacaagctccgcctcccaggcccacaccattctcctgcctcagcctcccaagtggctgggactacaggctcccgtcaccatgctcggctaattttttgtatttttagtagagatgggattttcaccatgttagccaggatggtctcaatctcctgacctcgtgatccaccygcctcggcctcacaaagtgctgggattacaggcgtgagccaccacgcctggccgtttgccagaactttttaactgcactgttgtatacgtgtagcgtgtgtgtaaaccaaagtaaacccagtcacggagattcctccaggtcaagagacagaacattaccaaccccctttcccaccctggacttctcaaactataggttagcttcgcctgtttttgaacagtcgctgcagggcctcatacactatatcatcttttgtatctggcttcttccatttcacagtgcttgtgtaattcatccac

SEQ ID NO: 169700 - DNA, 601 bp, Human
atgccagccccaaaaggtgagcagcccgaggaagtgagtacaatcccgcataggtaggtgaggcatgcacctgagacccaggaggtgtccagtgacctccccagggccaaagacctgggattcaagcccaggtcctgcccaaaccagaggcctgaaccaccatgcatctctgtggctgcgtgaacagctgaagagctcaacaagggccgttcctctgcttgtttgtagaacttttttttttttttgagacagagtctcgctctgtcacccaggctggagtgcagtggcgcgatctcggctyactacaagctccgcctcccaggcccacaccattctcctgcctcagcctcccaagtggctgggactacaggctcccgtcaccatgctcggctaattttttgtatttttagtagagatgggattttcaccatgttagccaggatggtctcaatctcctgacctcgtgatccacctgcctcggcctcacaaagtgctgggattacaggcgtgagccaccacgcctggccgtttgccagaactttttaactgcactgttgtatacgtgtagcgtgtgtgtaaaccaaagtaaacccagtcacgg

SEQ ID NO: 169701 - DNA, 601 bp, Human
accgtgggactgcccccggccagtcctctgtcacctttccagctcagtcaaccctcatgccagccccaaaaggtgagcagcccgaggaagtgagtacaatcccgcataggtaggtgaggcatgcacctgagacccaggaggtgtccagtgacctccccagggccaaagacctgggattcaagcccaggtcctgcccaaaccagaggcctgaaccaccatgcatctctgtggctgcgtgaacagctgaagagctcaacaagggccgttcctctgcttgtttgtagaacttttttttttttttgagacagagtctcgctctgtcacccaggctggagtgcagtggcgcgatctcggcttactacaagctccgcctcccaggcccacaccattctcctgcctcagcctcccaagtggctgggactacaggctcccgtcaccatgctcggctaattttttgtatttttagtagagatgggattttcaccatgttagccaggatggtctcaatctcctgacctcgtgatccacctgcctcggcctcacaaagtgctgggattacaggcgtgagccaccacgcctggccgtttgccagaacttttta

SEQ ID NO: 169702 - DNA, 601 bp, Human
aggctgggttatggctgcccggttccaagtgggacagcaggacgggaacaccattgaggaagaagttcacagcactggcagccccaagaccctggctgcgcagctccattaaaaacaatctggtttaaaccttaacaacagtccaaaaagagagcagggtgagggcaggaagcatgggggaattacccgctcaggctgttccctctcaggaagaaggggcagatgaagtccctgaggctggggtctctggctgggcacaggagcatccctgtctttggagagacctcgggaagatgacctytgaaccacagctgctagaatcctgggccatatatggagagctggcgggagggaaggactctccagaaaccgttccggggtccttccagatgacagctctgcttgtcacaacacgcccctcacgcccacaaggaacccttctctcctgacccaatctatgggacaggccagatgaatgggagagaaggccatggggatgtcaccaatctgctttgatttacagagaaggtaggagtctccgtaaagggcagccacttgggaaccaagtgagcctcgggaggtgaccccaggtgggaaggcg

SEQ ID NO: 169703 - DNA, 601 bp, Human
aaagcacccccagatatttctaatgaggtgccaaggtttacagtcacagcagtagactaacagcactaaaaggagtgaatggcagagttggggtggaggttgaacgtgactcaggacaaaataaggcaaaaggcctccacctttctcccttctcctggcagcggtattagactaagatgtcatgtccatttcatagatgataagcaccaagatgaaagcccaggaatggtgtttctgggtggggacctgtggctcctgtggatcatgccccctctggaccaacatggagcaggaatgacamtgggagccacagagtgctggaaggggcagaatgaccacactcaggccagtgagaagaacctccagacacctttcatctgcaggaaaatacaagcccatctccacttcctgtctgggggtggggaactggagagagagggagaaagagcagaaccagtttggccagcagattggtcagaagaaaggagaaatacgatcagcaatcttcagctctcaggctgggttatggctgcccggttccaagtgggacagcaggacgggaacaccattgaggaagaagttcacagcactggcagcccca

SEQ ID NO: 169704 - DNA, 601 bp, Human
aaccaacagagtggccctagataaggtaacagaaaacctctatggaacccaatttcatcatctaaaaaatggggattgtaatcctccttcatgggttatggtcagggttgaatgatctcattcacacaaatagtttaacatctgctagggttggataactgttagctattgttggtaagcataaaccttactgtgcctagtatgagacatctctaggaccaggggttctcagccctgaatgcacatgaaaatcactgtggaaacttttagaaaatactgatgtcctggcccaagtctgggmtggtaaacatttaacaattggctctcagggacctgatctgaagcgcctgctgactacaccgtgtaaatactgccatcttggcagatttcaagctaccaacgtgaggctgctggacatgggaagagaagcacacagtaggctccagcacacagctactccgaccccctcctgaaccaagggaatccatatctctttaaagcacccccagatatttctaatgaggtgccaaggtttacagtcacagcagtagactaacagcactaaaaggagtgaatggcagagttggggtggaggttgaac

SEQ ID NO: 169705 - DNA, 601 bp, Human
gtgacagcttccccttctgggatcttggaaagatcaaaccggaactctcgatggtggtagcgtgggtggaagaattccttgtcatgttccactggaagaggaagagaacacacaccaacaccgacagctcattagtgtctgggtttcactctctggctctgagtccaagcatcttgcctaagctagatggaggcatgcccattgccagtgaccccagtgacaactgctccttcctcaccaacacactgtagactggagggtcacaggctcagaccccatggtccccatggtcatcctgaaygacaagagcatgattctgcatccaacctgctgggaaaagtagggcactaaccacagccatccaagaggtcctggccagactcaggtcccaggggctcaggcctgggttggaatctggcctcagccactaaccaacagagtggccctagataaggtaacagaaaacctctatggaacccaatttcatcatctaaaaaatggggattgtaatcctccttcatgggttatggtcagggttgaatgatctcattcacacaaatagtttaacatctgctagggttggataactgttagctattgt

SEQ ID NO: 169706 - DNA, 601 bp, Human
tctctgttttttttggtttgggtttttttcttcccctaacattttattttagatggccaccttaattggttgcctgacatcgtgcactgggtttcagagtgagaaacgggagagaggtagcccttcaaaaatgtttcttccccttccccttttcttctatgtcccttagcacccagccagatctagactgcctataaaaacccacaaggcaccacgcatccctgggctccctggccttctactattcctgaatttgttgtcggtcatggttttaaggaagtgacatacaccatacaccttytttagaagggataatctggtacagggcctggcacgtggttgtgccaatctgacccatcctctggccctcaccaccttcttcctctgcccccagaggaaactcagcacctctcccagatacccgtatagcacccacctgcccaagtgctcctggagcacctgataaacgctgatccggaacgtctcattgtcgaagcgttcccggatgtagtccttgtagatccggaattcggctgccgtgacagcttccccttctgggatcttggaaagatcaaaccggaactctcgatggtggtagcgt

SEQ ID NO: 169707 - DNA, 601 bp, Human
catcacaaggaggtgcccacaccacctttcttccatcaatttccctgcccagtggggacggtagatgtctgacagcctgcggggtccagcaacccagccactgagtaataggaccttggtcatttctgcctcgggactgtctgaatagaatgcacctgctaaatgtcccagccctttttcttagcctccttacctctcacaagaccttgaaattaatggatctcgataaattaaagactttcaacacaaacgtttggtttctgacctagtgattcttggaaggctaagagttctctgtttkttttggtttgggtttttttcttcccctaacattttattttagatggccaccttaattggttgcctgacatcgtgcactgggtttcagagtgagaaacgggagagaggtagcccttcaaaaatgtttcttccccttccccttttcttctatgtcccttagcacccagccagatctagactgcctataaaaacccacaaggcaccacgcatccctgggctccctggccttctactattcctgaatttgttgtcggtcatggttttaaggaagtgacatacaccatacaccttctttagaagg

SEQ ID NO: 169708 - DNA, 601 bp, Human
atccccacccccaccccccaccagcaccaaatagcagtgcttggcaaacgtagctgtgatggttcttctgtccctgtctatggtaacaagtcccctttctagctgaagatgctaagcctgcacatcacaaggaggtgcccacaccacctttcttccatcaatttccctgcccagtggggacggtagatgtctgacagcctgcggggtccagcaacccagccactgagtaataggaccttggtcatttctgcctcgggactgtctgaatagaatgcacctgctaaatgtcccagcccttttycttagcctccttacctctcacaagaccttgaaattaatggatctcgataaattaaagactttcaacacaaacgtttggtttctgacctagtgattcttggaaggctaagagttctctgttttttttggtttgggtttttttcttcccctaacattttattttagatggccaccttaattggttgcctgacatcgtgcactgggtttcagagtgagaaacgggagagaggtagcccttcaaaaatgtttcttccccttccccttttcttctatgtcccttagcacccagccagatctagac

SEQ ID NO: 169709 - DNA, 601 bp, Human
ttctcctgcctcagcctcccaagtagctgggattacaggcgcccgccaccatgcctggctaatttttctatttttagtagagacggggtttcaccgtgttggccaggctggtctcaaactcctgacctcaaatgatccacctgccttggccttccaaagtgctgggattacaggcgtgagctaccacacccggcctaaaaacaaattttggaaagaaatatctttcataagcatgggctccagctttgcaaacctgggctcacgtcctaatgtggccacattctctctgggtagcctcatyctttggcttcaggtcactttagttctcctcattttacagataagccaccacttctgaaggctactgtgaatatgaaacaagatatcaagtgcaaaacactctggaaacgctcaagaacagttttgttttcttggtacttagatgaccatccccacccccaccccccaccagcaccaaatagcagtgcttggcaaacgtagctgtgatggttcttctgtccctgtctatggtaacaagtcccctttctagctgaagatgctaagcctgcacatcacaaggaggtgcccacaccacctttct

SEQ ID NO: 169710 - DNA, 601 bp, Human
gggctggaagccttcattttcactgtggttcctcttctttccttttgattttataccatgaacatgtcttgcctactcaaaaacttttttttttttttttttttgagaaagagtctcactctgtcacccaggctggagtgcggtggcaccatctcggctcactgcaaccttctcctcctgggttcaagcaattctcctgcctcagcctcccaagtagctgggattacaggcgcccgccaccatgcctggctaatttttctatttttagtagagacggggtttcaccgtgttggccaggctrgtctcaaactcctgacctcaaatgatccacctgccttggccttccaaagtgctgggattacaggcgtgagctaccacacccggcctaaaaacaaattttggaaagaaatatctttcataagcatgggctccagctttgcaaacctgggctcacgtcctaatgtggccacattctctctgggtagcctcattctttggcttcaggtcactttagttctcctcattttacagataagccaccacttctgaaggctactgtgaatatgaaacaagatatcaagtgcaaaacactctggaaacg

SEQ ID NO: 169711 - DNA, 601 bp, Human
ctggcatcagggaccacctcagcaggggctggaagccttcattttcactgtggttcctcttctttccttttgattttataccatgaacatgtcttgcctactcaaaaacttttttttttttttttttttgagaaagagtctcactctgtcacccaggctggagtgcggtggcaccatctcggctcactgcaaccttctcctcctgggttcaagcaattctcctgcctcagcctcccaagtagctgggattacaggcgcccgccaccatgcctggctaatttttctatttttagtagagacrgggtttcaccgtgttggccaggctggtctcaaactcctgacctcaaatgatccacctgccttggccttccaaagtgctgggattacaggcgtgagctaccacacccggcctaaaaacaaattttggaaagaaatatctttcataagcatgggctccagctttgcaaacctgggctcacgtcctaatgtggccacattctctctgggtagcctcattctttggcttcaggtcactttagttctcctcattttacagataagccaccacttctgaaggctactgtgaatatgaaacaagata

SEQ ID NO: 169712 - DNA, 601 bp, Human
ctgactgatagacatgaacacgtatgtcagcgagggtacttgccctgcggcaccatccatcatagaacagaggagccagcgtgcacacgtgaaacacagcacaacccaagccgtggaacagtgaggtgactcagaggatgagggcaccccgtgtgaacccctggaaagggctgccaaggttcatcatccaacgatgaaagccagaggcaggagtgagtgcactgtggggttccacaggtgaaaacagcaacacagattccttcgctgatttcaggagactcaagaaactggcatcagggaycacctcagcaggggctggaagccttcattttcactgtggttcctcttctttccttttgattttataccatgaacatgtcttgcctactcaaaaacttttttttttttttttttttgagaaagagtctcactctgtcacccaggctggagtgcggtggcaccatctcggctcactgcaaccttctcctcctgggttcaagcaattctcctgcctcagcctcccaagtagctgggattacaggcgcccgccaccatgcctggctaatttttctatttttagtagagacggggtttcaccgtg

SEQ ID NO: 169713 - DNA, 601 bp, Human
tctgactgatagacatgaacacgtatgtcagcgagggtacttgccctgcggcaccatccatcatagaacagaggagccagcgtgcacacgtgaaacacagcacaacccaagccgtggaacagtgaggtgactcagaggatgagggcaccccgtgtgaacccctggaaagggctgccaaggttcatcatccaacgatgaaagccagaggcaggagtgagtgcactgtggggttccacaggtgaaaacagcaacacagattccttcgctgatttcaggagactcaagaaactggcatcagggrccacctcagcaggggctggaagccttcattttcactgtggttcctcttctttccttttgattttataccatgaacatgtcttgcctactcaaaaacttttttttttttttttttttgagaaagagtctcactctgtcacccaggctggagtgcggtggcaccatctcggctcactgcaaccttctcctcctgggttcaagcaattctcctgcctcagcctcccaagtagctgggattacaggcgcccgccaccatgcctggctaatttttctatttttagtagagacggggtttcaccgt

SEQ ID NO: 169714 - DNA, 601 bp, Human
cctaagcaagaagctccctggctgctgggagtagatgtcgatgtcacctcccaggagagctgctcagcagtgtctaccaaagccacccatgtgtgggccctctgaccccacaattctatctctagaactttatctgactgatagacatgaacacgtatgtcagcgagggtacttgccctgcggcaccatccatcatagaacagaggagccagcgtgcacacgtgaaacacagcacaacccaagccgtggaacagtgaggtgactcagaggatgagggcaccccgtgtgaacccctggaaasggctgccaaggttcatcatccaacgatgaaagccagaggcaggagtgagtgcactgtggggttccacaggtgaaaacagcaacacagattccttcgctgatttcaggagactcaagaaactggcatcagggaccacctcagcaggggctggaagccttcattttcactgtggttcctcttctttccttttgattttataccatgaacatgtcttgcctactcaaaaacttttttttttttttttttttgagaaagagtctcactctgtcacccaggctggagtgcggtggcaccatctcg

SEQ ID NO: 169715 - DNA, 601 bp, Human
cacatgggtagctggtggcaggatttgaatccatgctcttaatagctggggaattacatcataggggcatcttggttctaggttcaaaaacaaaacaacctgtccagaaaaatgaataaataatatattttttaaatttaaccatttaacttctgaagaatggaggctttgctgcaggaggcacaggaagaacatgtagaaacctaaagaaagcagctccgtcttgccctccactgcttctcaccctattcccttccttgctcaatgctcccacctgccatgtcctctcctctgctggaaygtgagcttccagagggcagggactcgtgtctggttcgttctggtcgatgccctcaggcatggcatgcagcaggtacctgtgctgaggagggactcagtcactcagcagcccagaagcccccaggagcaggaccccagcactagaatgggcacccccagcccaagttgcctgttgccggcagcctggcagggaggacgcctggaacgcccatccctcctccaaacacagtgctcaggcctgctgcccaaccctgcagccctcaggatccaccccatggatctcaggcaagacagcagaggc

SEQ ID NO: 169716 - DNA, 601 bp, Human
ttgtcttcctaaagaggtcttgctccacttcctgctgtgatgatgatgatactaacgcaggtgaccatttattgagcacttcctgtgtgtaagacactgttgtaagtatgtcaccccctttcatccacagcacaactctgggagggagattcaattattatccccattttacagagggaaaaactgaggctctgagagatgactctttcccaaggccacatgggtagctggtggcaggatttgaatccatgctcttaatagctggggaattacatcataggggcatcttggttctaggttsaaaaacaaaacaacctgtccagaaaaatgaataaataatatattttttaaatttaaccatttaacttctgaagaatggaggctttgctgcaggaggcacaggaagaacatgtagaaacctaaagaaagcagctccgtcttgccctccactgcttctcaccctattcccttccttgctcaatgctcccacctgccatgtcctctcctctgctggaacgtgagcttccagagggcagggactcgtgtctggttcgttctggtcgatgccctcaggcatggcatgcagcaggtacctgtgctg

SEQ ID NO: 169717 - DNA, 601 bp, Human
cccagccctgcacagctgggcagctggcggcacagagacagaggcagccacatggcggggacagcagggcaggctctgggctcccccgggctgaggtctgcaggaggccttcagctggaagaagctgtgcgggcccaggttggggacatgcaaccaggttggggacatgcaaagaaaaagcctatctctgaacaggcgagctggaggaagcgtgggggatttgaagagcatttgcaagctcagggctttgttcctactggaagattgcagaattaggggaattggctcggtggacctacaygggaaggcagtgccacagccaccacccagggctcttgtcttcctaaagaggtcttgctccacttcctgctgtgatgatgatgatactaacgcaggtgaccatttattgagcacttcctgtgtgtaagacactgttgtaagtatgtcaccccctttcatccacagcacaactctgggagggagattcaattattatccccattttacagagggaaaaactgaggctctgagagatgactctttcccaaggccacatgggtagctggtggcaggatttgaatccatgctcttaatagctggg

SEQ ID NO: 169718 - DNA, 601 bp, Human
taagactccgatcctttcgcagccccctctcaccccagcaaggcctctggagccaaggccactgtccccagacctgcctctgagcccccactcgctccacagcccgccaagggcggctccaacatgtctttccagctgtctggggccgcgctttaagcagagccgcagggctatggaaggcctccagctcggctcattatcggaatttaatctggattccgagagatcaagaggagtcagtggaaagtgactcccacaaggggagagacgctgaggctgacccaaagccggctaatcctcrgcacccccggggctttcctggagctcaggcacagctcgtcagatgtcccagccctgcacagctgggcagctggcggcacagagacagaggcagccacatggcggggacagcagggcaggctctgggctcccccgggctgaggtctgcaggaggccttcagctggaagaagctgtgcgggcccaggttggggacatgcaaccaggttggggacatgcaaagaaaaagcctatctctgaacaggcgagctggaggaagcgtgggggatttgaagagcatttgcaagctcagggctttgttcc

SEQ ID NO: 169719 - DNA, 601 bp, Human
acaattgtggtctggactacactttgggctcagtctcatgggaagaagaacagtcttctctgagacaccaagctgaagggaacatggaatgtgtcacagaaggccaatacatggtgaaaccccatctctactaaaaataaaaaaatcagccaggcatggtggtacatacttgtaatcccagctacttgggaggctgaggcaggagaatcacttgaacttgagaggtggaggttgcagtgagctgggatcgtgccactgcactccagcctgggcaacacagtgagactccatctcaaaaaagaaaaaaaaaaaaggaatctctttccttcctcttgggcatgtaagacagctcatgggtgagaaattagagagatcttagccacctgttcacaccccagcacacagggaatcacctgggagcttttaaagcacaccaatgacagttcaacccctacggatcaggagttttaaaagcctctgtgattctattgcacagccaaggctgaaaaccagctcaggactcatcaatggacccatctgagccccaggtgagggaatcagcactatgggaatcactgaggcacggccatggctaagatgg

SEQ ID NO: 169720 - DNA, 601 bp, Human
tccaaagggatcttcacccttagccagtccctttcctgtgccattgagactgacaattgtggtctggactacactttgggctcagtctcatgggaagaagaacagtcttctctgagacaccaagctgaagggaacatggaatgtgtcacagaaggccaatacatggtgaaaccccatctctactaaaaataaaaaaatcagccaggcatggtggtacatacttgtaatcccagctacttgggaggctgaggcaggagaatcacttgaacttgagaggtggaggttgcagtgagctgggatygtgccactgcactccagcctgggcaacacagtgagactccatctcaaaaaagaaaaaaaaaaaaggaatctctttccttcctcttgggcatgtaagacagctcatgggtgagaaattagagagatcttagccacctgttcacaccccagcacacagggaatcacctgggagcttttaaagcacaccaatgacagttcaacccctacggatcaggagttttaaaagcctctgtgattctattgcacagccaaggctgaaaaccagctcaggactcatcaatggacccatctgagccccagg

SEQ ID NO: 169721 - DNA, 601 bp, Human
tgtgggagcaggcacggtggttcatgcctgtaatcacaacactctgggaggccaaggcaggagaacaacttgaggccaagagtttgagatcagcctggacaacacagtgagacctcatctctacaaaagtaaaaaactagccagacatagtggtgtgttcctatggtcctagctacttgagaggctcaggtgggacgattgctccaacccaggaggtcgaggctgcagtgagctgtgatcactccactgcactccagcagagcaacagagcaagaccctatctctcaaaaaaaaaaaaaaagaggggtgggcagggataagggtgtctccatggggggttgttgtgggaagcagtaaagagcccccattgcatgcaattagcttttgtcatcatgactgttcccaaaggcagccatcccttctcccagcatagacaagtgtcatgggagagaggaggctccaagatcgcattgtggacccagctaaatcgatggaaacgtaaagagagcagacctttcccacaggtggtctacaagaggggcaggactgaccacctcgtggggacacccgctcggcttcactgaacgtgatataacaccta

SEQ ID NO: 169722 - DNA, 601 bp, Human
gccccactcagatcttcactatgcagccccacacggttcagcaagtgtccacatgctgtccaagtccgtgcaacttccgaggggtggaaaaagaggcggctccaggtgcgtctgcaaagcctcactacacactactgggacaggctgggcaggtcactggtctctgcctcaatttccttgtgtggaaaatatgaattgccccaccatttcccaatttacaggactggactgccacgaggagaaagaaaaaagtgtatccaccagccaaggaagaaaaacatatgcgactggggaaagatgsaagcttctcatccttaatccccaacccagtattgtgccttcatttccttgtctgtgaaagagggtgtgggagcaggcacggtggttcatgcctgtaatcacaacactctgggaggccaaggcaggagaacaacttgaggccaagagtttgagatcagcctggacaacacagtgagacctcatctctacaaaagtaaaaaactagccagacatagtggtgtgttcctatggtcctagctacttgagaggctcaggtgggacgattgctccaacccaggaggtcgaggctgcagtgagctgt

SEQ ID NO: 169723 - DNA, 601 bp, Human
gttgtacatgcgctcaggcacacaggaccagaccatgtggtctgtgaattcagagagcccacatcttcaaagggaaggctgggtcgtgctttcatcctttcgtgcatttggtgtcttactgagcacctactatgtgccaggctctaggcaaaatggataccacagtgagcaaaacgaacaaaactcctccccttgtggaccccctgtcactgtctctgctgggccccactcagatcttcactatgcagccccacacggttcagcaagtgtccacatgctgtccaagtccgtgcaacttccraggggtggaaaaagaggcggctccaggtgcgtctgcaaagcctcactacacactactgggacaggctgggcaggtcactggtctctgcctcaatttccttgtgtggaaaatatgaattgccccaccatttcccaatttacaggactggactgccacgaggagaaagaaaaaagtgtatccaccagccaaggaagaaaaacatatgcgactggggaaagatggaagcttctcatccttaatccccaacccagtattgtgccttcatttccttgtctgtgaaagagggtgtgggagcaggca

SEQ ID NO: 169724 - DNA, 601 bp, Human
gggcaaagatactgtggccggcactcactcatccagcaggcatctgttgtacatgcgctcaggcacacaggaccagaccatgtggtctgtgaattcagagagcccacatcttcaaagggaaggctgggtcgtgctttcatcctttcgtgcatttggtgtcttactgagcacctactatgtgccaggctctaggcaaaatggataccacagtgagcaaaacgaacaaaactcctccccttgtggaccccctgtcactgtctctgctgggccccactcagatcttcactatgcagccccacayggttcagcaagtgtccacatgctgtccaagtccgtgcaacttccgaggggtggaaaaagaggcggctccaggtgcgtctgcaaagcctcactacacactactgggacaggctgggcaggtcactggtctctgcctcaatttccttgtgtggaaaatatgaattgccccaccatttcccaatttacaggactggactgccacgaggagaaagaaaaaagtgtatccaccagccaaggaagaaaaacatatgcgactggggaaagatggaagcttctcatccttaatccccaacccagtatt

SEQ ID NO: 169725 - DNA, 601 bp, Human
cctggtaagcctgtattccccacccttagagttagtatttgagcagacacttttcttcccagctacagatgactgcttgtgaccaaattgaaaaatattaattctctttgtctcctgccaaaaaagctaaagcaattacagatcctgattcgaaacatagatgttaatacatttggaaaaatgagcttctataggcgagcagaggcccagggccaagcatgaagtgcttttggaatcaaagtgccaaatcaagttatccagagagctgcctccacgaaagcccattcttcccaaatgcatyccagtgtaaagaaccccaggctgccgcacacacgctgatgtctcccctatttgcaaacaagaaccgacctacccttgggcacccactggcacacagctgtaaataacgtaattataatcatcacagggaaacatccataggatcagaaagtatcataattacaggcaattttcactttttggaaattgggctcagatgctgaagaaagattgcaagcaaggcattctcgagtttcaattctggaagagaaagcacattggagcatttggtaggacgaactagctccagggcaaagatact

SEQ ID NO: 169726 - DNA, 601 bp, Human
caccgacagaggttgcaataggaagacaaaggaagaagcagggtttggaagaaccttgagtatttacctacatgcctacttccaatctgaacttgaactagcttcattaactgtggttgtctcctttaaaacatcatcatgttcctggtaagcctgtattccccacccttagagttagtatttgagcagacacttttcttcccagctacagatgactgcttgtgaccaaattgaaaaatattaattctctttgtctcctgccaaaaaagctaaagcaattacagatcctgattcgaaacayagatgttaatacatttggaaaaatgagcttctataggcgagcagaggcccagggccaagcatgaagtgcttttggaatcaaagtgccaaatcaagttatccagagagctgcctccacgaaagcccattcttcccaaatgcatcccagtgtaaagaaccccaggctgccgcacacacgctgatgtctcccctatttgcaaacaagaaccgacctacccttgggcacccactggcacacagctgtaaataacgtaattataatcatcacagggaaacatccataggatcagaaagtatcata

SEQ ID NO: 169727 - DNA, 601 bp, Human
agtcacccttcggggtgctctgcgcagcaccgctccctcacctggcctccccatctccccactgcccgatgctcctaaaggcctttcctggaaacactttctaatccttcactctcacagccacacaatcctcagctgagggtgagctttggagaaacctgacctgaaaccagtggccaacaggtttcacttgatggcagcttcactcaactggcagtggctgccttatttagagacctgtaccaaggatccagggaaagggagggaaagggatccattagcaatgcctgccttggtcccrggaggagaagggtggcatgcgtgctggaatgcaagaccaggtgtcagctttccttcctcctttcttggggtggcaaaatggaaagccatgggcattgttgaggaaaaagaagaacatggcaccgacagaggttgcaataggaagacaaaggaagaagcagggtttggaagaaccttgagtatttacctacatgcctacttccaatctgaacttgaactagcttcattaactgtggttgtctcctttaaaacatcatcatgttcctggtaagcctgtattccccacccttagagttagtat

SEQ ID NO: 169728 - DNA, 601 bp, Human
cagggctgctaccgaatgccctactatgcccaggatggcccttaaccccagagaatgagccacccccaaaggtcactactgcggaggctcggaaaccgaaaccctgcctcaaatgacagggtataaacacttcagctctcttgacgggactaggatgagggtgcaactttgtctccagaacctctagcaggaagagtgagccaaagtcacccttcggggtgctctgcgcagcaccgctccctcacctggcctccccatctccccactgcccgatgctcctaaaggcctttcctggaaacaytttctaatccttcactctcacagccacacaatcctcagctgagggtgagctttggagaaacctgacctgaaaccagtggccaacaggtttcacttgatggcagcttcactcaactggcagtggctgccttatttagagacctgtaccaaggatccagggaaagggagggaaagggatccattagcaatgcctgccttggtcccaggaggagaagggtggcatgcgtgctggaatgcaagaccaggtgtcagctttccttcctcctttcttggggtggcaaaatggaaagccatgggcatt

SEQ ID NO: 169729 - DNA, 601 bp, Human
catccctccctccctccaccctgtgcttctcagtcagggcctagttagaggcccttttaaagatgggaccctgacaatatctggtgacatttttggtttcacaactgagtgtggggatgtgtcattggcatctggtgggcagaagccagggctgctaccgaatgccctactatgcccaggatggcccttaaccccagagaatgagccacccccaaaggtcactactgcggaggctcggaaaccgaaaccctgcctcaaatgacagggtataaacacttcagctctcttgacgggactaggrtgagggtgcaactttgtctccagaacctctagcaggaagagtgagccaaagtcacccttcggggtgctctgcgcagcaccgctccctcacctggcctccccatctccccactgcccgatgctcctaaaggcctttcctggaaacactttctaatccttcactctcacagccacacaatcctcagctgagggtgagctttggagaaacctgacctgaaaccagtggccaacaggtttcacttgatggcagcttcactcaactggcagtggctgccttatttagagacctgtaccaaggatc

SEQ ID NO: 169730 - DNA, 601 bp, Human
caagtgccatctttaaagcgcccctaactaggccctggggaagagttaggagacaaagaacccttaccccaaaaaggctcttataatctcatttccactcaagaagcaaagccacatggagtgctctgtgccaggcactgaggtcgccatagctgaaagcccaggggttacaaggactccagtctggggaccctgtgtggctgtgacccacgtcactcaagttcagaagacatcgagccacagccagagcgtagggattcaggttgaattttaaaataggtggggctgagatagacggagygatagtgggagaggactctgcatcaactccctccaaacgctgggtgactgtcactttcagaaacaagcaaagcaggagaaacacataggcaggaggagccccagggaatgtggccactgaagggtaggtggcgtcctggacaggacagaaggacaagaagtaaaagcaaaggggtccggaataaatgattgactttcattaataaaaatgcagatgctgggtccttaattatgaaaactgtaccctattgatgttaggtgttaaaacaggggaaaccaggcgtgtctgcgcatctgtgtg

SEQ ID NO: 169731 - DNA, 601 bp, Human
ctccctaagcccacagcatggaggggaaagagcctgctattgaggacacctcaagtgccatctttaaagcgcccctaactaggccctggggaagagttaggagacaaagaacccttaccccaaaaaggctcttataatctcatttccactcaagaagcaaagccacatggagtgctctgtgccaggcactgaggtcgccatagctgaaagcccaggggttacaaggactccagtctggggaccctgtgtggctgtgacccacgtcactcaagttcagaagacatcgagccacagccagagygtagggattcaggttgaattttaaaataggtggggctgagatagacggagtgatagtgggagaggactctgcatcaactccctccaaacgctgggtgactgtcactttcagaaacaagcaaagcaggagaaacacataggcaggaggagccccagggaatgtggccactgaagggtaggtggcgtcctggacaggacagaaggacaagaagtaaaagcaaaggggtccggaataaatgattgactttcattaataaaaatgcagatgctgggtccttaattatgaaaactgtaccctatt

SEQ ID NO: 169732 - DNA, 601 bp, Human
ccctctcccacttccgggacctgtgggttcaaccccagagcaagaggctgagcccgctccctaagcccacagcatggaggggaaagagcctgctattgaggacacctcaagtgccatctttaaagcgcccctaactaggccctggggaagagttaggagacaaagaacccttaccccaaaaaggctcttataatctcatttccactcaagaagcaaagccacatggagtgctctgtgccaggcactgaggtcgccatagctgaaagcccaggggttacaaggactccagtctggggacccygtgtggctgtgacccacgtcactcaagttcagaagacatcgagccacagccagagcgtagggattcaggttgaattttaaaataggtggggctgagatagacggagtgatagtgggagaggactctgcatcaactccctccaaacgctgggtgactgtcactttcagaaacaagcaaagcaggagaaacacataggcaggaggagccccagggaatgtggccactgaagggtaggtggcgtcctggacaggacagaaggacaagaagtaaaagcaaaggggtccggaataaatgattgac

SEQ ID NO: 169733 - DNA, 601 bp, Human
ctccgaggaggagtggaggccctgtccaaggtggcagttggtgaggctgacatggtgggagtcaccacctgagcagccagacatgggctggaggagaaatgctgtctacactcatggcagggacccctgccaggacaacctgtggtggcatctgcagagaaaagactcaaacaccagtgatgctggggaagctggaggatccctcttatgtccaggagccagactagggcctcagagatgcttttcctactgcaccgtgagcccccgcatgtggaacacccaaggggaaagggatggaggyaggactcagctggagaaagctttccaaggagaatgaccatgacaggtttgttgggaggctcctggttccagctctcaatcccacttgcaaacctgactcccaaaccaccccacccaccctctcccacttccgggacctgtgggttcaaccccagagcaagaggctgagcccgctccctaagcccacagcatggaggggaaagagcctgctattgaggacacctcaagtgccatctttaaagcgcccctaactaggccctggggaagagttaggagacaaagaacccttaccccaaaaagg

SEQ ID NO: 169734 - DNA, 601 bp, Human
atcgtcaaaacagaacactgtgggcctgggacttcagcccgtcagaacctcctggagcagctccagaggggtgcacctgaggacgagggcgctgtctcctgagggcgagggggctgtctcctgagggcgagggggctgtctcctgagggcgaggggctgtctcctgagggtgaggggctgtctcttgagggcgaggggctgtctcctgagggtgagggactgtctcctgagggtgagggggctggggaattccccatagaccttgactccgactcctcagtgggtcagagaaagttccccrcagagctcccacataggggaaggtgtgtggggaggggaagcctcgaggtctgcggctcagcgggtccatctctccgaggaggagtggaggccctgtccaaggtggcagttggtgaggctgacatggtgggagtcaccacctgagcagccagacatgggctggaggagaaatgctgtctacactcatggcagggacccctgccaggacaacctgtggtggcatctgcagagaaaagactcaaacaccagtgatgctggggaagctggaggatccctcttatgtccaggagccagactaggg

SEQ ID NO: 169735 - DNA, 601 bp, Human
accccaggaaccacctggagagggcggggaagtaaggcaagcttggagatcgtcaaaacagaacactgtgggcctgggacttcagcccgtcagaacctcctggagcagctccagaggggtgcacctgaggacgagggcgctgtctcctgagggcgagggggctgtctcctgagggcgagggggctgtctcctgagggcgaggggctgtctcctgagggtgaggggctgtctcttgagggcgaggggctgtctcctgagggtgagggactgtctcctgagggtgagggggctggggaattcyccatagaccttgactccgactcctcagtgggtcagagaaagttccccacagagctcccacataggggaaggtgtgtggggaggggaagcctcgaggtctgcggctcagcgggtccatctctccgaggaggagtggaggccctgtccaaggtggcagttggtgaggctgacatggtgggagtcaccacctgagcagccagacatgggctggaggagaaatgctgtctacactcatggcagggacccctgccaggacaacctgtggtggcatctgcagagaaaagactcaaacaccagtgat

SEQ ID NO: 169736 - DNA, 601 bp, Human
tgtggttgacacttggcctctgtcatgcttcagtgaccccagaggcaggtcctgagtcaaggacttgaatgcaagtagtttgtctgagaggtgaccccaggaaccacctggagagggcggggaagtaaggcaagcttggagatcgtcaaaacagaacactgtgggcctgggacttcagcccgtcagaacctcctggagcagctccagaggggtgcacctgaggacgagggcgctgtctcctgagggcgagggggctgtctcctgagggcgagggggctgtctcctgagggcgaggggctgyctcctgagggtgaggggctgtctcttgagggcgaggggctgtctcctgagggtgagggactgtctcctgagggtgagggggctggggaattccccatagaccttgactccgactcctcagtgggtcagagaaagttccccacagagctcccacataggggaaggtgtgtggggaggggaagcctcgaggtctgcggctcagcgggtccatctctccgaggaggagtggaggccctgtccaaggtggcagttggtgaggctgacatggtgggagtcaccacctgagcagccagacatgggc

SEQ ID NO: 169737 - DNA, 601 bp, Human
taagacttattctcacggtagcatcctgaagccgggggggtccaggaagggggcaggctgaggacatcagcttgcacttggtaggccctcaccaggtcccagaagctgtgccggtgccaaagctgccccttgccaggaagccctcccggctgccctgtgtggttgacacttggcctctgtcatgcttcagtgaccccagaggcaggtcctgagtcaaggacttgaatgcaagtagtttgtctgagaggtgaccccaggaaccacctggagagggcggggaagtaaggcaagcttggagatygtcaaaacagaacactgtgggcctgggacttcagcccgtcagaacctcctggagcagctccagaggggtgcacctgaggacgagggcgctgtctcctgagggcgagggggctgtctcctgagggcgagggggctgtctcctgagggcgaggggctgtctcctgagggtgaggggctgtctcttgagggcgaggggctgtctcctgagggtgagggactgtctcctgagggtgagggggctggggaattccccatagaccttgactccgactcctcagtgggtcagagaaagttccccaca

SEQ ID NO: 169738 - DNA, 601 bp, Human
gggcactgcagagcttctgacacggctctgggggaaatcccacacggatgggcagctgcctgcatctggcactgtggaggtgggcgggcagccatggaggatggggagactcatctttctagacttctcctggggaccgcatttcctccagcctccaggtccagaccaaaatagaatgaggtaaattcagcccctttcctgcagcacactcaaggaataaacaagcaccacaaatacagtcttcgggctgggtcatctttccaacctcatttttttttttttttaagagaaccacaggctrttttaagattccaaacccagagacagaaaaagtgcagcaaagcagggcgacaaggggaaagaaacttgacagtgctttgcagacagaaacaagtgacgcaatttccaaattcaagattctcaaaaacagaggctgggttggaacatctagagaaggccagagcgggctgttctaagacttattctcacggtagcatcctgaagccgggggggtccaggaagggggcaggctgaggacatcagcttgcacttggtaggccctcaccaggtcccagaagctgtgccggtgccaaagctgccc

SEQ ID NO: 169739 - DNA, 601 bp, Human
ccccagaaaaatctggggggcactgcagagcttctgacacggctctgggggaaatcccacacggatgggcagctgcctgcatctggcactgtggaggtgggcgggcagccatggaggatggggagactcatctttctagacttctcctggggaccgcatttcctccagcctccaggtccagaccaaaatagaatgaggtaaattcagcccctttcctgcagcacactcaaggaataaacaagcaccacaaatacagtcttcgggctgggtcatctttccaacctcatttttttttttttttaagagaaccacaggctgttttaagattccaaacccagagacagaaaaagtgcagcaaagcagggcgacaaggggaaagaaacttgacagtgctttgcagacagaaacaagtgacgcaatttccaaattcaagattctcaaaaacagaggctgggttggaacatctagagaaggccagagcgggctgttctaagacttattctcacggtagcatcctgaagccgggggggtccaggaagggggcaggctgaggacatcagcttgcacttggtaggccctcaccaggtcccagaagctgtgc

SEQ ID NO: 169740 - DNA, 601 bp, Human
tcttttcctgccaggttttaagctttttgtcagcaagaaccagccctattttattcagccctggagcggcctctccaccaggcacacagcttagcacaaagcaggcctcagatgcacgctggacaaatgtgctggtatcctctgcatccttatggccagtaaggttttctggtttcacttccaatagtttacattattaaaagagaaatggtaaatactttttcagattattcaggtagctccagaaatggctctgactcacagttcactggggccttagcccacccagcccactctatgycccactgggcacccacactcccaggccatgggcacccagctgcacatcctagttgaagggaaaccctcatcagcccctgggcacctccataccccccaccttcacaggcctggctatggaaccagggggctgtcaaattacctcaaattgacccctcactggaaactgccaggctgcatgggcttccggttgagtgcccccatttactgtccccatcacctcttcggagccacctcctttccccacatcaggcaaaaatcaagaggactcaggtgggcagaaagcaacagctgggaagaa

SEQ ID NO: 169741 - DNA, 601 bp, Human
gtccctggcatcccccagacgggaagaggaagtcagggaggtccaaggctttttaaaaatacactttcttgaagacggtgcatatccaggaaggctaaaattaaagctttggggagtaaggtggaaaaatacacaaagaggcacaatatcctcctgccccagacagagctcgggtggccacccacggccctctcacccaccccacggctgtctgtctccctctgggcagggccagctgactgcagacagcaccaacccagccactcatgggaaagtcaggaagatgcccgtccagcacccrgaggccagcgttgtcacagtcagaaggcgagtcagtggcccttatgttctagccctcagtttctccatccacaagacaaagggtttggagtttatcaaggtctcaaaaactgcaacttattaataggatagctaagagaggaaaatgagaggatcaaaaatccaaaatgctctgtggtgaaatgaggttgggaagcaccacatgacacattgctccttagagatgtcataatgcaccttagctctttaaaggctctgaaaagtcctgctgcaaagaaatgtctgctccggcaatggagcg

SEQ ID NO: 169742 - DNA, 601 bp, Human
gcagggaaaagcgttcccggcagagagaaccgaatgcggaagtcatgatgagaaagtagtgaggagagggcacaggtgcacgatgtcccctgcagggcctctggccgcgggaggtcaggtcttgctgagcgctgggaagccgggaggagttctaagcaggagtggagatgacgggctctgccactcgcagacccagctgactcgctccccgacccctagtctgaccctcgccctcgcctcactctgctgctctttggaaaactgcaggccggacattctgaaggcctgcatgttgtgaacrgttgctgggccgcaaggatattcctcagaagaaaaggagcaagagagcgagccagcgagcatggccagagcattcccaggctagcatgatgtcatggagggagcacaggcttgcggctgcggtgagtcaggccgggaaactgcaacccgccgtgcacctggagtcagcccagcagcaaccccagcctgcagggaagcccgggaaggagatcaaaggagcccagaaggaagccggccccaccctggcagccagctcccgggtccaaggggtgccccttctgagctgcaggctggggaggac

SEQ ID NO: 169743 - DNA, 601 bp, Human
ggaagaggcctctgggtgagcaagacaaaagaaaaggactagatgtgaggtgtgagggtgtgcggggaggacgttttatagaaacatctcccgaagggggtcagaggatgagcagaactaacacagctaaaagggcagggaaaagcgttcccggcagagagaaccgaatgcggaagtcatgatgagaaagtagtgaggagagggcacaggtgcacgatgtcccctgcagggcctctggccgcgggaggtcaggtcttgctgagcgctgggaagccgggaggagttctaagcaggagtggasatgacgggctctgccactcgcagacccagctgactcgctccccgacccctagtctgaccctcgccctcgcctcactctgctgctctttggaaaactgcaggccggacattctgaaggcctgcatgttgtgaacggttgctgggccgcaaggatattcctcagaagaaaaggagcaagagagcgagccagcgagcatggccagagcattcccaggctagcatgatgtcatggagggagcacaggcttgcggctgcggtgagtcaggccgggaaactgcaacccgccgtgcacctggagtca

SEQ ID NO: 169744 - DNA, 601 bp, Human
tggtaggcagaataacaccccctcagacacatccaggtcctgacccaggaagctgtgggtatgccacctcccaggccctgatcccagaagctgtgggtatgccaccttccacagcagcagggactttgcagatgtgatgaaagatttttgagttgggagattatcctggattatcctcatgggcccaaaggaatcataagggtcctgataacaggggaggcaggaggccagagaataagctgtgacagcgaaagcaggggtcagggtggtgtgactgcggctgggaaccttgagccaagaragggggctctgtctcctagaagccagaaacaacaaggaaacagatcctcccccaggctctccagaaaagatgcagccctatggaccccctgatttgggcctagtaaaacccatttcagacttcagacctcccaaactctaagagaataaatgtgtgttgtcttaagccactaagttggcggtcactgggctcagcagctggaggaatgaatacagtttctctcctgagatccacactgaaacgcctcctctccacaggtgctctgctaggagccagagacacagcggcagccagagatgg

SEQ ID NO: 169745 - DNA, 601 bp, Human
cttcccctggaaagttctaccacaatggaaaaggggatattttaaaatctcaaacgtgggaaggcaggaagtcctttttttggcctctggctacctacctagaggctatttagagactgatcctcatgggccttcacccaccacccgcctcccaggggagtaagactcccatgtgggatgcaggacccggcctcagcgcaaacacagatccagggaagatggccctgaaactgccccagggcaaaacagagcggagttgggagtctgaggatctctctggccctgaggcacccaggcacgygttggagccacaggaaacacgaattccaacatggccacacagtgcacactgtctcgttacctgggacagtccccatcctgtctgcgcccaccatcggggctccttcagcctcctgcccctgggcccagccatccagggtcttaggagcagaacaggcccttggaaatccattctggtcattttaattttcagcttggaaagatgagagagtttttgtcttgcgcatgggcagctggtggctgaacgaggattagacaccagttctgggccataatttagggcagtgtaatgaaaaatgtt

SEQ ID NO: 169746 - DNA, 601 bp, Human
ctcctcccaaggacgcccaggtgaatcggctgaaatctaattctaggggagcaggacgaggaaccgcacatccccaggctcgtttccagtgtctcccagcccaccttcccctggaaagttctaccacaatggaaaaggggatattttaaaatctcaaacgtgggaaggcaggaagtcctttttttggcctctggctacctacctagaggctatttagagactgatcctcatgggccttcacccaccacccgcctcccaggggagtaagactcccatgtgggatgcaggacccggcctcagygcaaacacagatccagggaagatggccctgaaactgccccagggcaaaacagagcggagttgggagtctgaggatctctctggccctgaggcacccaggcacgcgttggagccacaggaaacacgaattccaacatggccacacagtgcacactgtctcgttacctgggacagtccccatcctgtctgcgcccaccatcggggctccttcagcctcctgcccctgggcccagccatccagggtcttaggagcagaacaggcccttggaaatccattctggtcattttaattttcagcttg

SEQ ID NO: 169747 - DNA, 601 bp, Human
tgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccggcccccagttggttttataaccacagattttgcaaattatcaacagatarttctttcttatataatttgatcaagaacatggaagaaggagtgtttgaaacccatattgtaaagctagcacgccactgactcccaaaatagagaaggctaatttgaacagacattttcctaaagaagatgcacaaatggccagtgagccatgaaaagatgctaaacatcatcagcaaccattagggaaacgcaaattgaaaccacagtgagacagcacttcacacccactaggatgactagagccaaaaccacagatgataactagtgttactggcaaggatgtagagaaagtggaactc

SEQ ID NO: 169748 - DNA, 601 bp, Human
tcacattgtttataacagaaaaactgagcactaaccatccagtgagagggactggtaaaaacattatggcacatccaaggcaacagagccctgcacagccgcttcaaaggaccgtataaatctacacttgttgacaaggtggaaatatgataggaaggtgctaagaaacagaatttgtaggactgaaacttctgggaaaatgcaaaatgcaaaaattggtgcaaaaagaaatgaaaattttgatttgcccaaaagaaactgaaataggaaggtctttcccatccccataccccagttggtktttttttttttttttttttttttttttgagacggagtctcgctctgtcgcccaggctggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgag

SEQ ID NO: 169749 - DNA, 601 bp, Human
ttctcctactgaatcaggctcccaaggcccctgtaggaaatatccacacctcagcacagaagtcacaaacccagatggtgattttgctggaaaattgttattagcaggaaaatgtgaccagatatctggacaggccctcgaggacagtaaaacaatgaatggtaaccaaaggaacagagtgagacctttaaacagagaacgcctcgccaaacgatactgagcattctcttattgcaggctatgacactgaggccagatgctacaggccagcactgactcatccatgaatcaacgtgaacgygtcaactcccctccttcaagtcatagtttgcaatttgtcccaggcacacttaggagagccaaatcttcatcagaaggcactgggagacgggagccttgctgagatgggtcgagtgtgagatgctaacacgggctttgctttcagactgagagcccaggcatgaggttggacctcatggaaaggacaaggaaggaattactcagcagccaggtccagtctgacagctcggagagggggaatttctagctgccaccttgagcatcgtaaaagaacactggttcttacaaccaggagagcact

SEQ ID NO: 169750 - DNA, 601 bp, Human
aaacaacttctcctactgaatcaggctcccaaggcccctgtaggaaatatccacacctcagcacagaagtcacaaacccagatggtgattttgctggaaaattgttattagcaggaaaatgtgaccagatatctggacaggccctcgaggacagtaaaacaatgaatggtaaccaaaggaacagagtgagacctttaaacagagaacgcctcgccaaacgatactgagcattctcttattgcaggctatgacactgaggccagatgctacaggccagcactgactcatccatgaatcaacrtgaacgtgtcaactcccctccttcaagtcatagtttgcaatttgtcccaggcacacttaggagagccaaatcttcatcagaaggcactgggagacgggagccttgctgagatgggtcgagtgtgagatgctaacacgggctttgctttcagactgagagcccaggcatgaggttggacctcatggaaaggacaaggaaggaattactcagcagccaggtccagtctgacagctcggagagggggaatttctagctgccaccttgagcatcgtaaaagaacactggttcttacaaccagga

SEQ ID NO: 169751 - DNA, 601 bp, Human
tccttcccaagactcatgttgaaaatccccaatgcatcattattaagaggtgggccctttaggaggtgattaggccattggggatggattggtgtctttatgaatgggtttgagggagaaagtctggaccctttctgtttttccatcttcggccatgtgaggacacggcaacgaggtgtcatcttgaagcagagggcagccttcaccagacactgaccctgccagcgcctagatcttggacttcccagtctccaggactataaggaatgaggtatttgttttttgtttgtttgtttgtttttttttaaagattgtaaaggactcattcctctctcaagcacagagagatgacagaagcaaggaagtctttttagagccacacaggactttgaagaccctaagtttacctttcacatccaaactgaattaaagtcatgagattatttttcatgactcatttacttcttcttccccatgctcttttagaggtagtttcaggctggcttcggggatgtctacacagattttaaacttataaacaagaatttcctgctgtcttatctccagtttgcctggatgactttcctggctttgaaaagct

SEQ ID NO: 169752 - DNA, 601 bp, Human
ccatatgccaggctccaggttgaaatgcctgaccagtctcatgtcacttagttcttacaacactctgtagggtagataatattccccatgccattgtgcagaactcaaaactcaggatccgaaaggtcaagttgtgtgcccagggttatgccactaggacagtccaggcaggactggaaaccaaccaggctacctgcaagcccaagcttgcaactgtacacaaagacagttcttctggacactgccttttcagagcctttcaccagtcaacctcgttggaatgtaacccactaagccacgkgcaggagccgagccactcatgtcccctttgatgaggcacacatctccggttggctccagcccccagctctccgtactaacactgcagacagccaccgctatttatcttcctgtctgacctggacaactctaggtttgtgaggtctgctagatcacccttctgctgcatgccataatatgttagacattcgtcaggcacatcaatgtgaacaaggctcagagaagacacacgggaaacagacctgtaatgttagcaagtattgggagattaacagacccggagaagcctacacagggaaga

SEQ ID NO: 169753 - DNA, 601 bp, Human
gtgtggtggcgggcgcctgtagtcccagctactcaagcgctgaagcaggagaatcgcttgaacctgggaggcggaggttatagtgaatcgagatcgtgccattgcactccagcctgggtgacagagactccatctcaaaaaaaaataaaactacaaatagacaatgccacttcaggaattggtcctagagctacactcaaacgaaaaacgacctacacaccaaggtttcccactgaagccctgtttgtgagaccaaaagactagaaaacacctaggcatccatcccaggagagctgggtaygtcagttttggtgatcatgatgacgaggatgatgactgctctcctttacatgtgtattacagttaggtcctgttctaagcctcattactcaaagcacggtccagggaccagcagcttctgtcacctggtggctgtctgagaacacagactcctctgccccaggccagctgagtcagaatctgcattttaccaagatgcctgggaaaatcctacgtacattaaggcactatttttaaaaactcttcccataataacccattacatcttgtaacaacccaatggcccaaatcctctcatcac

SEQ ID NO: 169754 - DNA, 601 bp, Human
ggggcaaaaggactctgactgtgtctggggggaatgatgagggcaggactggtagtaagaggagctggccacagggctggcgtcaattaagacaaaatcacctgagccagcagaacaggcaagacagagaagcacagaacccactggggcccagttggaaggtttccccaacatctacaagtccacagaaatgtgttactaaaaatagaaaaattagccggtgtggtggcgggcgcctgtagtcccagctactcaagcgctgaagcaggagaatcgcttgaacctgggaggcggaggttayagtgaatcgagatcgtgccattgcactccagcctgggtgacagagactccatctcaaaaaaaaataaaactacaaatagacaatgccacttcaggaattggtcctagagctacactcaaacgaaaaacgacctacacaccaaggtttcccactgaagccctgtttgtgagaccaaaagactagaaaacacctaggcatccatcccaggagagctgggtatgtcagttttggtgatcatgatgacgaggatgatgactgctctcctttacatgtgtattacagttaggtcctgttctaagc

SEQ ID NO: 169755 - DNA, 601 bp, Human
taagtgactcaccctaggtcacaaggccggaaatagcagggctaggatttgaacctggggagcctggctcgggagcccgagctctaaccatcaggcagcactgcctccaccaatgctgagcctttctccataacctggacaatgggggagtaggtgctggaggtgaaaggggcaaaaggactctgactgtgtctggggggaatgatgagggcaggactggtagtaagaggagctggccacagggctggcgtcaattaagacaaaatcacctgagccagcagaacaggcaagacagagaagmacagaacccactggggcccagttggaaggtttccccaacatctacaagtccacagaaatgtgttactaaaaatagaaaaattagccggtgtggtggcgggcgcctgtagtcccagctactcaagcgctgaagcaggagaatcgcttgaacctgggaggcggaggttatagtgaatcgagatcgtgccattgcactccagcctgggtgacagagactccatctcaaaaaaaaataaaactacaaatagacaatgccacttcaggaattggtcctagagctacactcaaacgaaaaacgacc

SEQ ID NO: 169756 - DNA, 601 bp, Human
ataaaatatacatatactatatattatatagtatatatagtatagatagtatacatactatatattatatattttctattatagtatattatataatatagtatataccacataatatagtatattatataattgtatattattgtatatgtaatatatattatatataatatataatatagcatattatagtatattatataatatatatttatatctaaatttatatatttatttatatttataaatttatataatatatacatattatactatatattatattatatataatatatasttatacatagatatataatatatactatatattatatatagtatatatactattacatattatatactattatattatataatagtatatagcatatatactatagtatatatagtatatatactataatatatatagtatatattatatataaaatatagaagacatattaatatatattatgtattttttatgtgtatatatatataaagcacatactaacgtaggtgctcgtgtacagatgtaacatgtattttgttctaataccccaggaagggctgagaaaggttattttgcagg

SEQ ID NO: 169757 - DNA, 601 bp, Human
attatagatataaaatatacatatactatatattatatagtatatatagtatagatagtatacatactatatattatatattttctattatagtatattatataatatagtatataccacataatatagtatattatataattgtatattattgtatatgtaatatatattatatataatatataatatagcatattatagtatattatataatatatatttatatctaaatttatatatttatttatatttataaatttatataatatatacatattatactatatattatattatatayaatatatagttatacatagatatataatatatactatatattatatatagtatatatactattacatattatatactattatattatataatagtatatagcatatatactatagtatatatagtatatatactataatatatatagtatatattatatataaaatatagaagacatattaatatatattatgtattttttatgtgtatatatatataaagcacatactaacgtaggtgctcgtgtacagatgtaacatgtattttgttctaataccccaggaagggctgagaaaggtta

SEQ ID NO: 169758 - DNA, 601 bp, Human
cacaaagaaaattagctggacgtcatggtgcacgcctgtaatcccagctacttgggaggctgaggcacaagaatcgcttgaacccgggagacagaggttgcagtgagccggagatcatgtcacggcgctccagcctgggtgacagagtgagactccacctaaaacatatatatataatatatactataatatataatatatataatatactatatattatatatttttatattatagtatatatatgtttttatatattatacatattttatatattatagatataaaatatacatatacyatatattatatagtatatatagtatagatagtatacatactatatattatatattttctattatagtatattatataatatagtatataccacataatatagtatattatataattgtatattattgtatatgtaatatatattatatataatatataatatagcatattatagtatattatataatatatatttatatctaaatttatatatttatttatatttataaatttatataatatatacatattatactatatattatattatatataatatatagttatacatagatatata

SEQ ID NO: 169759 - DNA, 601 bp, Human
aggagtttgagaccagcctggccaacatggagaaaccccgtgttgtagagactaaaaaccccgtgttagtagagactaaaaacacaaagaaaattagctggacgtcatggtgcacgcctgtaatcccagctacttgggaggctgaggcacaagaatcgcttgaacccgggagacagaggttgcagtgagccggagatcatgtcacggcgctccagcctgggtgacagagtgagactccacctaaaacatatatatataatatatactataatatataatatatataatatactatatattrtatatttttatattatagtatatatatgtttttatatattatacatattttatatattatagatataaaatatacatatactatatattatatagtatatatagtatagatagtatacatactatatattatatattttctattatagtatattatataatatagtatataccacataatatagtatattatataattgtatattattgtatatgtaatatatattatatataatatataatatagcatattatagtatattatataatatatatttatatctaaatttatatatttatt

SEQ ID NO: 169760 - DNA, 601 bp, Human
tcccagcactttgggaggccgaggcaggcagatcacttgaggtcaggagtttgagaccagcctggccaacatggagaaaccccgtgttgtagagactaaaaaccccgtgttagtagagactaaaaacacaaagaaaattagctggacgtcatggtgcacgcctgtaatcccagctacttgggaggctgaggcacaagaatcgcttgaacccgggagacagaggttgcagtgagccggagatcatgtcacggcgctccagcctgggtgacagagtgagactccacctaaaacatatatataaaatatatactataatatataatatatataatatactatatattatatatttttatattatagtatatatatgtttttatatattatacatattttatatattatagatataaaatatacatatactatatattatatagtatatatagtatagatagtatacatactatatattatatattttctattatagtatattatataatatagtatataccacataatatagtatattatataattgtatattattgtatatgtaatatatattatatataatatataatatagcatattatag

SEQ ID NO: 169761 - DNA, 601 bp, Human
gattaatgaacttagaaggtgcatcatgaagcatcaaccagtgcctgaagattcatttactgaacacgtgttcatgcctcgggtactgagcccagcactaccgtgtgctctggggtgctccagaggcaagacaggcgcaggctctggtggggccaacagaaggaaagttccctcccatgagccactaaatgaggaggagcatgcaaattagcctgattacacctaggaagaaagaaatgtaggccaggtgtggtggctaacgcctataatcccagcactttgggaggccgaggcaggcagrtcacttgaggtcaggagtttgagaccagcctggccaacatggagaaaccccgtgttgtagagactaaaaaccccgtgttagtagagactaaaaacacaaagaaaattagctggacgtcatggtgcacgcctgtaatcccagctacttgggaggctgaggcacaagaatcgcttgaacccgggagacagaggttgcagtgagccggagatcatgtcacggcgctccagcctgggtgacagagtgagactccacctaaaacatatatatataatatatactataatatataatatatataat

SEQ ID NO: 169762 - DNA, 601 bp, Human
tcgcagccgagtctgacctacaaaacccaagagagaatgtagtgctttatcaagaagagattaatgaacttagaaggtgcatcatgaagcatcaaccagtgcctgaagattcatttactgaacacgtgttcatgcctcgggtactgagcccagcactaccgtgtgctctggggtgctccagaggcaagacaggcgcaggctctggtggggccaacagaaggaaagttccctcccatgagccactaaatgaggaggagcatgcaaattagcctgattacacctaggaagaaagaaatgtagrccaggtgtggtggctaacgcctataatcccagcactttgggaggccgaggcaggcagatcacttgaggtcaggagtttgagaccagcctggccaacatggagaaaccccgtgttgtagagactaaaaaccccgtgttagtagagactaaaaacacaaagaaaattagctggacgtcatggtgcacgcctgtaatcccagctacttgggaggctgaggcacaagaatcgcttgaacccgggagacagaggttgcagtgagccggagatcatgtcacggcgctccagcctgggtgacagagt

SEQ ID NO: 169763 - DNA, 601 bp, Human
cccactccagcgcagtgggcatcggggctgcctcgggcatggtgggatgtttagcagtacccttggcctcttctcactaatgccagtagcacctctccatgtcatgacaaccaaatatgtctccagacattgctacatgtcccctgggaggaaaaccatccctggtcaagagccatggctgtacaaacacactccctaaacaagccaagaaaggaagatgtgtaaaggtgagtcatcgcagccgagtctgacctacaaaacccaagagagaatgtagtgctttatcaagaagagattaatraacttagaaggtgcatcatgaagcatcaaccagtgcctgaagattcatttactgaacacgtgttcatgcctcgggtactgagcccagcactaccgtgtgctctggggtgctccagaggcaagacaggcgcaggctctggtggggccaacagaaggaaagttccctcccatgagccactaaatgaggaggagcatgcaaattagcctgattacacctaggaagaaagaaatgtaggccaggtgtggtggctaacgcctataatcccagcactttgggaggccgaggcaggcagatcacttg

SEQ ID NO: 169764 - DNA, 601 bp, Human
agggatatttcggagtgatacggaaacgttctagaatcagacaatgggatggctgcacaacaatgagaatatactaaaaaaaaaaaaaaaaaatcaccaaattgcactctttgaaatggtgagttttatgttaggaaaattagatctcacattttttaaaaaactaaaaagcaaaacaggggtgggaatgacccactcactgtgccttagagggacagtttgtataaataaacagtaaggatgcctaccgcagtgtctggctgtttacccaataaatgcctgcctcaccagcagcagactrggagctcatggcccaccccatcctcaacacagccccagggcagatgctgcaacctcactttgcaaaggaggaacaagactctgagtgaggaaggcctttgagctggtccacggcaaggccaagattcgaaccctggtctgtcaaaaccaaagcctgcattctctgccacgacaaccacaagctctcgtgctgcaaacacacccaaggcctcccttccgtctgggtttacagtcagttctcaactagggtcaaagctccccagaagggggtgggacctacacatgagcttggaggtcagca

SEQ ID NO: 169765 - DNA, 601 bp, Human
acaacaacaacaaagggatacagaaaatacactggcaattcctaaaaaaagtttaatatgtagtcttcacgtgacccaacaattccactcctaggcgtgtacccacgagaactgaaaacacgggttcacatgaaaaacttgtacacaagagttggcagcagcattatttatgatggccaaaaagtggaaacaacccgatgtccattaacaaatgaatggataaacaaaatatggtgaatccatatagtggaatattgtttgccataaaaaggagtcattttctgatccatgatacaacacrgacaaaccttcaactcgttacacgaaatggaagaagccagatacaaaagccacacattgaatgatcctatttctatgaaatgtccggaacaggtaaatccatagaaacagaaagtagcttactggttgcctagagctaggggttgggggagcagagagtggctcttaagggatatttcggagtgatacggaaacgttctagaatcagacaatgggatggctgcacaacaatgagaatatactaaaaaaaaaaaaaaaaaatcaccaaattgcactctttgaaatggtgagttttatgtta

SEQ ID NO: 169766 - DNA, 601 bp, Human
tagctcagggcagagctttgcataccctaagtgctcaataaatgctagctcagggcagagctttgcataccctaagtactcaataaatgctagctcaggacagagctttgcataccctaagtgctcaataaatgctagctcagggcagtggtccagacagtaatgtaagcttgggtgtccccagtgtagagatggcatttaaagccagaagactggatgagctcgcctggggaaagtgtgtacagcctgacaagcaatgtgaaggtggcctctgtgttccactgagaggtcaggggaatgmaacggagactgtgcaggagtacccggtaaggaaggatctggaagacgcttgggcaggaagaatggggacaccaacagggtatggggtcccggaaaacaggggaggaaaatagagggagcaaactccgtgtccgttgctctgcagatggacctaagaacacactatctatccactggctttgacaatgatgaggtcattggcaaatatatatgtaataccatgtctgggggtgatgagtatttcaaagccaaaaataaagcatccagtggaaacaaagcctgttttactcatgacagcaca

SEQ ID NO: 169767 - DNA, 601 bp, Human
aagattgccaggagcctctgaagccagaagaggcaaggagggattcctccctagagcctttgtaagaggacaaccctgtggcaccttgactttagacttctcgcctccagactgtgagacaataaagccctattgtttcaagccacccagtgagtgggacttcgcatccagggccctggtcaggacaccaaggcgctctacaagaagcaagaaccactggggtgggactttcagtggtgtttataaggccactcaggctgcccctggagagccgatggcaggggtcaacctggaagcaggsagaccaggtggaggcaacagaatggtccacgtgggaggtgacgtgagactggacccagggcagtggggagggaggctggtgagaaaaggccagatcctcaagagttcatttttaaaatctttagaatttattttggttttaactttttgttgtgaaatgattatagattcacaggaagttgaaagacgatgtacagggaggtcccaagtgcccttcatccagtttcccccaaaggtgatgtctcgaataacaagaacacagcctccaaaccaggaaggtggcagatttaggactgaattt

SEQ ID NO: 169768 - DNA, 601 bp, Human; identical to SEQ ID NO: 23061

SEQ ID NO: 169769 - DNA, 601 bp, Human; identical to SEQ ID NO: 23062

SEQ ID NO: 169770 - DNA, 601 bp, Human; identical to SEQ ID NO: 23063

SEQ ID NO: 169771 - DNA, 601 bp, Human; identical to SEQ ID NO: 23064

SEQ ID NO: 169772 - DNA, 601 bp, Human; identical to SEQ ID NO: 23065

SEQ ID NO: 169773 - DNA, 601 bp, Human; identical to SEQ ID NO: 23066

SEQ ID NO: 169774 - DNA, 601 bp, Human; identical to SEQ ID NO: 23067

SEQ ID NO: 169775 - DNA, 601 bp, Human; identical to SEQ ID NO: 23068

SEQ ID NO: 169776 - DNA, 601 bp, Human; identical to SEQ ID NO: 23069

SEQ ID NO: 169777 - DNA, 601 bp, Human; identical to SEQ ID NO: 23070

SEQ ID NO: 169778 - DNA, 601 bp, Human; identical to SEQ ID NO: 23071

SEQ ID NO: 169779 - DNA, 601 bp, Human; identical to SEQ ID NO: 23072

SEQ ID NO: 169780 - DNA, 601 bp, Human; identical to SEQ ID NO: 23073

SEQ ID NO: 169781 - DNA, 601 bp, Human; identical to SEQ ID NO: 23074

SEQ ID NO: 169782 - DNA, 601 bp, Human; identical to SEQ ID NO: 23075

SEQ ID NO: 169783 - DNA, 601 bp, Human; identical to SEQ ID NO: 23076

SEQ ID NO: 169784 - DNA, 601 bp, Human; identical to SEQ ID NO: 23077

SEQ ID NO: 169785 - DNA, 601 bp, Human; identical to SEQ ID NO: 23078

SEQ ID NO: 169786 - DNA, 601 bp, Human
actacagacgccaccacgctggctaatttttgtatttttagtagagacggggtttcgccatgttggccaggctggtctcgaacccctgacctcgtggtccgcccgcctcggcctcccaaagtgctgggattacatgcttgagccaccccgccggccggccgttcttaaacgcacgactacttccctagctttccagcaccaaatccagcggccccacccggccacgcccccacgccaggccatgacccccatatggctcactgcgcaagctcacacccagtcccaggaagcgagccccacstcgccccagctctgcattcacagccgccaagcggtcccggaagccgaatgccggataggtcaaagacagcgccgctgctccggcactgccgccagagggcgcggagtcgccgtgttggcctgcacctcccttgtcacgtcagccgaacggctacggcaatggaggattttgccgtatgcgacgacaggatgactgcttcccctgaagcttcaccaaacacggagaggctttcctgtccctgggagacgcggtgatgtgacgcagcggttgcagcgaaggtttcttgtaaaagatggccgc

SEQ ID NO: 169787 - DNA, 601 bp, Human
attattattattaacagaggacactattaagaatccagcattgtaatctgaatactcattttaatccttccaacgatcccccagatcgttgtctcatttcacgaaagaaaaggagcctctaatcccatccctaccagggtttggcaaagtgggcaagtgagaggctcaaccatgagcttcagttcctcctctgtaaatggtaacaatggcactgtcacaaagaggaccaagtgagaccacaggaggcccgtgtgtgtgcgtgtgtgtgtgtatgtgccagagacagaaagagagagagagacaaagtttcactcttgctgcccaggctggagtgcaatggtgcaatctcagctcaccgcaacctccacctcctgggttcaagcaattctcctgcctcagcctcctgagtagctgggattacaggcatgcgccatcatgcccagctaattttgtatttttagtagagatgggtgagttctccatgttgatgaagctggtctcgaactcccgacctcagatgatccgcctgcctcggcctcccaaagtactgggattacaggtgtaagccacccagcccgggcttttttttggggggggacga

SEQ ID NO: 169788 - DNA, 601 bp, Human
tggagttttactcttgttgtccaggctggagtgcaatggcgcaatctcagctcactgcaacctccacctcctgggttcaagtgattctcctgactcagcctcctgagtagctgggattacaggcatgcaccaccatggccggctaattttgtatttttagtagagatggggtttctccatgttggccaggctggtataaaactcctgacctcaggtaatccgcccgcctcagcctcccaaagtgctgggattacaggtgtgagccactgctcccgacccattttttcttttttcttttttytttttttgtatttttagtagagatggggtttcaccatgttggccaggctggcctagaacttctgacctcaattgattctcccatcttgccctcccaaagtgctgggattacaggtgtgagccactgcacctgcccaagagctttgtttctatcctttctagtccattccctcataatttctgagccccaatccttcccttcttccaaccctcttctctttgttttcctactaggcctgcctttgcgaagtcccactgtagatcataaggaggctgcaagaactgatgagtggtccatttc

SEQ ID NO: 169789 - DNA, 601 bp, Human
acctggctaggcagccaggacagggattcctatttactacactctggttttataggtaagtaaacagattcccaaggataaggaacctacttttcccaacctcaacctgaatttctgggattaataccttctaagaatagatatgaatgtgtagtgttgtagcagtagcagtagtatttaatagtagtagtagtagtgtagtaccatcatccccattccccattcctcaagctggaagccattcttttcttcacttctggtggagatggggacaaaagctttgtttcttttttttttttttgagacggagtctcgctctgccacccacgttggagtacagtggcaggatctcggctcactgcaacctccacctcccgggttcaagcaattttcctgcctcagcctccaaattagctgggattacaggcctgcaacaccatgcccagttaatttttgttttgttttgttttgttttttgagacagagtctggctctgtcgcccaggctggagtggagtagcacgatctcagctcactgcaacctccatccccctagttcaagcgattctcctgcctcagcctcctgagtaactgggattaca

SEQ ID NO: 169790 - DNA, 601 bp, Human
ggattaatgttacattaacagatatgccagcttgcctcctcatggagttgtaaaaatgtacactcccacttgtaggtatcacagcctgctttccccagccttgcaaacagtgtcccatcacaagtcattctgaatgctagtataggacaccaaatctctctttcctcctaacaacctggctaggcagccaggacagggattcctatttactacactctggttttataggtaagtaaacagattcccaaggataaggaacctacttttcccaacctcaacctgaatttctgggattaataccttctaagaatagatatgaatgtgtagtgttgtagcagtagcagtagtatttaatagtagtagtagtagtgtagtaccatcatccccattccccattcctcaagctggaagccattcttttcttcacttctggtggagatggggacaaaagctttgtttcttttttttttttttgagacggagtctcgctctgccacccacgttggagtacagtggcaggatctcggctcactgcaacctccacctcccgggttcaagcaattttcctgcctcagcctccaaattagctgggattacaggc

SEQ ID NO: 169791 - DNA, 601 bp, Human
tattgcttgagacagattaacccttgtctgtttaagccactatagaaggctacattgttatttgcaatgtaatttgcattgttatttgcactatagaaggctacattgttatttgcagccacagtcataattataattatatgtgataaatcttggagcttattctacaacagtactactttattttgtaggaggggctgcatagaattcctgttaaacaaatgtgtcttttttttttttttgagatgtggtgtcactctgtcacccaggttggagtgcagtagtgcgatctccactcacygcaacctctgcctctgcagctcaagtgatcctcctgcctcagcctcctgagtagctgggactacaggtgcctgccaccacgcccagctcatttttgtattttttgtagagacagcgtttcaccatgttgctcaggcttgatgtgtcatttttcaaaaatcaagccagtcccctatttatgaacaattagtttgcttccatgcttttgccattcaaacagccctcaactgtacctctttctacgtttgtctgtgcacatgggggaatacatatgtaagatagtttccttggccctgaagtg

SEQ ID NO: 169792 - DNA, 601 bp, Human
cagagtgagactctgagaaagaaaaggaaaagaaaagaaaagaaaggagggagggagggagggaaggaaggaaggaagaaagaaagaaaggaaagagagagagagagaaagaaagaaagagaaaaagaaagaaagaaaggaaccacgaaatagccaggcaagtccaggagtgacagggccaaaaccttccgccacagctcccatcagacaactagccatatctctggaggagccttgggaacccttgactttggcaggtaagaatattaacttgcttgctgggctgcttattctgttttgkcccattataatgggcctctgtcaccccaaaactgtatgatcacagggtagatggacaagcccatagagagcattttacctatcatctaagctgttcttcagggactttggtttcctcacacacctttcttatcaggcctggatgcttcaggacagttgcagcaactgctcttttagtagatgaaaccaataaactggctttaggacaacatctggaggttttaaccccacaccaagtacaaggagtcctagaagctaaaggacaccagtggatgacgaggacacttacggaaatatcagg

SEQ ID NO: 169793 - DNA, 601 bp, Human
gatgaagaaaggtatgaaaaagcctgttaactctgaaaaggttaaggaagtttctcagggtaaagatgagaatccagttttgtttcaagggcgtttcattgaggctatcagaaactacagtaacactgatcctgcctcaagggaaggacaaacccttttcggagtacattttataacccattctgcccctgatacccgtaggaaactacaaaaagcagctatgggtccccaaattcctatggaacagcttttggatatggcatttttagttttttgttttttgtgggtttttttgagatgsagccttgctctgttgcccaggctggagtgcagtggcacgatctcagctcacagcaagctctgcctcctgggttcatgccattctgctgcctcagcctcctgagtagctgggattacaggtgcccgctaccatgcccagctaattttttgtatttttactagagacagggtttcaccattttagccagaatggtctcgatctcctgacctcgtgatctgcccgcctcggcctcccaaagtgctgggattacaggtgtgagccaccgcacccagcctggcatttttagtttttaataacgga

SEQ ID NO: 169794 - DNA, 601 bp, Human
aaaaaattaatcctttataacaaacccttgtagcagagcacatctccccacatatatacaagcattgtacctagggtggatgcattcctcctcttactttcgggaatgtcctactctgtctatggtgtagctgttctttcactactttacttttttttgagacgaagtttcattcttcttgcccaggctggactgcaacggctggacttgctcgggtcaccgcaatctccgcctcctgggttcaagtgattctccggcctcagcctcccaagtagctgggattacaggcatgcaccaccaygcccagctaattttgtatttttactagagacggggtttctccacattggtcaggctggtttcgaactcccgacctcaggtgatctgcccaccttggcctcccaaagtgctgggattataggcgtgagccaccacaccgggctcactactttacttgcttaataaacttgcttttactttgcactatggactcgccctgaattctttctttcacaagatccaagaaccctctcttggggcctggatggggacccctgtcctgtaacatatttctggtgaccacaaagggacagcaggcatt

SEQ ID NO: 169795 - DNA, 601 bp, Human
aacacttattcaataaaatctatgaatattctgtaggaaaagcaagcatctcaggtatctgaaccaagactgccaccactctcctccctatcagatcagcaaggcagagaatctgctgcagattgctgctgccagacagggctccctctccctgcagctcttagtcagaaggctttatctggccaggtgcagtggctcacacctgtaatcccagcactttgggaggccgaggcgggtggatcatgaggtcaagagtttgagaccagcctggccaatatggtgtgctgagaccagctcggtrggggagaccctaatccagcagcgctagaggaattaaagacacacacacagaaatatagaggtgtgaagtgggaaatcaggggtctcacagccttcagagctgagaggcccgaacagagatttacccacgtatttattaacagcaagccagtcattagcattgtttctatagatattaaattaactaaaagtatcccttatggaaaacaaagagatgggccgaattaaaggaataggttgggctagttaactgcagcaggagcatgtccttaaggcacagattgctcatgctattgtttgt

SEQ ID NO: 169796 - DNA, 601 bp, Human
attgtaccactacactctagcctgggcaacagagtgagactccatcacaaaaaacaaaacaaaacaaaaaaaacagacataagtagaataccaaattccagcatgaaagcatgaggagctccatgacctattctccagtaagacttgtgaaaactataaagacccaactacttaaaacctctagaaacgagctggtcacagtggctcatacctataatcccaccactttggaaggctcaggtggaagaattgcttgagccgaggaatttgagaccagccaggacaatatggggagaccccrtctctacagataaattaaaaaataactgggcatggtagcatgcacctatggtcccagctactcaagaggctgaggcaggaggattgcctgagcctaggaggtcaaggctgcagatcctgtctcaaaaacaaacaaacaaacaaacaaaaactctagaaattgtcataagggcaacaggaaaatgcagaaacacttattcaataaaatctatgaatattctgtaggaaaagcaagcatctcaggtatctgaaccaagactgccaccactctcctccctatcagatcagcaaggcagagaat

SEQ ID NO: 169797 - DNA, 601 bp, Human
gaaagagtagttatctccaatcataagactgtggagcagactgcaagggagaagggtatacatatcccactgatctctctgccaacccaccctcaactgaaaaaaacaaaaattagactatcttttaggactgaagtagtgattcccagtaagatacaaaaagctgtattggagaacttttaaaatatatcaaaaagcctaaaaacaatcatacaatcatcctcaataaagctgtacagtctaatacaaacaagtttcattactttgactagaatcttatcacagtgggaatattccagcyaggccaagtgcagtggctcacacctgtaatcccaacactttgggaggactgcttgaggctaggtgttgaagaccagcctgggcaacacagcaagaccccatctctgaaaaaacaaaaaattgctcttaattagccaggcgtagtggtgcgcacatgtagtcctagctactcagggggctaggtgggaggatagcttgagcccagaaattcgaggctgcagtgagctctgactgggccactgtgctctaccctggggaacagattgagaacttgcctcaagaaaaaaaaaaaaaaaaggaa

SEQ ID NO: 169798 - DNA, 601 bp, Human
ggttgcagtgagctgagatcgtgccactgcactccagcctgggcaacagagtgggacttcctctcaaaaaaaaaaaaaaatggttaacagtggcaaaatacccttggggaggagccaatgaccactgtttggggtaccctcacagcaacaagatacataaccaggaaaaggatgttcactccagcaggctgcaggggttttctgagaaagagtagttatctccaatcataagactgtggagcagactgcaagggagaagggtatacatatcccactgatctctctgccaacccaccctcawctgaaaaaaacaaaaattagactatcttttaggactgaagtagtgattcccagtaagatacaaaaagctgtattggagaacttttaaaatatatcaaaaagcctaaaaacaatcatacaatcatcctcaataaagctgtacagtctaatacaaacaagtttcattactttgactagaatcttatcacagtgggaatattccagccaggccaagtgcagtggctcacacctgtaatcccaacactttgggaggactgcttgaggctaggtgttgaagaccagcctgggcaacacagcaaga

SEQ ID NO: 169799 - DNA, 601 bp, Human
ttgggcgtggtggcaggtgcctgtaatccagctacttgggaggctgaggcaggagaattgcttgaacccaggaggtggaggctgcagtgagccatgaccatgccactgcactccagcctgggcgacaagagtgaaactccatctcataaaaaaaaaagttggccgggtgcggtggctcacacctgtaatcccagcattttgagaggccaatcacctgaggtcaggagtttgagagcagctggccaacatggtgaaaccccatctctactaaaaataaaaaaattagctgggtgtggtggcrggcacctttaaggccagctacttgggaggctgaggcaggagaatcacttgaacctgggaggcagaggttgcagtgagctgagatcgtgccactgcactccagcctgggcaacagagtgggacttcctctcaaaaaaaaaaaaaaatggttaacagtggcaaaatacccttggggaggagccaatgaccactgtttggggtaccctcacagcaacaagatacataaccaggaaaaggatgttcactccagcaggctgcaggggttttctgagaaagagtagttatctccaatcataagact

SEQ ID NO: 169800 - DNA, 601 bp, Human
acaatttttttttctctgaaacacaagaatattgtcaaagacttacttttacaaagtggcatatggccaggcgcaggggctcacacccgtaatcccagcactttgggaggccaaagtgggcggatcacctgaggtcaggagttcgagaccagcctgaccaacatggagaaaccccatctctactaaaaatacaaattagctaggcatggtggcacatgcctgtaatcccagctactcgggaggctgaggcaggagaattgcttgaacccgggaggcagaggttgcagccggctgagatggygccatcacactccagcctgcataacaagagcaaaattccatctaaaaaaaaaaaagtggcataaaaccgctataaatgcgtaacattttcctgaatgatgaaatacacacagctgggtgtggtagctcacacctgtaatcccaacactttgggaggctgaggcgggaggatcaccaggtcaggagtttgagaccagcctggccagtatggtgaaaccccgtctctacgaaaaatacaaaaattaaccaggcgtggtggcgctcgcctgttgtcccagctactagggaggctgaggcagaa

SEQ ID NO: 169801 - DNA, 601 bp, Human; identical to SEQ ID NO: 26277

SEQ ID NO: 169802 - DNA, 601 bp, Human; identical to SEQ ID NO: 26278

SEQ ID NO: 169803 - DNA, 601 bp, Human; identical to SEQ ID NO: 26279

SEQ ID NO: 169804 - DNA, 601 bp, Human; identical to SEQ ID NO: 26280

SEQ ID NO: 169805 - DNA, 601 bp, Human; identical to SEQ ID NO: 26281

SEQ ID NO: 169806 - DNA, 601 bp, Human; identical to SEQ ID NO: 26282

SEQ ID NO: 169807 - DNA, 601 bp, Human; identical to SEQ ID NO: 26283

SEQ ID NO: 169808 - DNA, 601 bp, Human; identical to SEQ ID NO: 26284

SEQ ID NO: 169809 - DNA, 601 bp, Human; identical to SEQ ID NO: 26285

SEQ ID NO: 169810 - DNA, 601 bp, Human; identical to SEQ ID NO: 26286

SEQ ID NO: 169811 - DNA, 601 bp, Human; identical to SEQ ID NO: 26287

SEQ ID NO: 169812 - DNA, 601 bp, Human; identical to SEQ ID NO: 26288

SEQ ID NO: 169813 - DNA, 601 bp, Human; identical to SEQ ID NO: 26289

SEQ ID NO: 169814 - DNA, 601 bp, Human; identical to SEQ ID NO: 26290

SEQ ID NO: 169815 - DNA, 601 bp, Human; identical to SEQ ID NO: 26291

SEQ ID NO: 169816 - DNA, 601 bp, Human; identical to SEQ ID NO: 26292

SEQ ID NO: 169817 - DNA, 601 bp, Human; identical to SEQ ID NO: 26293

SEQ ID NO: 169818 - DNA, 601 bp, Human; identical to SEQ ID NO: 26294

SEQ ID NO: 169819 - DNA, 601 bp, Human; identical to SEQ ID NO: 26295

SEQ ID NO: 169820 - DNA, 601 bp, Human
tcaattccctactttaaaccgtcccatagcctgccactgcattcacaataaaatccaatttcctgaccgtggccgacaaagccctgcagtaactaaccccaccaagataagataattatttttatttattggtgtacacgtttatcgtctctcactacactaaaatgtaagctcctatcttaattcccgctgtatcccagtgtcgcgaatagagcctggtacgaattaaggggacggggttgtgtgggtttatatcagcacttgtccatgagttggcaaaccgtcaactgcccccagtggrtcgtcactaggtatcctggggcggcccctcacccagctccagggcggcgcccctccccgagcccctggcccattttcacttccctgaggaaataatggcgggagacccctggcgcgcgcatcccgccccgagccaccgacttcagcagctctctcgccgcagcagccctgcttgcagcccccaactccctggtccactggccacacctctcgcgcgttctcctggcccacaagccctgaggccgcctgcttggccaagccgctctcgtccagccccagccctttcacgtggctgtgggag

SEQ ID NO: 169821 - DNA, 462 bp, Human
ctcatggactgtgaagtaccttggtcccacacttatggcagcccctcaaaaaatatgtaaggactacaggcgcctgccaccatgcctagctaatttcttgtatttttagtagagaaggggtttcaccatgttagccgggatggtctcaatctcccgaccatgtaatccacctgctactcgggaggctgaggcagaagaatggcgtgaacccaggaggcggagcttgcagtgaaccgagatggcgccactgcactccagcctgggcgacagagcgagactccctctcaaaaaaaaaaaaaaatgatgtaagcaatgtgtgtgggtatgctatatccatcccatttccacttcagttaccaaagcacactgcccttaatagaacctagaagatattcttcagatgctacttttcttttctctttcagatggagtctcgctgtcacccgggctggagcgcaatgg

SEQ ID NO: 169822 - DNA, 601 bp, Human
ggcctacacaagtcacacactcatccaactaacactgagtgccagtgcactgcagtcactgttctaggtgccgagggtaacgaaggcaaggcagaaaagccttgtacttgtggagctcatgttttagggagggatacaaacatacaaacattgcacacataatcttcatcactactatgaagaaaaagggatgatgagagagaacgagtggctagaaagtgatcctggagtgtctttctgatgacatttaatttgatatgtgaacctctgggaggagcaggagtcagcgttccaggcaaasaaaacagcgaattcagaaaatccaaagcagaaacaagcttggcatatccaagggacagaaaggttgcagtgaccaaagtatagcgaaaaagaccaggaagatgaggttgaagaggtagacagcggccagaacgcagaacaggaacttacagtgtgtggtaaagtttggattttattctacataaataatacaaagccactgaaaaggtcttgaagactatgtgtcatgctatgatttgtttttaaaagatggtgctagctactactgtgtgaagaatgcacagtatgagtacaagtggga

SEQ ID NO: 169823 - DNA, 601 bp, Human; identical to SEQ ID NO: 28452

SEQ ID NO: 169824 - DNA, 601 bp, Human; identical to SEQ ID NO: 28453

SEQ ID NO: 169825 - DNA, 601 bp, Human; identical to SEQ ID NO: 28454

SEQ ID NO: 169826 - DNA, 601 bp, Human; identical to SEQ ID NO: 28455

SEQ ID NO: 169827 - DNA, 601 bp, Human; identical to SEQ ID NO: 28456

SEQ ID NO: 169828 - DNA, 601 bp, Human; identical to SEQ ID NO: 28457

SEQ ID NO: 169829 - DNA, 601 bp, Human
ccacgactcagcaggcaaatcctagaaacatactcgcacatgtgcacaaagacacataaaaggatattcctagtagccttgtttttaagagtaaaagctgagaataaatctaaatgttcaaaaaacagaaatggcttaataactggacttttatgtaacagttaaaagaaataagctatttctataagcagatctgagggaaactaggacttgcccagtgctgtgccagcagaaatggggccaaaaaactgccccagaagtcctagctagcaaaaagcaaaaattcgaaagagaagccatkttcttctcacagccaatcttcacagcaacggctctagaaatgagaaagatgtcggatcaaactacttctgccacttactaactgggtccctagcaagttatttaaccttctgagactgcttcttcaaatgcgaaatgtagattgataatctcccctcagaggagggaaggcctggctcatcacaggcactcactatgatagcctgaggccctaagggttaggcgccataagcctctaagctctgccagtccccactcctcagtctcctcactctatgacaggccacaactcttctggctc

SEQ ID NO: 169830 - DNA, 601 bp, Human
tcaatgtaaaatcaaaagctttaaccatggccctacctgatcttactccgaaactgaactttttcatcagtcttttaagtttcatcatttccttgaagttttctggtaaatttccttcttaagaatacttactttggtttgacaatgaaagagcctggaaactggtacaggcactctgactagtgttcataacccacgactcagcaggcaaatcctagaaacatactcgcacatgtgcacaaagacacataaaaggatattcctagtagccttgtttttaagagtaaaagctgagaataawtctaaatgttcaaaaaacagaaatggcttaataactggacttttatgtaacagttaaaagaaataagctatttctataagcagatctgagggaaactaggacttgcccagtgctgtgccagcagaaatggggccaaaaaactgccccagaagtcctagctagcaaaaagcaaaaattcgaaagagaagccattttcttctcacagccaatcttcacagcaacggctctagaaatgagaaagatgtcggatcaaactacttctgccacttactaactgggtccctagcaagttatttaacc

SEQ ID NO: 169831 - DNA, 601 bp, Human
acagggcatgagccaggcacggtggctcatgcctgtaaccccagcactctgggaggccgaggcaggtgaatcatgaggtcaggaaatcaagaccatcctggacaacatggtgaaaccccatctctactaaaaatacaaaaattagctgggtgtggtgatgcatgcctgtaattccagctattcaggaggctgaggcacgagaatcgcttgaacccaggaggctgaggttgcagtgagctgagatcacgccactgcactccagcctggcgacagagactctctctcaaaaaaaaaaaaaaaaggcttctgttttctaactgcttcaaagtctacccacttctctcactcactcagaagaactttcctgagcacccactatgtgccaggaactgtgtctacaaagataagcactgaccactgtatccccaggagacgctgagtaaacacccaacctgctccctcccattcttccccatctccaaaaatggccaaacctgggaattttcctcgactcctctctttctttcagccccacatctaaccctttaggaaatcctgtcagcgctaccatgcaaacacacccagaatccaaccactttgc

SEQ ID NO: 169832 - DNA, 601 bp, Human
ggcaaaaggattacttgaggccaggagttcgagaccacctgggcaacatagtgagaccccatctctacaaaaacaattttttttttgagatggtgtctcactctgtagcccaagctggaatgcagtggcgcaatgtcacctcactacaaccaccaactacctgggctcaagcgattctcatgtctcagcctcccgattttgtttttgagacagggtctcactgttgcctgtgttgaagtgcagtggtgtgatttcagctcactgcagcctcgacttactcaggtgatcctcccaccccagscttccgagtagctgggactacaggcacacgtcaccacacccagctaatttttgtattttttgtagagacacagtttcaccatgttccccaggctggtctcgaactcctgggctcaaacaatctgcctgcctttgcctcctaaagtgctgagattacaggcaccaccatgagccaccaggcctggcctctctggaaattttttttttttatttttttttttttttttgagacagagtctctctgttacccagggctgaagtgcaatggcataatcgccactcactgtaacctccacctccc

SEQ ID NO: 169833 - DNA, 601 bp, Human
acctccgttctgatatggaaatattccaatggcactaagaaacactacctatagtgtcaggtacgctctgtaacttctcacttttaaatgtggtcattatcttatcattgggctgtttgccttctctaccccagaaacccagtcaggacaaagactctcagatattaaagttaaggaaaagttttactctaccttcattctatctgatagcctataaatggaagttttggaatagccccaaaagagaggacccatttcatttgtgctttaccaaattcttagttcctgaacattaatcttrgacaaaaattctccaaacaacacgaatatatcagaacattgtggtaaactgggaaaatcctgtacttttaaagtgaactttgattttttaaaatcaaaccttttatatcccacagcgataaattccttcaaatggaatgcttacttatatttactgctagatgaatgtggcatgaaattcctcaaggaggggaagaaagacattcccgtctctcactagcccccacatttgtttagaagttgctctgtgctgacaagctggcaggggacgtgggtgacggacaatgaaaccggctgttag

SEQ ID NO: 169834 - DNA, 601 bp, Human
agctaccattcccagctgctctacagtttttctaaggccataacaacaaaaccaatttccaaagcaccttacattagaatattgcaaataaaggtaaatttctctctgaattctaaacatcatccacattagctctttaataaacgtttgttcattatccaagaatcattgttaaattaacttttagaacgtgatctctatgttcattacatgcttttgcatataacggttctgcttcctgaaccactctttttagcttaggcaactcctcctagcagactcagtttaaaacgtatccccycccccttcacacattcttcttcctcatcctccaaattgtccccatggtgacctgtgtttccactggcacagcagcagcccacggcaatgccataacttgcagaccttgcctacccctctgcagattgcccacacctgagctgagggcacagcacataggcaggtagagtgaatggatgaatgaatgaagtcactaagagtgaaggggttgtcattaggcacatcatctactaataatacccaagaaacgaacctgcagatacatttacatgttctatatggtaatggcctgagaactcta

SEQ ID NO: 169835 - DNA, 601 bp, Human
acttggctcacagcaagctccgcctcccaggttcaagtgattctcctgcctcagcctcccaagtagctgggattacaggcgtgcaccaccacatctggctaatttttggggtttttttgtacttttagtagagataggtttcaccatgttggccagactggtcttgaactcctgacctcaggtgatccacccaccttggcctcccaaagtgctgggattacaggtgtgagctaccattcccagctgctctacagtttttctaaggccataacaacaaaaccaatttccaaagcaccttacrttagaatattgcaaataaaggtaaatttctctctgaattctaaacatcatccacattagctctttaataaacgtttgttcattatccaagaatcattgttaaattaacttttagaacgtgatctctatgttcattacatgcttttgcatataacggttctgcttcctgaaccactctttttagcttaggcaactcctcctagcagactcagtttaaaacgtatccccccccccttcacacattcttcttcctcatcctccaaattgtccccatggtgacctgtgtttccactggcacagc

SEQ ID NO: 169836 - DNA, 601 bp, Human
gctctgtgacttcaccttcataaacttccttggtctcctttattcgcagccctggaagaggtggcagaggggccatggtgagaagcagaatcttttctctcacactgagagcccaaaacttccatgtcaccagaactgccaaatcaaccttaataatgtacattccagggtgtcatgatgggtaaaaaggcaatacaaacatatcaatgtaaattagaggcactattagaaatgcaactttttttttttttttttttgagatagagtctcgctctgttgcccaggctggagtgcagtggcrcgatctcgactcactgcaacctctgcctccccggttcactccattctcctgcctcagcctccagcctcccgagtagctgggactacaggcgcccgccaccacgcccggctaatttttttgtatttttggtagggacagggtttcaccatgttagccaggatggtcttgatctcctgacctcatgatctaccctcctcggcctcccaaagtgctgggttataggtgtgagccaccacacccggcctagaaatgcaactttttaagggaactttctaggttcaaatccagaactagatagac

SEQ ID NO: 169837 - DNA, 601 bp, Human; identical to SEQ ID NO: 28458

SEQ ID NO: 169838 - DNA, 601 bp, Human; identical to SEQ ID NO: 28459

SEQ ID NO: 169839 - DNA, 601 bp, Human; identical to SEQ ID NO: 28460

SEQ ID NO: 169840 - DNA, 601 bp, Human; identical to SEQ ID NO: 28461

SEQ ID NO: 169841 - DNA, 601 bp, Human; identical to SEQ ID NO: 28462

SEQ ID NO: 169842 - DNA, 601 bp, Human; identical to SEQ ID NO: 28463

SEQ ID NO: 169843 - DNA, 601 bp, Human; identical to SEQ ID NO: 28464

SEQ ID NO: 169844 - DNA, 601 bp, Human; identical to SEQ ID NO: 28465

SEQ ID NO: 169845 - DNA, 601 bp, Human; identical to SEQ ID NO: 28466

SEQ ID NO: 169846 - DNA, 601 bp, Human; identical to SEQ ID NO: 28467

SEQ ID NO: 169847 - DNA, 601 bp, Human; identical to SEQ ID NO: 28468

SEQ ID NO: 169848 - DNA, 601 bp, Human; identical to SEQ ID NO: 28469

SEQ ID NO: 169849 - DNA, 601 bp, Human; identical to SEQ ID NO: 28470

SEQ ID NO: 169850 - DNA, 601 bp, Human; identical to SEQ ID NO: 28471

SEQ ID NO: 169851 - DNA, 601 bp, Human; identical to SEQ ID NO: 28472

SEQ ID NO: 169852 - DNA, 601 bp, Human; identical to SEQ ID NO: 28473

SEQ ID NO: 169853 - DNA, 601 bp, Human; identical to SEQ ID NO: 28474

SEQ ID NO: 169854 - DNA, 601 bp, Human; identical to SEQ ID NO: 28475

SEQ ID NO: 169855 - DNA, 601 bp, Human; identical to SEQ ID NO: 28476

SEQ ID NO: 169856 - DNA, 601 bp, Human; identical to SEQ ID NO: 28477

SEQ ID NO: 169857 - DNA, 601 bp, Human; identical to SEQ ID NO: 28478

SEQ ID NO: 169858 - DNA, 601 bp, Human; identical to SEQ ID NO: 28479

SEQ ID NO: 169859 - DNA, 601 bp, Human; identical to SEQ ID NO: 28480

SEQ ID NO: 169860 - DNA, 601 bp, Human; identical to SEQ ID NO: 28481

SEQ ID NO: 169861 - DNA, 601 bp, Human; identical to SEQ ID NO: 28482

SEQ ID NO: 169862 - DNA, 601 bp, Human; identical to SEQ ID NO: 28483

SEQ ID NO: 169863 - DNA, 601 bp, Human; identical to SEQ ID NO: 28484

SEQ ID NO: 169864 - DNA, 601 bp, Human
gaaagatttcagagtgcatttcgaaacttctagaattgtctcacacaaataacttcctctggctttctttaccctccctttgattaccagaagctgaaagaaaggaattaacttctttctggctcaaagacatctggaaaacatatgacctccgtcaatatctctaacaccaggtcccatgattcaaactacacacaatcagtaagaaaaggaattcaacatgtgtgctatcggctcacttcctttcttgtgtttatttcagagcaataaatcaagtgttttctaagttcctactcccaarctcctagtcagaaaaggactcacctgccatagggaacagcctctgtccttttttacagcgttggaaagagcctcagagtcaaaaatgaaagtaaactatgtatttccttattgcaaagggcggaaacgtgtaattacagattgtgaaactgctgctcagaattccagactcattatcaggaagtgccttgtcatcagcaaattggcatccaattactggaatttagtttctgacttgggggaaaaaaatgaaaatgacaaaatattatcctgtgggttgacacctcagcttgtttctttt

SEQ ID NO: 169865 - DNA, 601 bp, Human
aacagagttccatcaaagccaatttaaacaaaaaacagcctaaataaaaaataattattcttgttgcacttcatgcaaataatcaggccaagtacagtaagactaaagcttattttggtaaacagattagttctattataatttacttttaataaaaatagggtctggagagaaaaattatgcttcaaaagaaaacatataatatacccattgttagttttgtttgagttttttcctacagtttggactaaatcctaaattctttgtggattagaagtccccaaattaatgctttccaatytttgcttttaaaattgagaattgtactcctcatcctaggatttgttatttaccttacaggaggctgttggcttaaatattatagcaaaactacagaggagagtactaatgtttttgcattgcaagcattggaagcccagccagtcctgcatgagtatgctcagacagttgcaaagtggttacattcttctcaccttggggttcactctaatttccactatgtctcctgtcagcaggaagaagccagagtgatcgacagccttttcccatcttcatagcctacaccttaagattaagctat

SEQ ID NO: 169866 - DNA, 601 bp, Human
tgggaaaaacaaacaacaagaaacaaacaaaaaaccctctgttttcttcatgacaaccaaggaattaaaagtagatggatcactctcaaaatcaaaggctctgttctgttttgcattgtgttatctgacagtttgaattttggggatatcagaaattactttgcattatgagatagctttggtatgtaataactaggtaggaaatatactttaagggatggctaatagtattttcagagggaaacttggctcttcgcacacttgggtcagagaagcatgctctgggccacctggaagatayggaaacatccccatgcctgactgagagatgagacttccatgggggatgggctgatttcaaaatgggttgattggctttaggttgccttgcaataaaatgcaggttagaagcactgcactctcttctccagtagtatttccttccttttggggatctgggatccagtataaaatggcatccttcattttggagatctgtctttgccttcagctgtgcctgcttatttagcttggaaaaaaaatgcatgctttcctggccctgttcctccaagggctccactctgaagccagtagtccagtt

SEQ ID NO: 169867 - DNA, 601 bp, Human
accccattttgggaaaaacaaacaacaagaaacaaacaaaaaaccctctgttttcttcatgacaaccaaggaattaaaagtagatggatcactctcaaaatcaaaggctctgttctgttttgcattgtgttatctgacagtttgaattttggggatatcagaaattactttgcattatgagatagctttggtatgtaataactaggtaggaaatatactttaagggatggctaatagtattttcagagggaaacttggctcttcgcacacttgggtcagagaagcatgctctgggccaccwggaagatacggaaacatccccatgcctgactgagagatgagacttccatgggggatgggctgatttcaaaatgggttgattggctttaggttgccttgcaataaaatgcaggttagaagcactgcactctcttctccagtagtatttccttccttttggggatctgggatccagtataaaatggcatccttcattttggagatctgtctttgccttcagctgtgcctgcttatttagcttggaaaaaaaatgcatgctttcctggccctgttcctccaagggctccactctgaagccagt

SEQ ID NO: 169868 - DNA, 601 bp, Human
agtatcctaggtgctgccaatgcctccttccttctcctgactggttctgtggccccatagtggggtgtctgtctgtagccccattgcagggtgttaggattggtgaatctactaggcactgctaatgcctccttccttctctcgacttgtctgtagctctatgatggggtgtctgtagccccattgcagggtgtctgtagccccattgcagggtgtctgtttgtagctccaccacggggtatctgttcggctccactggggtcttggttggctctaactagtaggaagagtcttggttcasgagacttgtcctcaatcaggacaattttgagatttctcagacagagaataggaggatagtttggaagggatactcttggagttcctgtttagggatcatctgatttggaaggccttctgtctgtctcatcttcgtgtgtgtttgtatatgtggagggaatctcagaaggaattgctgaaggaagtccagcaggcctaactcagaggactcttcttatttggttacattcgatgagccctggagaaagttcaataggcctgtctcatggtgactatctgctctttgccttacccagagacc

SEQ ID NO: 169869 - DNA, 601 bp, Human
cactgttagaatttatgctctgtgaggacaggggccatgaactacatctgcactatttttggcattctttttactagttatttactgaatatttactaattatttactgaatcagtagtcaagtccatgtaggaacaaatgaataaaacttatgtgtggctcaactcttaaggaatatgaaaccacctttgcaaaattataactgaggaaattacaacaatgaacgaaatcagactgggaaagcctttgtggctacctgcttgtggtttggtgcccccgctccagcgatggatccagaagstagcccaagtagccgcctagttctcttggactgggggctggctctggtactctctccactggcaggcactgccaacccaatgtgcatgcatttaattgcaacggagaaataatcctggagagatgtcctctaactgtggccctatcacagggtttccgtctgtagctgcattgaagggtgtctggattggtgagtatcctaggtgctgccaatgcctccttccttctcctgactggttctgtggccccatagtggggtgtctgtctgtagccccattgcagggtgttaggattggtgaat

SEQ ID NO: 169870 - DNA, 601 bp, Human
ctattctaatctaggccttctcattcactcattttctgatactgttcccaccttgctcattacattcaaaacgttctgccttcatttaatttctagaaagattctatttaggggtctctgtatttccagcccctaccttctcattcattcttgttttcctactgctgtctgtctaaccttcaagtctcagattagatggcacctttctcagggaatcaagtctctacttagggatctgtatagtttcagcacccccgcttctaatttcttctggtttttgaactgttctctgtctatctgkctatctgtctatccttcaagtatcagattagatggtattttcttaagggaatcctctctgattcttccagaggagacagcatcagagatatatgctcctagggcaccttgtatctccttagagtagcattttttttccatttatttatttatgtatttatatatttttgtgagacagagtctcactctgtcacccaggctgaagtgcagtggtgctatcttggctcactgcaatctctgcctcccggattcaagcgattctcctgcctcagccttctgagtagctaggactacaggtgca

SEQ ID NO: 169871 - DNA, 601 bp, Human
ctgatggcatccattatatgcttaaaagaataaataaatcattctcaaatttatggattcagcccagatgtggatgtcggtattgaaacctatacattcaatagacaatgagatatctcaactacatctcacaacctcatttaactcaacttacaaagatgaactgttcattttttcatttccatccttcattctcttttccatatactagtaaataatacctatactccaagtacaaaagagcagcaatacctggtgatattcaacctctttggccttctctatgtcttatttcccttcwtaattcacattgcatcgattttatttgctaaacattttcagaatctgaccacttctctcaattctaattgttcattacttctattcgggccaacatcctttctttcttaagaaataaattcataagaactttatcaatctactctccgtccctctattctactctttgcaacgaagagtgttccaatatctagatttgaccatgaaaactttcagcctattctaatctaggccttctcattcactcattttctgatactgttcccaccttgctcattacattcaaaacgttctgccttca

SEQ ID NO: 169872 - DNA, 601 bp, Human
agattatagtgagctataattgtgacactatactccagtcttggctacagaatgagatcctgtctcaaaaatatcagcaataataacaaatctcaaaactataaaatattgatagggaaaactgaagaagacaaaaataagtagaaatgtattttgagttgatggactggaaaattactattattaaaatgtccctaatacccaaagaaatctaaagatacaatgcaattcctatcaaaattctaatggcagcttttacaaaaatagaaacaaatcctaaaatttatatggaatcacacamaaaaaaacaaaccctgaataggcaaagcaattttgagtaaagggaacaaagctgcaggcatcgcactatctgagttcaaaatagactacaaagtactacagtcatcaaaatagcacaatagttgcataaaaatagaaacagagagcaaatgaacaggacagaaaacccagaaataaacccaattatttacattaatttgacttttcaacaaaggtttcatgaacacacaactgggaaagaacaaattcttcaataaatgatattgggaaaattgtaaaaccacatgcagaagaataaaaa

SEQ ID NO: 169873 - DNA, 601 bp, Human
ataaataaatttccatttaaaattgctgcaaaaatacttagaaatcaatttaaccgagtaggtaaaaaacaagtacacgtaaaagtataaaacttcaacccaatcaacatggtgagactatgtctctacaagaaatttaaaaagttggctggccatagtagcatgtgtctatagtccttgcttcttggaagtctgaggtaggaggattgcttaagcccaggaatttgagattatagtgagctataattgtgacactatactccagtcttggctacagaatgagatcctgtctcaaaaatawcagcaataataacaaatctcaaaactataaaatattgatagggaaaactgaagaagacaaaaataagtagaaatgtattttgagttgatggactggaaaattactattattaaaatgtccctaatacccaaagaaatctaaagatacaatgcaattcctatcaaaattctaatggcagcttttacaaaaatagaaacaaatcctaaaatttatatggaatcacacacaaaaaaacaaaccctgaataggcaaagcaattttgagtaaagggaacaaagctgcaggcatcgcactatctga

SEQ ID NO: 169874 - DNA, 601 bp, Human
aaaaggcatcaaaattggaaaggaagaagtttaattgtgcctgtttaaagatgaaatggtcttatatacggaaaaccctaaaggatccaccaaaaatcttttagaacaaataaacagattcaagaaaattgcaggataaaaaaaatcaacatacaaaaatctgtagtgtttctgtataacaataaaccatctttaaaaaataaataaatttccatttaaaattgctgcaaaaatacttagaaatcaatttaaccgagtaggtaaaaaacaagtacacgtaaaagtataaaacttcaacccratcaacatggtgagactatgtctctacaagaaatttaaaaagttggctggccatagtagcatgtgtctatagtccttgcttcttggaagtctgaggtaggaggattgcttaagcccaggaatttgagattatagtgagctataattgtgacactatactccagtcttggctacagaatgagatcctgtctcaaaaatatcagcaataataacaaatctcaaaactataaaatattgatagggaaaactgaagaagacaaaaataagtagaaatgtattttgagttgatggactggaaaat

SEQ ID NO: 169875 - DNA, 601 bp, Human
atatttataattctttcaaatcttgttctcaatgaaaatttaaaattgaaagtaacctgattcctaatcttccagtgtggtggattagtttaatttgacaccatgttaatgtattactccttagagtaatttgaatatttataaggaaatatagataccaaagtaatacatcctttgtttcaatacaacagatatgatttcggcagattgtacacagaaatgctggatatcttatcaattctcaatcaatgctacaaagataattatacaatccatgtaggtgtaaggatagtgctgacasaaaatgacatctaaagaaatcatgtcaggacattgcacaaaagctttggcacagaagcaccagcctcattgtctgggttatcttgaattaatattttcatacgtgcttattgggcagctattatgagaaaaacattagacattacaaaccaggaaaaaagttacataatataaattaacttagtaaagggtaatatctcccatgtacttattataaataaaaaatgaatgcatataaaacaatttaaatcattattataatcatcattatcatttacatatcactgtaccaaaggtttta

SEQ ID NO: 169876 - DNA, 601 bp, Human
ataaatggatgagtgcatccatatttataattctttcaaatcttgttctcaatgaaaatttaaaattgaaagtaacctgattcctaatcttccagtgtggtggattagtttaatttgacaccatgttaatgtattactccttagagtaatttgaatatttataaggaaatatagataccaaagtaatacatcctttgtttcaatacaacagatatgatttcggcagattgtacacagaaatgctggatatcttatcaattctcaatcaatgctacaaagataattatacaatccatgtagrtgtaaggatagtgctgacacaaaatgacatctaaagaaatcatgtcaggacattgcacaaaagctttggcacagaagcaccagcctcattgtctgggttatcttgaattaatattttcatacgtgcttattgggcagctattatgagaaaaacattagacattacaaaccaggaaaaaagttacataatataaattaacttagtaaagggtaatatctcccatgtacttattataaataaaaaatgaatgcatataaaacaatttaaatcattattataatcatcattatcatttacata

SEQ ID NO: 169877 - DNA, 601 bp, Human
cctaatgcaaacttcctggtcatccactgtattcatttttctcttttactggttcacggcccatagtgataatgatctgcctaaaatatatattcccgggaaagtcaatgctcttgtctagaatataaattcttcctactagatttttacttcctatatgatttttactcttttctgtatttagttttcttggtgaaagaactatatctttgaatttgcatttttttaacttacatcctatacccacatctttgtattcaaaatgtttaaaagtacttaatatgcttgctaaatacataatgaataaatggatgagtgcatccatatttataattctttcaaatcttgttctcaatgaaaatttaaaattgaaagtaacctgattcctaatcttccagtgtggtggattagtttaatttgacaccatgttaatgtattactccttagagtaatttgaatatttataaggaaatatagataccaaagtaatacatcctttgtttcaatacaacagatatgatttcggcagattgtacacagaaatgctggatatcttatcaattctcaatcaatgctacaaagataattatacaatccatgt

SEQ ID NO: 169878 - DNA, 601 bp, Human
gagcagaaagcaatgaagtccttctccacgtgggtcttgtaaacagcatcttcctccaggttctcagatgactgtgaagaggccacttccaaggatgctggagagtctctgacccacagttccccacggtttgctatggagacattaactttctgcacactgctgtgcctcccacagaatggctgtcacagttgcccaccttgttctttttgaatgttcattcttactagtttcatacatacagacccacacacatacaaacacacacagagaaacagacacacacacacacacacacaccccacttttctttctctccagtgtcattcaacaatgtgcctactgatagtgaaatcatcttgaatttaccattttctagaaaaaaaatctgttttcttttgaaaaatagctcccaagagctatcagacaattggtctcaaattcctggcctcaagccatcctcctgtcttggcctcccaaagtgttgggattataggcatgagccaccatcctcagccagccatgaggcaattgaatctttggagcaaagtggcactgcaacattctacagtcccctgatctctttactaatttccccctc

SEQ ID NO: 169879 - DNA, 601 bp, Human
atgtttttaaaaagaaaagcatagcttgggaattatctttacagatttgtaggaagcacttacaacctgacatttacctactttccacagaacgtaaacagaaaacctagcaaaaggtgatcaaaagttgcagttggtaagcattgcaagagattgtgtattgaagaaattttgattcttgggattggctttctactacaaaactcatgttcattctctcagcttttataggggcttgagaaataactagaattatcccactttacagaggaagaaatagaagcacagaaagatgaaggarcttccccatgttcacacagtgagtaagcaacaaaaaattgccaccaggctccaaagttgtttgcagattatgccacactgtctttcaccgtataatagaaatagatgaacacatgacaagtttcagtgatagaagctgaaaaaagtgataaaaatctattgtacaggatggtgccagtagtaaccaacattgtgttatgtacttgaaatttgttaagagagtagattttatgctaagtatacttctcacacgcagtcacggaatgatgataataataaacagagaagtgtaagaatcttt

SEQ ID NO: 169880 - DNA, 601 bp, Human
atgtacgagctatggagaaaaataacataggaagtagtgggaataaggaatgtcccaagttgggcaagaagtagcaaacctttccttctgcacttttttattgaaagaatgacttcttttttgttccctctcacatgtctttatggatcctatcacaatctgtaagcacatatttgtttgttaacccacattttcagtatccatatctcccacgaaaatgtgagtcctagataggattacgtcatgtaggcctcatttacccctctgtcaccaggaggaaatccatgacctagcagaccayccagattttattcatttaataaattaagaaataaaaattatttcaaaatatttttccttctctaaaacttaagaacttacgctccataacataaagcttatggttgatattattttattttactttgatcttctgctgggatatattggaattgtcttttccttagccatattttaaacaactgaatgacagaaactgggtacctctctactttcacttccctgacaaaaattgtcattgtgaagtaaaaagtgaatcatgacaaattcttcctgaagaaataaatgagtaactagaaaa

SEQ ID NO: 169881 - DNA, 601 bp, Human
atactttaaagaagtgagttgcctgattataggtaatggtagagctgattcccactagcccattggacaccaagggctggtaggaagtagatgaggaaaatagacttctaaagctatcattaagagataacagaccacttcgggaggccgaggcaggtggatcacaagttcaggagatcgaggtcatcctggctaacacggtgaaaccctgtctctactaaaaatacaaaaaaattagccggacgtggtggcgggcacctgtagtcccagctacttgggaggctgaggcaggagaatggcrtgaacacgggaggcggagctgcagagagctgagatggcaccactgcactccagcccgggcaacagagcgagaccctgcctcaaaaaaaaaataaaaaataacagactaagataacaagagaaaattctttatgcaaatgtttgccattcaaaaccattctgccttacccttgaaactaagaatggtgaaagtagaaggtggagatctctgaattctattttaatgttagaccactgtataattattaatattattccataatacaagtgcaggcccttgaaagtaggtatcccgtgtttt

SEQ ID NO: 169882 - DNA, 601 bp, Human
caagagaaaattctttatgcaaatgtttgccattcaaaaccattctgccttacccttgaaactaagaatggtgaaagtagaaggtggagatctctgaattctattttaatgttagaccactgtataattattaatattattccataatacaagtgcaggcccttgaaagtaggtatcccgtgttttgctttttaaacattctccccttccccaacatgtagcatctgctacaaagcctgtcagagtattgttcattcatcagatattttcagaacatctgccacattccaggcactgttgrgcactagggatacagcagaaaacaggtcagacaaggtccttattctcataaatgtattctagtggaaaggatggaaaacaagcaaataaggatttcagagagtgagtaatgcactgaagaaaatacagcagggtaatgatagcagggtatgatgaaaatgaagccatattagatggtctgattggaggagtccccagtagcaggggacatttgaactgagccttgaacgataaagagataaccatgaaaagaactggggaaaggacattccagccagcagagagcaaatgaaaaagctct

SEQ ID NO: 169883 - DNA, 601 bp, Human
cacggccaagaaaattcttctttccctcagttcagctaggtcccatagcaattttctgccctgagttccttatggtcttgctttttgtgtctggtttctgctcacagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcckgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagag

SEQ ID NO: 169884 - DNA, 601 bp, Human
cctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttacccacatttcttgtgttgttgttttgtgacgactttatttcttggtttctgttattttacctggggtgggaggtggggggtaattcccgtatgaaatgtgtygtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggtgagaagtcctggtgctggtaccgacctgctgtccctgcagctctcctgtgcgcctgtacctttcccttcctcccaac

SEQ ID NO: 169885 - DNA, 601 bp, Human
tgttacccacatttcttgtgttgttgttttgtgacgactttatttcttggtttctgttattttacctggggtgggaggtggggggtaattcccgtatgaaatgtgtcgtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgttyctggtcgcgcggaccgggagctacccggtgagaagtcctggtgctggtaccgacctgctgtccctgcagctctcctgtgcgcctgtacctttcccttcctcccaacctcgtttgactccatctcaccttccccgacagcattgcctctgcccagtccagccccggtgcacccccctttgcacactgtccgctccctaaggtcgcttccctgcccgtgtacccttcaccctctggagtttgctgcttcctgctcctcatccctttcttatctcatctaggctgggtctcttctgcgtcagt

SEQ ID NO: 169886 - DNA, 601 bp, Human
cgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggtgagaagtcctggtgctggtaccgacctgctgtccctgcagctctcctgtgcgcctgtacctttcccttcctcccaacctcgtttgactccatctcaccttccccgacagcattgcctctgcccagtccagccccggtgcacccccctttgcacrctgtccgctccctaaggtcgcttccctgcccgtgtacccttcaccctctggagtttgctgcttcctgctcctcatccctttcttatctcatctaggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggtgtgtgtgtggaggggtgcagggcggagta

SEQ ID NO: 169887 - DNA, 601 bp, Human
ctgcggcggaaaacaggctactcctttgtaaattgcaagaaagctctggagacttgtggcggggacctcaaacaggtgtgtgtgtggaggggtgcagggcggagtactagagctcgacctcagactcttggggcggtcacgctggggagcataaagttagactgctcttcagtgaccataatggcacagtcctaagtggaaatctggcttaaatgacaaccttggccttgactttgtcttatttgaaagcagttgagtatcccaggattaacaaaccagactgttacggtgtttcttgttrcctggagctgaaagggtttgtgtgagctttggagtcagattgttcaggagtcaaattgtggggcccccacactgtctgactttagactttttttttttttttcagacggagtcttgctctgtggcccaggccggcgtgcaatggcacgatgttggctcactgcaacctccgcctcccgggttcaagcgattctcctgcctcagcctcctgagtagttgggattacaggcgtgcgccacgacacccggctattttattttttattttttatttttttttgtatttttagtagagatggggt

SEQ ID NO: 169888 - DNA, 601 bp, Human
cccgcctcggcttcccagagtggtgggattacaggagtgagccaccgcgcccggctgactttagacatcttaatctttcagagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttrtaacacagtggtaagtattgtgtatctaaacatagaaaaagtacagtaaataggcataaaagataaaaaacgatacatctccatagggaacttatcatgtatggagcttgcaggactggaagttgctctgggtgagtcagtgagtggtgagtgaatatgaaggcctgccttaggacactatggtgcactatagtagacgttaaagcacagtacacataagctacattacatttataagaaatttttttctgtgataataagttaaccttagtttaatgtaacatttttattttataaact

SEQ ID NO: 169889 - DNA, 601 bp, Human
cctgggctatatggaattgccagctgctcctaggctacaaaccgttacaaaatgttactggactgaatactgtaggcagttgtaacacagtggtaagtattgtgtatctaaacatagaaaaagtacagtaaataggcataaaagataaaaaacgatacatctccatagggaacttatcatgtatggagcttgcaggactggaagttgctctgggtgagtcagtgagtggtgagtgaatatgaaggcctgccttaggacactatggtgcactatagtagacgttaaagcacagtacacatargctacattacatttataagaaatttttttctgtgataataagttaaccttagtttaatgtaacatttttattttataaacttttaacatgttttaaatttttggactcttttgtaataacagcataaaacacatattgtacagctgtaccaaaatatttttctttatgcactttttctgtgagcttttttctgtttttaaaattttaaactttttttggctgggcgtggtggctcatgcctgtaatctcagaactttgggaggctgaggcaagcggatcacctgaggttgcgagttcgag

SEQ ID NO: 169890 - DNA, 601 bp, Human
ctgttggctataggaaccacatctggatcattgtggtgggactagcatcttgctttcttcctaagtatccttgatggagggtgggtggtagggaagggttggagcttgctgggaatttactaatctgaagtttccagtcaaggcatcagttccgtttttatcaggtcatcttgtattatctatgatgtttcaatgagtcatgggtgagaaaccaggcagacagctatgtatgaggcttattaagaaattctggaagagctgggtgtttcagccttgtcagtttctgggaattaactattgrgtatatgctttgagctattttaaaatttgttttggtttctggattctcctttttcatgacttttagatatgactatggctaatccaggcatacttatacagacccttttgtttattctcctacccctttctaccttttggcttatttggacttctgttagaagagaataacatcctgagagaaaggggaaaaataagttaaaatctgtttctggttctcataaataactcttgacaatgttatcttttctgtttttgatgagaggaaattgaaactatccgatgacatggtgctttgagc

SEQ ID NO: 169891 - DNA, 601 bp, Human
gagccactgcacctggcctcttttttttttggtttttttttttttttttgagacagggtcttgctctgttgcccaggctggagtgcaatggcatgatcataactcactgcaacctcaaactcttgggctgaagcgatcctcctgcgtcagccactagaggcactgggattataggcatgggccacaacatccagctaggagttttaagagcctctatagaaatagatttaggtggccgggcatggcagctcatgccctggcataagagtgaggcctagtgacagagtgagactccgtctcaaaaaaaaaaaacaaaaagaaatagatttaggcaggctgggtgtggtggctcatgcctgtaatcccagcaccttgggaggccgaggcaggcggatcacctcaggtggagaccagcctgaccaatatgatgaaaccccgtctctactaaaaatacaaaaattggccggtgtggtggcatgtacctgtaatcccagctacctgggaggctgagacaggagaaacgcttgaacccaggaggcggaggttgtggtggggcccagtgacaccgcccgcctcagcctcccaaagtgctgggattaca

SEQ ID NO: 169892 - DNA, 601 bp, Human
catttaagggacaattgaatagaattttaaaatcagagaggaggagccatgtttgtattgttcacttttgcattcctggcacctagcaccttagcataggatcactgttgggtaaatatttattgaataatgaatggttgccatttacgaaaccatgtttacagttttgtgctccagaagtgaggtaaagggttgcttaatgagaacccagtatttctactcaaaaggaccttattgcaaagtatttggaagtttaaaagagtgggaacatggggacgcatagggagtggtgaaactggcycagggaaagtccattgcagcaagatagaggttgccaaaccgtaagcagaacaagttgaaaccgcgcctgtctggcaaacagtccaaagtggaattgaaactcccatctttgaagtggtgaaaaaaggccctggggtgggggagtggggcagagggctggcgtctgtctgcctgggttagtcttggttcgggagtgtcccgagcaagcctggggagatgactgcccctcgccttgatccccaactaacctggggttctggattatgtgtggggaagagggaatgtgtgtggcattccgtgt

SEQ ID NO: 169893 - DNA, 601 bp, Human
aaatcgagaccatcctggctaacacggtgaaaccccatctctactaaaaatatatatatataaaaaattagctgggcttggtggcaggcgcctatagtcccagctactcaggaggctgaggcaggagaatggtgtgaacctgggaggtggagcttgcagtgagctgagatcgcgccactgcactccagcctgggcaacagagcgagactctgtctcagaaaaaaaaataaaaaataaaaaaattaaaacttagatgggcgtcttggcaggcatgctacttgggagtctgaggcaggagaaycgcttgaacctgggaggcggaggttgcagtgagctgagatcgcgccactgcactccagcctgggagacaagagcgagacttcgtctcaaaaaaaagaaaaaaaaaaagaaaacagtcggtatccttcacaacaggtgcacacagccagggcaatcacgcctccccggggacactgggcaatgtccagagacatttttggcagcctcgactgcgaggggaagggtactactggcatctagtggatagaggtcagagatgctgctcaacatcgtacaatgcccaggacagtcccacaacaaa

SEQ ID NO: 169894 - DNA, 601 bp, Human
cgactgcgaggggaagggtactactggcatctagtggatagaggtcagagatgctgctcaacatcgtacaatgcccaggacagtcccacaacaaagaattctccagccccagatgtcagcagtgccaaggctgaaaaactccctctgcaaggacaccccagagagagcagcctggtacatctcagttggggccacatgctttcctgaattttggcattctgcttttgtgctgatgaaataacttctggggcttgcaaaacacatgtcatgtagactgtgtttgtatagatctgggggaggraagctgcaatgcctgggcttgcatagattggcaaccccctagctagctttcttccagggtcacaaacccatgttcaaacccaggtcactagccaggtgctaatggctcgagcctgtaatcccagcactttgggaggccaaggcaggaggatcacttgagctcaggagtttgagagcagcctgggcaatatagggagacccacatctctacaaaaaatttaaaaacattagccaggcatggtgacatgtgcctgtagtctcagctactcaggaggctaaggtgggaggatcacttgagccc

SEQ ID NO: 169895 - DNA, 601 bp, Human
ttgttctaaaggagttctgagaagggtctcaggggtccctaaacagggaggtgtgtttgtggagcccccatcaccatgtgaaccagagtggctccctcttagcttttttccacattggacttcactgcaagatcccctttgaagaattaaaaatattgctctaggccaggcttggtggctcacgcctgcaatcccagcactttgggtggccaaagcaggagggttgcttgagttcaggagtttgagaccagcctgagcaacatagcaagaccccatctctacaaaaaattaaaaatcagcygggtggcatgcacctgtagtcccaactacttgggaggttaaggcaggaggatcacttgagcccaggagtttgaggctgcagtgagctgtgatcacaccactgcactccagcctgggtgccagagagagactcggtctcaaaaaacaaacaaaaacccactgttgttctaagtgaatgctgtcaggggaggggcaaagacacagggaaccccagcgaacagactccttctccgtcccatttagaattcccatgtagtgccccatacaattagcttctgaccacatgtgtccttggcagact

SEQ ID NO: 169896 - DNA, 601 bp, Human
cctttgaagaattaaaaatattgctctaggccaggcttggtggctcacgcctgcaatcccagcactttgggtggccaaagcaggagggttgcttgagttcaggagtttgagaccagcctgagcaacatagcaagaccccatctctacaaaaaattaaaaatcagctgggtggcatgcacctgtagtcccaactacttgggaggttaaggcaggaggatcacttgagcccaggagtttgaggctgcagtgagctgtgatcacaccactgcactccagcctgggtgccagagagagactcggyctcaaaaaacaaacaaaaacccactgttgttctaagtgaatgctgtcaggggaggggcaaagacacagggaaccccagcgaacagactccttctccgtcccatttagaattcccatgtagtgccccatacaattagcttctgaccacatgtgtccttggcagactgtcccaccctctctgagaaaggatgtgtcttcccctggttgagcccttcagaataggagggtgactcccaatgtcccctggctgtttgctcacaggctggctttccccctggtgtggtcaacattgtgcctggat

SEQ ID NO: 169897 - DNA, 601 bp, Human
tggccaaagcaggagggttgcttgagttcaggagtttgagaccagcctgagcaacatagcaagaccccatctctacaaaaaattaaaaatcagctgggtggcatgcacctgtagtcccaactacttgggaggttaaggcaggaggatcacttgagcccaggagtttgaggctgcagtgagctgtgatcacaccactgcactccagcctgggtgccagagagagactcggtctcaaaaaacaaacaaaaacccactgttgttctaagtgaatgctgtcaggggaggggcaaagacacagggraccccagcgaacagactccttctccgtcccatttagaattcccatgtagtgccccatacaattagcttctgaccacatgtgtccttggcagactgtcccaccctctctgagaaaggatgtgtcttcccctggttgagcccttcagaataggagggtgactcccaatgtcccctggctgtttgctcacaggctggctttccccctggtgtggtcaacattgtgcctggatttggccccacggctggggccgccattgcctcccatgaggatgtggacaaagtggcattcacaggctccact

SEQ ID NO: 169898 - DNA, 601 bp, Human
catacctcacctcagccttgaattcctgggctcaaggagtcctcctgctttggcctctcaaagtgctgggattacagacatgaaccaccacacctggcctggattttacttttgagcagttgtaggtttatagaaaaatagagctgaacgtacagagggtgcccatatattccttcgcacctccctgttccaccagtttcccctttattcacatcctgcatgagtgtggttcatctgttagtattgatgagccaatactggtaccttattattcacttaggtctgtagtgtatattcgggtttttttttttaatttttattttttttggagacagagttttgttctgtcacccaggctgcagtgcagtggcacgatctcgactcatgcctcccgggttcaagcaattcttgtgcctcagcctcctgagtagctgggactacaggtgcgcaccaccacgcctggctaattttttgtgttttagtagagacagggtttcactctgttgcccaggctggtctcgaactcctgagctcgggcaatctgctgtcaggcacccagcctcggggtcattttttgtgttgtacttactatgggcctaga

SEQ ID NO: 169899 - DNA, 601 bp, Human
gcaaccatcaccactaattctataatattgtcattgcctcccctaaatatcctgtacccattagcagtcactccccattcctccccctaccaggcccaggcaaccaccaatctatgttctgcctatagatttatctattttggacattttatgcaaatggaatcctacatggttctttgtgtctggcttcttccaagtagccatgttttaaaggttcatccatgttgtaataagaatgtatcagaacataaaaggccaagtaatattccattgtgtgaatagaccacattttgatttttcyattaatctgttgacagacttgattgtttccaccttttggttactgtgaatagtgcagctaggggcactaacatttctttctttcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgacc

SEQ ID NO: 169900 - DNA, 601 bp, Human
tcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgacctcaggtgatccacctgcctcagcctcccaaagtgctgagattacaggtgtgagccaccgcacctgtcctaacatttcttttcttttttttttttttgagacagagtcttgctctgtctccaggctggagtacagtggcacgatctcggctcactgcaacctccgtctcccaggtttgaatgattctcctgcctcagtctcccgagtagctgagattacaggcgcccaccaccatgcccagctaattttttgtatctttagtagagacagggtttcaccatgttggccaggctggtcttgaactcctgaccttgtgatccgcccacctcagcttcccaaagtgctgagattacaggcttgagccactgcacccgtcctaacatt

SEQ ID NO: 169901 - DNA, 601 bp, Human
taacatttctttttgtctcatttctctttgtggctaattattaagataatataaacttgcattaataaatttaatgagaaagtgtttaggctatgtgtggcagctcacatctgtaaccccaacactttgggaggctgaggcaggagaatctcttgagcccaggatttcgagatcagcctgggcactacagcaagacctcatctctactaaaaaaaaaaaaatgcaaatcatgaccagcctggccaacacggtgaaacctcatctctactaaaaatacaaaaactatttgggcgtggtggtrggcgcctataatcccagctactcgggaggctgaggcaggagaatcacttgaacccgggaggcgcaggttgtggtgagccaaaatcgtgccaccgcactccagcctgggtgacagagtgagactccacctcaaaaaataaataattttttttttaaaaaaaagcaaaaaaaaattagccagatgtagtgatgcgtgcctatactctcagctacttgggaggctgaggtgggagcccaggaggtcaaggctgcagtgagcagtgatcacaccactgcactgctgcctgagtggcagagtgag

SEQ ID NO: 169902 - DNA, 601 bp, Human
gacctcatctctactaaaaaaaaaaaaatgcaaatcatgaccagcctggccaacacggtgaaacctcatctctactaaaaatacaaaaactatttgggcgtggtggtgggcgcctataatcccagctactcgggaggctgaggcaggagaatcacttgaacccgggaggcgcaggttgtggtgagccaaaatcgtgccaccgcactccagcctgggtgacagagtgagactccacctcaaaaaataaataattttttttttaaaaaaaagcaaaaaaaaattagccagatgtagtgatgcstgcctatactctcagctacttgggaggctgaggtgggagcccaggaggtcaaggctgcagtgagcagtgatcacaccactgcactgctgcctgagtggcagagtgaggccctgactctttttaaaaaaaggtatttaatgtaaaaaataagactttgttgcatttcttttattctccatcggtaaccactcatgcacacacagttatgctgttgtatgtttattttttaaaaaataggctgggtgtggtggctaacccctgtagtcctaacacttgggagggaggccaaggtgagtcaat

SEQ ID NO: 169903 - DNA, 601 bp, Human
aattcctagaagttaaatagctgggccaaaggatctgagtatataatttttgagcaatattaataaaccacttgctctaaaggctgtaccagtctgtcatccttctaacagtatatgtaacggtctcttgctatcagtgtattttcttcctaaactttttggtaatcttatagttgaaaagtaaagattgatttgatgtccttttctccggtaggctgaggaagttgggccttttttgtgttttctgctattggccctgtgtgtttcctcttctgatcttgctttcttatgaccttggtcmatttcccagttgtcttgttgcctgcataattctaagcctgaagcctaggagaggtctgaatccgatgtctccataactctgggttccttctcccacaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggaggtgagcacttggggccagtgctctggaaacattcttg

SEQ ID NO: 169904 - DNA, 601 bp, Human
gacctggccccatgattcaattacctcccacaacacgtgggaattgtgggagctacaattcaagatgagatttgggtggggacaaagccaagccatatcagtagccatgcatgcaatagcatggattaatcttgaacataacattgagtgaaagaacccagactgtctgggtgcggtggctcatgcctgtaatcccagcactttgggaagccgaggtgggtaggtcacttgaggtcaagagtttgagaccagcctggccaacatggtgaaaccttatctctactaaaaacacaaaacttarctggctgtggtggcaggtgcctgtagtcccagctactcgggaggctgaggcaggagaatcgcttgaacctgggaggcggagattgcagtgagtggagatcatgccactgcgctccagcctgagcgatagagtgagactccaaaaaaaaaaaaaaagaacccaggcacaaaaggccacatgctgtgtgattccatttacagtattataaatatctagaataggcgaatccatagagatagaaagtatgttagtggttgccaggggctgggggagggaggaatggagagtgcctgcctcctg

SEQ ID NO: 169905 - DNA, 601 bp, Human
agaataggcgaatccatagagatagaaagtatgttagtggttgccaggggctgggggagggaggaatggagagtgcctgcctcctgggcacagggcttctttcagtgtgatagaaatgttctgcaattagacagtggtgatggtcacacaacactgtgaatatgctgtcaaccagtgattgtacactttaaaatggtgaattttaggctgggtgcagtggctcacccctgtaatcccagcactttgggaggccaaggtagacggatcacgagatcaggagatggagaccatcttggccaaygtggtgaaaccccgtctctactaaaaatacaaaaattaggcctgggcctggtggctcacacctgtaaggccgtggtggttcacacctgtaatcccagcactttgggagtccgaagtaggtggaacatgatgtcaggagttcaagaccagcctgaccaacatggtgaaaccctgtttctactaaaaatacacaaattagacgggtgtggtggcatgcacctgtaatcccagctacttgggaggatgaggcaggagaatcgcttgaacccgggaggcagaggttacagtgagttgagatcgt

SEQ ID NO: 169906 - DNA, 601 bp, Human
ggtggtatctaagctgatatacctgaaggatgagtggaagtagagatggtgaggggaggaagagaagaacgtactaaacaaagagcatagcttctggaaaagctgtgatggcgagaaatatggctcttccaggaactgcaggaaggttgctggtggtggaagatgtagtggttagtggggagagagcaaggccagaatgcacaggcccttgttggccatgatgtggggtttgatgtctttgataatggagtttgatctcagctatgggagcattttaagtagaagaattaggtggctcaatttttttttttttttttctgagccagagtcttgctctgttgctcaggctggagtgcagtgctgtgatcttggctcactgcaacctccgcctcccgggctcaagcgattctcatgcctcagccacttgactagctgggattacaggcgcctgccaccacacctggctaattttttgtatttgtagagatgaggtttcaccctgttggccaggctgatctcgaactcctggcctcaagtaatctgcctgcctcggcctcccaaagttctgggattacaggtgtgaaccactgtgcctggccca

SEQ ID NO: 169907 - DNA, 601 bp, Human
aaagagggtatatgtgacaggaagccaggagtaggattggcgactctggatatagagaggaaaagcaaaactaggaatcaaagatggcacccaggtttccaaggaggggttgagtggtgacgccagtcctgtgatagggaacactgaatgaagtactgtggttctctttagggttgtgtttggggtacctgtccaaacccaagaggtgatgtggagaacacatctagggagatgggcttggagctccaggggcaagacccagatttgaaatagaaattctgacatcattggcctataactsttcatcaaaatcatagttacaggccacgtgccatggctcacgcctgtaatcttagcactttgggaggcccagacaggcggaacgcttgagcccaggagttcaagacaagcctgggcaacatagtgacaccccatctctaataaaaatacaaaaagttagctgggtgttatggtgcatgcctgtagtcccagctacttgggaggctgaggtgggaggatcgcttgagccaggaggtcaaggcagtagtgagctgtaattgcacccctgtactccagtctggggagaaaaaaagaaaagccc

SEQ ID NO: 169908 - DNA, 601 bp, Human; identical to SEQ ID NO: 111525

SEQ ID NO: 169909 - DNA, 601 bp, Human; identical to SEQ ID NO: 111525

SEQ ID NO: 169910 - DNA, 601 bp, Human; identical to SEQ ID NO: 34126

SEQ ID NO: 169911 - DNA, 601 bp, Human; identical to SEQ ID NO: 34127

SEQ ID NO: 169912 - DNA, 601 bp, Human; identical to SEQ ID NO: 34128

SEQ ID NO: 169913 - DNA, 601 bp, Human
acaaatagcaaagtttttgtgccttatgggttgtgacataaaatttcttaatgtggagtgaaattttcaaaaagtgtacaaaacacttagcattagtaacttaacttctttggacctagtggacatgagaacccatatgcattgaaaagccaacagaagtattcaacaggccgggcgcggtggctcatgactgtaatctcaacactttaggcggaggtgagcggatcactaggtcaagagatcgataccatcctggccaacctggtgaaaccccgtttctactaaaaatacaaaaattagstgggcgtggtggcacaccctgtagtcccagctagtcaggaagctgaggcaggagaatcgcttgaacccgggaggcggaggttgcagtgagccgacattgcgccactgcactccagcctggtgacagagggagactccgtctcaaataaaaatattcaacagttagtgtttctcaagattttgacagtgatccattctaaaaattagtatgaactagtaacaccccctgtgtaatatacatataaaataaaataaaaaatttcaggcctggcaacagagtgagactctgtctcaaaaaaaa

SEQ ID NO: 169914 - DNA, 601 bp, Human
agagtaagaatgtctcaaaacaaaaacaaaatgaggccaggcgcggtggctcatgcctgtaatcccagcactttgggaggctgaggtgggtggatcacctcaggtcaggcgttcaagaccagcctggcaaacatggcgaaaccccgtctctactaaaatacaaaagttagccgggtatggtggtgggcacttgtagtcccagctacttgggaggctgaggcaggagcatcgcttgaacccaagaggcggaggttgcaatgagccaagatcgtgccactgtactccagcctgggcgacagastgagactccatctcaaaagcaaaacaaaacaaaaataataataattcaaaaaggggtcagatatggtagctcacggctgtaatcccagcactttaggaagatgaggtgggaagatcacttgaccccagaagttttagactagcgtgggcaacacgatgagaccgcatctctacaaaaaaataaaacaattggctgggtatggtggtagcacacgcctgtagtcccagctactcaggaggctcagatgggagaattgcttgggcctgagaggtcgaggctgcagtaagctgtgatggcacc

SEQ ID NO: 169915 - DNA, 601 bp, Human
aaagacagttgccaaagtaatctgcaatgaggaaatcaatgaaggatctggggttagggagtaatataatgaaaaagaagctaaaggaagacctgcacattatggttttgtacgtcatgtcttggtttagactacactttagaggggatatgacggtaggaaaacctggttggatgtattacagagacataaacatataaatgagtaagacccgagaccagaatgagggtaatggagatggaaacaaaaatcaaacagaaagagcttttaagtgaaaaattagatcttataaaaggaccaygtaattttaaatgactctaaagaattgtattccagacacctgaatgattgatgggattaatacacgagatgggtattgggatatggcttatgacagaagatgatgcatttaattttagaaccatagagacaaggtaacaagatttaaatcaggaagaatttaattgtaaaatcttatagaaaaatatggaagaagtcagctacacagagacagcagttgaaaatgaatcattcggctgggcatggtggctcacgcctgtaatcccagcacttcgggaggccaaggcaggtggatcacttg

SEQ ID NO: 169916 - DNA, 601 bp, Human
aatgctcatacactgcaggtgggaatataaaatggtacaaacccttagtttctttttaaagttacatatatctaccacatgacctagtaatttcattcttaggtatttatccaaaggaaataaaaacatatgtttacaaaaacactcgtataacaatgttcatagaagactttttcataatagccagaaactggagataactcaaacacccatcaacaggagaatggataaacaaattatgatataattcatccaatggaatactattcagtaataagaaggaataaaccacagattacartagacattatgcagaatgaaagaagccagatacaaaaattgtacattcaataattccatttatataaagttctaaaacaagcaaaactaacctatgaaactcttgagggggtaggaatacaaatgtttagattttgtaattacatgaacgtatgctattgtcaaaaactcactgaactaaacccttaagaactgtgcattttactgtatgttaaaaaacatgaatgagaaaactgattcacacagtaaagacagttgccaaagtaatctgcaatgaggaaatcaatgaaggatctggggt

SEQ ID NO: 169917 - DNA, 601 bp, Human
atgtacaaccaagaaacaattagacataaaattaatagaataaggctgtatacaaggaagttctggctgggcacagtggctcacgcttgtaatcccagcagtttgggaggctgaggcaggtggatcacttgaggtcaggagttcgagaccagcatggccaacatggcaaaaccctgtctctaccaaaaatacaaaaaaattagctaggcatggtggacgcttgaacgaaggtggaggttgcagtgagccgagatcgtgccaccgcactccagcctgggtgacagagggagactccatctcaaaaaaaaaaaaaaaaaattaaaaattaaaaacaaatcaaaacaaaacaaaacaaaaggaagtactatattgtccaaacacaaggggcaatgactaagtgctatggtgaatgaaaatcaatgttaatcaatttaagccttgaatgagataacattatataacactagatatagtgttttaatttatataacattataacactataatagccaaaataaaaatgactgacatcagcatttttatggtgctacaagggtaccgtctagtaagggtacagagcaactggaatgctcatacactg

SEQ ID NO: 169918 - DNA, 601 bp, Human
gctttaaaaaaatcaggtaaaaggagttggtgagtttaaattaaataagattggctatgagatgataatttttgaagctggatgaagggtgcatacacccttctctttcctgatgtatgtctttgaaattgtccatgaagttgttttaaagcagttgaacaattttagaagatattcttgatatatcacactgtaacctgacaatacattcaatgctatttaaacaagtataagatgaacctagacagggcgcggtggctcacgcctgtaatcccagcacttcgggaggccaaggcaggcrgatcacctgaggtcaggagttcgaggccagcctggataacatgatgaaaacttgtctctactaaaaatacaaaaaaattagctgggtgtggtggcacgcacctgtatcccagctatgcaggaggctgaggaggagaaatgcttgaacccaggaggtggaggttgcagtgagcagggatcacgccactgcactccagcctgggtgacagagtgagactccatctccaaaaaaaaaaaaaagatgaacctaaacctaacatactgccctaggcactggaggaaatacaaaagaaatgtgatc

SEQ ID NO: 169919 - DNA, 601 bp, Human
tatgctagctggaatttgctttaaaaaaatcaggtaaaaggagttggtgagtttaaattaaataagattggctatgagatgataatttttgaagctggatgaagggtgcatacacccttctctttcctgatgtatgtctttgaaattgtccatgaagttgttttaaagcagttgaacaattttagaagatattcttgatatatcacactgtaacctgacaatacattcaatgctatttaaacaagtataagatgaacctagacagggcgcggtggctcacgcctgtaatcccagcacttcrggaggccaaggcaggcggatcacctgaggtcaggagttcgaggccagcctggataacatgatgaaaacttgtctctactaaaaatacaaaaaaattagctgggtgtggtggcacgcacctgtatcccagctatgcaggaggctgaggaggagaaatgcttgaacccaggaggtggaggttgcagtgagcagggatcacgccactgcactccagcctgggtgacagagtgagactccatctccaaaaaaaaaaaaaagatgaacctaaacctaacatactgccctaggcactggaggaaat

SEQ ID NO: 169920 - DNA, 601 bp, Human
aaaagaaaaaaagaaaaacatgggaatgtaatcagcaaaattcaaactgcaggaaactctattcaacaagaaaaaaatgggaaaaaggagaatctacggatttaaagaaattgaaaacacataaaccaatggcaatgtatggatcttaattggatccagattcaaactgttaataaaaaaagagagagagacaatagggtaatttgatgatagtaagcaatcagttaaatttttggatgtaaaaattacggttatgttagaaaaaaggttatctttcacagaaaaacactgaaatatgtakgaataacatatgctatgctagctggaatttgctttaaaaaaatcaggtaaaaggagttggtgagtttaaattaaataagattggctatgagatgataatttttgaagctggatgaagggtgcatacacccttctctttcctgatgtatgtctttgaaattgtccatgaagttgttttaaagcagttgaacaattttagaagatattcttgatatatcacactgtaacctgacaatacattcaatgctatttaaacaagtataagatgaacctagacagggcgcggtggctcacgcctgta

SEQ ID NO: 169921 - DNA, 601 bp, Human
atgggagcccgttgtggtgtctcatgcctgtaatcccagcaatttgggaggccgaggtgggcgggtcgcttgaggccaggaatttgagaccagcctggccaacatggcaaaatgtcatctctatgaaaaatacaaaaattagtcaggcatggtggcgcatgcctgtagtcccagctactcaagaggctgaggcacgagaatacaagaatcacttgaaccctggaagcagagaagttgcagtagtgagccaagattacactgctgcactccagcctgggtgacagagcaagactctgtctcaaaaaaaaaaaaaaagaaaaaaagaaaaacatgggaatgtaatcagcaaaattcaaactgcaggaaactctattcaacaagaaaaaaatgggaaaaaggagaatctacggatttaaagaaattgaaaacacataaaccaatggcaatgtatggatcttaattggatccagattcaaactgttaataaaaaaagagagagagacaatagggtaatttgatgatagtaagcaatcagttaaatttttggatgtaaaaattacggttatgttagaaaaaaggttatctttcacagaaaaacact

SEQ ID NO: 169922 - DNA, 601 bp, Human
tacatcacatgtagagatggggctgggtgcggtggctcacacctgtaatcctagcactttaggaggccgagggggcggatcacgaggtcaggagtttgagaccagcctggccaacacagtgaaaccccatctctactaaaaatacaaagattagttgggcatggtggtgggcgcctgtagtcccagctactggggaggctgaggcaggagaatcgcctgaacccaggaggcggaggttacggtgagctgagatcatgccactgcactccagcctgggcaacagagcaagcctctgcattamaaaaaaaaaaaaaaaaaaaaatagagatggtaggctgggcatggtagcatatgcctgtaatctcaacactttgggaaggggatgtgggagtactgcttgaggcttggagttttgagaccagcctgggcaacatagtgagatccccatctctacaataaaattagccaggcatagtggcacaggcctgtagtcccagcaactgggtactcagaaggctgaggcaagactgcccaagcccaggagttcaatgccgtagtgggctgattgtgccactgcactccagcttgggtgacagaggga

SEQ ID NO: 169923 - DNA, 601 bp, Human
ttacatcacatgtagagatggggctgggtgcggtggctcacacctgtaatcctagcactttaggaggccgagggggcggatcacgaggtcaggagtttgagaccagcctggccaacacagtgaaaccccatctctactaaaaatacaaagattagttgggcatggtggtgggcgcctgtagtcccagctactggggaggctgaggcaggagaatcgcctgaacccaggaggcggaggttacggtgagctgagatcatgccactgcactccagcctgggcaacagagcaagcctctgcattwaaaaaaaaaaaaaaaaaaaaaatagagatggtaggctgggcatggtagcatatgcctgtaatctcaacactttgggaaggggatgtgggagtactgcttgaggcttggagttttgagaccagcctgggcaacatagtgagatccccatctctacaataaaattagccaggcatagtggcacaggcctgtagtcccagcaactgggtactcagaaggctgaggcaagactgcccaagcccaggagttcaatgccgtagtgggctgattgtgccactgcactccagcttgggtgacagaggg

SEQ ID NO: 169924 - DNA, 601 bp, Human
actagtatgtttccaaaaatacaagaacaattcctttggattaacctgtttggatatgaaagaataaattacagcagtgattctcaagcttctaccctaacctatgctggtctgtgtgaaaattttcagcagcctatggtaaaatgagaaaagcagtgttaaaagtgaaattttcatgaaactaaatatattcaggtgttaatgtcctttcagagaatggtggtgacaatttgtggtaactttaaaaagacaaaataaaaagtttgtaattctgtgttgtccacaaattatttcactttctttttttttttttttgagacggggtctcagtctcacccggatggagtgcaatggcgcaatcatggctcaccgcagcctcgacatactgggctcaggtgatccccacctcagcctcttgagtagctggcatcacaggcgggcaccaccacgcctgactacattttgtatttttagtagagatggggttttgccatgttgcccaggctggtctcgaactcctgacctcaagtgatccacctgcctcagcctcccatagtgctgggattataggcatgagccaccgtgcctggccgataataca

SEQ ID NO: 169925 - DNA, 601 bp, Human; identical to SEQ ID NO: 106005

SEQ ID NO: 169926 - DNA, 601 bp, Human
attatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagscctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgagg

SEQ ID NO: 169927 - DNA, 601 bp, Human
ggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttcyggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgagga

SEQ ID NO: 169928 - DNA, 601 bp, Human; identical to SEQ ID NO: 106005

SEQ ID NO: 169929 - DNA, 601 bp, Human; identical to SEQ ID NO: 169926

SEQ ID NO: 169930 - DNA, 601 bp, Human; identical to SEQ ID NO: 169927

SEQ ID NO: 169931 - DNA, 601 bp, Human
ctgcaatccccagcctccctcgccggcccccaccgtccccggactcaaagacgttctctgagcgagtctgtggggctctctgggtgtgaatgtcggaggctgcgatcgacatgccactccctactcaccataacttgacgcacgacatcaggctggaaggtgccagggggcctctggaaattgcgagccgtaggagatggagtgacttctggggcttggtcctttcgcagagaggggaaggggtctgtctgtgcaggggtcagtctctagaccaagacggtgagtctactttccgggttgytaccctttttccgagttgactgaacaacttcccttataggcgcctctacagtcccgcccctggggtggggcagggggcagagcgaaagctagtgcctttctccttgactagcgtttcctgagcacctgccgcagccagattaggtgttgctgggcattgaggatgttagggaaggagtcctcaccttccaggaacccacaatcaacccactcctacagtcaaagccttcccttttcccacaggatttcctgctccacgacctgccaggccatgagtggagatggtgcttaggagggtttt

SEQ ID NO: 169932 - DNA, 601 bp, Human
acgagtttacgatcttgaccgccacatcgtagccccacttcctatgttgcgcccggaacactgtgccgaacccgcctttgccgacgagctcctggttctccagttcctcgatggacaccaagggggcgggggcaccgctgggcctgagagaggggtgtcgcccactagccggccgtgccgtgcctcagcgctgctccccgcgcccctgtgactcggcgttctcactgcaatccccagcctccctcgccggcccccaccgtccccggactcaaagacgttctctgagcgagtctgtggggckctctgggtgtgaatgtcggaggctgcgatcgacatgccactccctactcaccataacttgacgcacgacatcaggctggaaggtgccagggggcctctggaaattgcgagccgtaggagatggagtgacttctggggcttggtcctttcgcagagaggggaaggggtctgtctgtgcaggggtcagtctctagaccaagacggtgagtctactttccgggttgttaccctttttccgagttgactgaacaacttcccttataggcgcctctacagtcccgcccctggggtggggcagggg

SEQ ID NO: 169933 - DNA, 601 bp, Human
ttggccagattgcggctggggtcaaccggggtcactcacgagtttacgatcttgaccgccacatcgtagccccacttcctatgttgcgcccggaacactgtgccgaacccgcctttgccgacgagctcctggttctccagttcctcgatggacaccaagggggcgggggcaccgctgggcctgagagaggggtgtcgcccactagccggccgtgccgtgcctcagcgctgctccccgcgcccctgtgactcggcgttctcactgcaatccccagcctccctcgccggcccccaccgtcccyggactcaaagacgttctctgagcgagtctgtggggctctctgggtgtgaatgtcggaggctgcgatcgacatgccactccctactcaccataacttgacgcacgacatcaggctggaaggtgccagggggcctctggaaattgcgagccgtaggagatggagtgacttctggggcttggtcctttcgcagagaggggaaggggtctgtctgtgcaggggtcagtctctagaccaagacggtgagtctactttccgggttgttaccctttttccgagttgactgaacaacttcccttatag

SEQ ID NO: 169934 - DNA, 601 bp, Human
ttctcagggggtgtcggttttcccatttatgaaatgagaaggttgagttagatcatcttctcccctcccctccacaaagtaccctgaatctagatataggtctggaggaggagtctggtggaagaattgaacagggaaaagaaagaggtagagaatgggtacctgttactggatttggctccggggtcctgcaggaccagttcatgccttgtctctcagccccctgcaaacagcacagagcatccagttctgccctggagcctggcactcccactgcactcctctcagccccaagttttcrctggcaaggggacagcatttataggactcttagtgcatcccctaatcctgtcaatgtctcacctgattccctcggggtccaggacttggtgttccagttgaggtagggctgggcatctggtttctgaaagttgaggtctctggagtctggggaggttgggccatcgaatctgaagatgtgcctgctgtccaggcttgtggaacctgctcctcttgtgccctgctcctcttggtaaggctcgggcattttttaggaacagagctgggaggctcctctagattcagtttgtttagccactca

SEQ ID NO: 169935 - DNA, 601 bp, Human; identical to SEQ ID NO: 29332

SEQ ID NO: 169936 - DNA, 601 bp, Human; identical to SEQ ID NO: 29333

SEQ ID NO: 169937 - DNA, 601 bp, Human; identical to SEQ ID NO: 29334

SEQ ID NO: 169938 - DNA, 601 bp, Human; identical to SEQ ID NO: 29335

SEQ ID NO: 169939 - DNA, 601 bp, Human
cgctgattatattgagggtggcggatggctctgcgcgcagtgatgtgttgctgggtgttttcccgtctctggatattgtgggcgcccagggtgacatttatattgctgcaaaagcaagaggtaggtctgggctgcaggagctatggtccaccagctctgcagggtaggcagacagcacggggagggcaagactgcagctaaccagaatcgaggggatgggagggccctggggctcagctgtatcctctttctcagcagctctgagctagggatgacagggtggtacttgccttcaggtttrcttccccagattaagttgataaatagcctgagtttatattttgagccccaatatgtgtcttccatctcttcctcttgctctttttgatcttatcctcctttcctcctcatttacactggcctgttccctcccgcaaagactcacttggtctttctttcaccctttcattgctacaactcttctttcagatggctcttccaccgaagagctccgcagggctgtgttcctggctggccaggaagttccttagctcctcaccttccccagcaatgagctgctgtcagcacaaagtcttctcgc

SEQ ID NO: 169940 - DNA, 601 bp, Human
ccctccccgccaccccggagccttgccctcacttcctcctccattgtccccggacacactaggaaggagccagagggccaggtaggtggtacctgcaataacatgatgtcattctggatggtccgctgattatattgagggtggcggatggctctgcgcgcagtgatgtgttgctgggtgttttcccgtctctggatattgtgggcgcccagggtgacatttatattgctgcaaaagcaagaggtaggtctgggctgcaggagctatggtccaccagctctgcagggtaggcagacagcayggggagggcaagactgcagctaaccagaatcgaggggatgggagggccctggggctcagctgtatcctctttctcagcagctctgagctagggatgacagggtggtacttgccttcaggtttgcttccccagattaagttgataaatagcctgagtttatattttgagccccaatatgtgtcttccatctcttcctcttgctctttttgatcttatcctcctttcctcctcatttacactggcctgttccctcccgcaaagactcacttggtctttctttcaccctttcattgctacaac

SEQ ID NO: 169941 - DNA, 601 bp, Human
ttatactctgtggacgtttattaaggctctggcaacactgtggagctggcctgtgtccccgagaagaagagtcagtcacaggggggtctccatctgatccagcagtttgaagcttctcattgttgtccttatccagggcaggaaacttgagaccctggtgaagacttctggaggaacccctgacgactttccataggagacgatgccgtgggccacattgttacacagcagggggcctccggaatccccctgtaggtagagaggagaagggagactgagacaggcctccctgctcctgctkccctgagctccgggctctcagggaaggcaggggtgggtgggccccttcaattgctgggtgtgtgtgagatggaagatcggtggggtacaggagccaagcctctggatcttttcggtcgctggacttcagctctgccttaattactgtctccagcccaatctgagtcaaggtacctctcccttctccaggagaatgttgcctatgtatgtgttgtgggtcttcctcctattcccccagagaccaggttgatggggaaaacaatccccagcccaccctggtctggctgccaggctgaggctg

SEQ ID NO: 169942 - DNA, 601 bp, Human
ctggggcggcgcggaactatgacgtagtagctgcgtcaggagcgcgcccgcgtttctaaactttgtctggataaggcgcacgcttggcgacgtcgaaggtccgtccgcagttaaggaagcttttgcagccggacaggtcgcgaagcacacatggggcagggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctycagattcgcacccgcacctgagcccggaagctctgggatatttccgccgggcgctgtcagcattgaaagaggctcccgagactggggaagaacgaggtaggcagcaacttcggggtttagaccaagagcatcaaatccagggcaggcaaggaaactttctagggtcggcagggcgtggggacttagtttcatttcccatgtcctcttcctcggcctccgacccacgacccttggttaagcgagggtacataactgtattctctactaagtctcttcaaagtgtgtctttcttcccttttc

SEQ ID NO: 169943 - DNA, 601 bp, Human
cgctgtcagcattgaaagaggctcccgagactggggaagaacgaggtaggcagcaacttcggggtttagaccaagagcatcaaatccagggcaggcaaggaaactttctagggtcggcagggcgtggggacttagtttcatttcccatgtcctcttcctcggcctccgacccacgacccttggttaagcgagggtacataactgtattctctactaagtctcttcaaagtgtgtctttcttcccttttcagatctgatggtgcacaatataatgaaggaagtagagactcaggccctagckttgtccacgaacaggactggcagtgagatgctgcaggaactgttgggattcagtcccttgaaaccgctttgtcgcgtgtgggctgctctgcgctctaacttgcgcactgtggcctgtcaccgatgcggggtccatgtattacaaagtgctttgctacagctccctcgattgctggggagtgctgcagaggaggaggaggaggaggaggaggaggatggaaaggatggtcccacggagaccctggaggagctggtcctgggactagccgctgaggtgtgtgatgattttcttgtctactgt

SEQ ID NO: 169944 - DNA, 601 bp, Human
gcatttttagttgttttcgttgggaagatttctctgaataatgtggtccgccattaccagaatgccagagttacattccatgtttcccatcagctgtcccctgtgtttgaggagctgagccctgtcttggaagctgtattggcccagggccacccaggggtagtcattgccctggtgggggcctgtcgcagagttggggcctaccaagccaaggtcctacagctcttgttggaggtgagtggatattacccacaatctgtttatgccctcagttcaacttctaccttttaggacttatctratcttaagtttttgtacctctggactcaggaagtctaatgcccaaggagttcacaggaatgggggaaaatgaggcctataggtgcccgccaccatacccagctaattttttttttttttttgagacggagttttgctcttgttgcccaggctggagtgcagtggcgcaatctcagctcaccgtgcccggctgaggccaaatgttatttcacagtcctggaacaaaaattgtctcccagaactaagagagaagtttatttaagggataaacatttattaacccctgtatgtgatagaggct

SEQ ID NO: 169945 - DNA, 601 bp, Human
tctaatgcccaaggagttcacaggaatgggggaaaatgaggcctataggtgcccgccaccatacccagctaattttttttttttttttgagacggagttttgctcttgttgcccaggctggagtgcagtggcgcaatctcagctcaccgtgcccggctgaggccaaatgttatttcacagtcctggaacaaaaattgtctcccagaactaagagagaagtttatttaagggataaacatttattaacccctgtatgtgatagaggctggggatacagcaaggcatgacatctgctttcatrgagctaacattcttgtggagttgggccttctttcctttcctgaaggtgttcccttaaagttgaggtaagggacggagaagttctcaggttcatcatattttgtcttctcctttaggcattccactgtgcagagccctcatcccggcaagtggcctgtgtgcctctctttgccactttgatggcttatgaggtgtactatggactgacggaggaggagggggcagtgcctgcagagcaccaggtgaggtaggggagaggccaagccagtgactaattgggagtcaggcctcccagggttta

SEQ ID NO: 169946 - DNA, 601 bp, Human
gattctgcccactggccttgaccacctgggctttccagcctccactgccccccttgcccactgggatgatcacgtgcgtgcccttgcccacctcggggttgtttcctagagtaggaaatcagcaattagctggcaaggcctccctgaggagaggggatggagcctgggacttctcccggccccacccacaatgtgtatgagccactgtgtatgtccctacgttgggccatcaccttattctctgacagtctcccttagagcagctctgtctccacccaatgcttgcccacatgttagggcmgtgccgcagtccaacatcccaaacctgttcccctgacactgaactctgaggtggggaggagagacgagggctcctgtcaccttctgcctgcctgactatcacagtgcctgggctggaggggcagatccacctgccccgtatgaaagggcagtcctgatcctgaaggccaaccctgcctgcttcctggggctgcagcttccagagcccagggcatccctggtggaggtggtaggggttcctgggaaattaaaggatgaggtgggcaaggttaggccctaatcaaagggtaaaaggagtcac

SEQ ID NO: 169947 - DNA, 601 bp, Human
atggtccacgtacacaatgtcctctgtgtccccagaacacacaaaactggttccctccagttctctccctgggcctcacctacttctggccagttctgcaggactcatgtccacagaagaaaatgcggggatgcccctagcctgacaggactgctgtgggaggacacggggagcatgacagatggtggaggagattggctgtagccaggggcctttgccaggagaggtgtggctggctgtgtgaccctgggctggccacctttctgcaccaggcctcggtcctctcatctgcccaatgggcggctggcttctcctggggtcaggcacctaggcaccccgccacatccgagggcaggaagcccttccctgtctttccctcccatctaccctctgctccagaccccagctgctcacctgggcaccaggggttgaagaggatgtagatctcattgcgggggtcaaagggcaactggaactccccagcgtctgattgtgtgcggactgtgaactgaaacttgccgatgatggcgttgggggaagtgtggacccgcaggttcagattctgcccactggccttgaccacctgggctttccagcctcc

SEQ ID NO: 169948 - DNA, 601 bp, Human
ctgggcaagactagcagagcaggctacccggggggttcaggctctgttcactgagctgccagagaccatggtatggtgacatgaggaaagccctactttgtgacacatcatagcattcccaggggcccaggctggggcaaagatcaacatagcttccttctcagctttggcctaatggcgaaggtggcagccaccaccaggagagctgctgtgtgtgagggaggggtgggcaagtgggcagggggtcctctgcttcctcccctcagtttccccaccccaagccattgttctttctcaggarctcgctgtctgaagatgaagcctgcccctgtcccagaaggctgatctagaaggccaggctctggcctgctctgctttccctccgtgcttttcctaggcggggacggggcagcacgtgtaagtctgtatcaaagatgacagccgcaggcccaggaacacagcatgtgtgtgccctcactacacccaggggcttgcccagcccaggatcaggcccagacgggctgggtaagggcctgagggatggagttctctcctctggaactgctacttggccctcatggcacaaaacaaacaatgagtt

SEQ ID NO: 169949 - DNA, 601 bp, Human
gggccaagaggcaaaggcctggtggggctgctgaggcaagtccagctctgcggatcccttaggacgaggaacctccccccaccatggtgggggtgtgggtaagagatgcctgctgggcaagactagcagagcaggctacccggggggttcaggctctgttcactgagctgccagagaccatggtatggtgacatgaggaaagccctactttgtgacacatcatagcattcccaggggcccaggctggggcaaagatcaacatagcttccttctcagctttggcctaatggcgaaggtggcrgccaccaccaggagagctgctgtgtgtgagggaggggtgggcaagtgggcagggggtcctctgcttcctcccctcagtttccccaccccaagccattgttctttctcaggaactcgctgtctgaagatgaagcctgcccctgtcccagaaggctgatctagaaggccaggctctggcctgctctgctttccctccgtgcttttcctaggcggggacggggcagcacgtgtaagtctgtatcaaagatgacagccgcaggcccaggaacacagcatgtgtgtgccctcactacacccaggg

SEQ ID NO: 169950 - DNA, 601 bp, Human
gatgtccccctggaggctcccaattgtactggaggctctggtctgggctcacagcagctaaggagccacagactgtccagggaggatctgccttaagaaaccatcatccaaccctgtcttttactgtagggagactcacataaaccctacagctaaagacaggaaacaggtcccccaacactcagcacagtggccctttccttacttccaggcagggccaagaggcaaaggcctggtggggctgctgaggcaagtccagctctgcggatcccttaggacgaggaacctccccccaccatgstgggggtgtgggtaagagatgcctgctgggcaagactagcagagcaggctacccggggggttcaggctctgttcactgagctgccagagaccatggtatggtgacatgaggaaagccctactttgtgacacatcatagcattcccaggggcccaggctggggcaaagatcaacatagcttccttctcagctttggcctaatggcgaaggtggcagccaccaccaggagagctgctgtgtgtgagggaggggtgggcaagtgggcagggggtcctctgcttcctcccctcagtttccccac

SEQ ID NO: 169951 - DNA, 601 bp, Human
gtacctgaaccaacagctcagagatgtccccctggaggctcccaattgtactggaggctctggtctgggctcacagcagctaaggagccacagactgtccagggaggatctgccttaagaaaccatcatccaaccctgtcttttactgtagggagactcacataaaccctacagctaaagacaggaaacaggtcccccaacactcagcacagtggccctttccttacttccaggcagggccaagaggcaaaggcctggtggggctgctgaggcaagtccagctctgcggatcccttaggaygaggaacctccccccaccatggtgggggtgtgggtaagagatgcctgctgggcaagactagcagagcaggctacccggggggttcaggctctgttcactgagctgccagagaccatggtatggtgacatgaggaaagccctactttgtgacacatcatagcattcccaggggcccaggctggggcaaagatcaacatagcttccttctcagctttggcctaatggcgaaggtggcagccaccaccaggagagctgctgtgtgtgagggaggggtgggcaagtgggcagggggtcctctgc

SEQ ID NO: 169952 - DNA, 601 bp, Human
ctgtttttagagtttaggatttatttgttaacaaatgaaagacacagtattagttttcctcaacagtgtgatctaagatgatggtgagtgcttgcaatctcttctgggtcacagagtcctcttccccaaagagagatattttcaaaggacatggtattgtgtgttgctaatgaaaagtcatggtatgcatctgatttgtaatacttcattagcaaccaataggctttgttctagcagaaacaaaaagtggaaaatgtaggacttgatggaaagtttataggatgaaactaattgacacctkttactcctaaaatgtgtttttatgcaaggtgtgtgggcatggcttttaggtatgtctatgacttcatcatggaatggaaaatacatatgtaaggtgcacaggctcacagacacagaaaaacacactctcttcttacactcacatttttcgcatatcagcaagaacaataataaaattgatggcacattgttaagtcataccatctctctatgataagtgccagacaaaataaagcagtatttctgatttcttgaaagagaatgacaaaactaaaccaagctgcctgtggctttgtccaat

SEQ ID NO: 169953 - DNA, 601 bp, Human
aagtacattattaattattaattgctttatggactatgttgaaagtctcattagtattatttttccgtttcagagataggcacaacttcagggcttaatttttaaaaattcatatacattgaacccatatataggtcccaattgcaacaactgaaatatgcctctttcaacacatgcaatagagagtaaaactttcaaatgactcagtgtagtttggaggccaacaaggaccaccaccaaactggcagctatgccacttgtcaaattaatgtgtgcttggacttgtaggacacggggtcarttagggcaatagtgtcagatgcatataaggatgtctcctaataatcatttaaagggtaacctgtttttagagtttaggatttatttgttaacaaatgaaagacacagtattagttttcctcaacagtgtgatctaagatgatggtgagtgcttgcaatctcttctgggtcacagagtcctcttccccaaagagagatattttcaaaggacatggtattgtgtgttgctaatgaaaagtcatggtatgcatctgatttgtaatacttcattagcaaccaataggctttgttctagcagaaa

SEQ ID NO: 169954 - DNA, 601 bp, Human
tagaagccctgagcaaaaatgatgccatggatacccatgttgctcatgatctgttttgggttttaaggtggtttcatggaggaggtgtgcattaatattttagaaataccattaagaagacatatgcactattgtcattatcaaaatgaaatattgaatagagaagagttttctccttcctagtcgtattaaatcatactgtgtcttagtgctgcgagataaggttttgatgctgttgaatgaaatagctactatcaagcaaaatctctgatacaattggcatgagatgccaaattaaggyaaaaaaataactctctttcaaagtaaaaaaaaaggaatttcattaaaatttcctttgagttctttgcattgactcatagagatatgaatggctgtgatagaaaaatggggttatttcataaggactctgcctaaattttcaattaattattattattactattaaaagaacaatcagatgtttgagcttgttgtcaggggaccagctaactacctgaccccatctttacttcttgaaaaaaatggaaaactatgagaagtaaaatagtaagtacattattaattattaattgctttatgg

SEQ ID NO: 169955 - DNA, 601 bp, Human
tttggagagaaaaggaattactgcttcctgacattctgcaaagaatgtacctgactacttcctcaatagaactagccatatgcttatacaacaaagatcaattgaaacaatcagccatatgttcattgaacatattttgcctgactctttcttggaatcatttgccttggagacaaaaggagcacaaatccagtctggcctcatctcccaacgactgatctaattattacaaaacacatgagttttacctgctggttttcctttaagatcaatatttcactttatcctatttttatgcttraagattctttaaacaaataaatgaaatattaaataatgaatgcatttatattagaaggaaaatggtcgtataatcctttaactcactaagttacctttcatccctttcttttttaacgtatctgctcctcttgagcaaatggcagttgtaatatgtcatgttaaggtattcattagttttctgatcttggtgattttaatagtgttgaaaagaatctacacaggaatttattagcctgctcttgagcatgtatgtttgatctctcttctgactttaaaaaatgaaaaagaaatgcatatt

SEQ ID NO: 169956 - DNA, 601 bp, Human
tgttcaggtctatagctaagtctgaccatctgtagaaaaatacatgctttttgctctctctgactccataatgagtttatgatagtgtgtgtaggcatataaaaattattggaagaaatcccaaagcaagggaacttattgaagaaaaaccttttttgaacaaatgaaggccaacaaaaatttttgaaaaccctcctgctctgtgactatgggcacaggttaggtctttgcctgctgctgaatctctactgagatagagaccgtgctcgaacacagctgaggtttattttttatttatttwtttttttttgagacggagtctcgctctgtcgcccaggctggagtgcagtggcgcgatctcggctcactgcaagctccgcctcctgggttcacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatccgcccgcctcggcctaccaaagtgctgggattacaggcgtgagccaccgcgcccggccacagctga

SEQ ID NO: 169957 - DNA, 601 bp, Human
attacaggcgtgagccaccgcgcccggcctgtgatttcttttagtgtaaccttttacataaagttgactttttaagggtttcaaatacctaagaacttgtttatttctttagttcaggataaataaacaacatccctgcattttaccaaaagggcaatgtaatgttttgttgttgttaaaaaggaaggaaagaccaattaaattctttgcagagatacttcagagataggtggactttggtcaggaccatgctaacaatgagaggttctcagctccaaaaaccacttttggcatcctttgsccttctgatacacaaacttgttaaccctatgattggttaaggaattgtctaatcatatatgtcaataatagagagcaaaacatcttgcagttttcttattatactctcctgtgaaagacagatgtgttgtgtctaattattcactgattggtatcgggagaaacgttaacataattggcacatttgttctaattaacagagggaaactgccacatgccacccaacatgaaaagtgagtccagcaagcattagctagaaaactccacgtctatcagaaaggttactctgttaaactcatac

SEQ ID NO: 169958 - DNA, 601 bp, Human
gagcagggatgaaaacctcatttctcctattaaaagctgtatttccaataaaaattcagtctttatgccaagtaattatttatcaaaacttgtagtacatttgggttttttaaaaaaaattaacaatttgatccctatggtcaaaggagataaagtttatacgcaaatttttattacagagaaatatgatgaccaatggaaatttttatgcctaaaatttattctattagagtaaaaacctatgggggaaatggcatagaaatataagttaaaatagaaaaaggaatactgtaagtttccstattttttttttttttgagatggagtttcactctgtcgcccaggctggagtgcaatggcgtgatcttggcccaccgcaacctctgcttcccgggttcaagcaattctcctgcctcagcctcccaagtagctgggattacaggcatgtgccatcatgcctggctaattttgtatttttagtagagacgggggttcctccatgttggtcaggctggtctcgaactcctgacctcagttgatccacctgcctcggcctcccaaagtgctgggattacaggtgtgagccattgtgcctggcaag

SEQ ID NO: 169959 - DNA, 601 bp, Human
gggaataattgggaatattagtgttgtagttgagaaaataagggactgtaataactgggcgacaaatcctttttgcaaatcaggtggtttaaattctttgctttcatcaaaactgaaggagggcctaatatgtcaaatgatgggtcactgaacataaattttgatgacagatcgctatgtaatttttgacctgtaacttggaagacgtgcagagttgagggacactgttacaacataagtccacgtatttctacttacttatgtatgagaaggttctcagtatttgaattcattataaatracagatagaaatgtaattgatttcatcctgtttcatttcagcagtagcattcaaactaggctaaatgagctacctagacaggcgagcagggatgaaaacctcatttctcctattaaaagctgtatttccaataaaaattcagtctttatgccaagtaattatttatcaaaacttgtagtacatttgggttttttaaaaaaaattaacaatttgatccctatggtcaaaggagataaagtttatacgcaaatttttattacagagaaatatgatgaccaatggaaatttttatgcctaaaa

SEQ ID NO: 169960 - DNA, 601 bp, Human
ttgccatcatatattacatgagagtgtaaaaacctctagggcaccagataagggaataattgggaatattagtgttgtagttgagaaaataagggactgtaataactgggcgacaaatcctttttgcaaatcaggtggtttaaattctttgctttcatcaaaactgaaggagggcctaatatgtcaaatgatgggtcactgaacataaattttgatgacagatcgctatgtaatttttgacctgtaacttggaagacgtgcagagttgagggacactgttacaacataagtccacgtattyctacttacttatgtatgagaaggttctcagtatttgaattcattataaatgacagatagaaatgtaattgatttcatcctgtttcatttcagcagtagcattcaaactaggctaaatgagctacctagacaggcgagcagggatgaaaacctcatttctcctattaaaagctgtatttccaataaaaattcagtctttatgccaagtaattatttatcaaaacttgtagtacatttgggttttttaaaaaaaattaacaatttgatccctatggtcaaaggagataaagtttatacgcaa

SEQ ID NO: 169961 - DNA, 601 bp, Human
caggaccgcctgagctctggactcttttctgtccataaaaccaagaaccaggaggagccaactacagtgctacagacttcagccttgacagagtgggctgcagattacgagataggggctggaaaaagctgggacaccaagacacatacattttagctactccaggacttgggttgaggctgtcctcaggctggtgtccccagggaagcagagaggtccttagaaaagaagcattggacacactttctgttatcaacatgaccctgtcactcataggaccaatacaggtttactttcagarctagcagtagaattgggtgtgctttgattttaggggcatcaggaaagcctccttaccctccaaaattgctcccccaaatttttgacaatgacttgaaatgtcattaagagagaccaattttaaattccactattagaaggatctcttcacatgtaaatgacctggagaaataacaaactaaatcatataaagtttcctaaaacatggcatataaataactaagggaacactgcagataaagaggagttcagggtgctaggatttcaagatagggctggattcaagtatccagcactatgc

SEQ ID NO: 169962 - DNA, 601 bp, Human
catacttggtaatgaggcataaatgataggcaatttatattactattatttttacctagaccatctatatttttataatttttaatttacttttatgggttttccatttcttttctcctagtacttcaagccagtctacttgttcttttaatgacatcagtctctcagccccataccatggcatacacatcattagcttcaacacccttatccatgtccctaagagatggaattttcttccagccacctctgctttccctaccaccctgaaagtacacctatgttggtcctatgactgcaytggtccccaaaaagggactgtcccccatctttttcctcattaaactttgttttcatgggactcaaaattctgtgacagatttttggtcaagttgtttccattaaaaactatagattttaaaaacgaataattgccacatgcaaaacgaaacaaaaaaaccccaaagtagtccacaaaacagcctcctttccttctgaaggttttacgatgcattgttatcattaaccagtcttttaccattaaacttaaacagccaattgaaacaaacagttctgagcccattctcccaccactgattaa

SEQ ID NO: 169963 - DNA, 601 bp, Human
atattttcctttaaactctatgagtttataattctagagatgtcattagcatgcatttgctttataggtattaacattttaattaatcttcataaaaattattttctaattctaaagtataagaaaacattatcagttttaaaaaaataagtagaaaagatttttaatgaaacacaggttattaaaataaaagaaatattcactatcatacttggtaatgaggcataaatgataggcaatttatattactattatttttacctagaccatctatatttttataatttttaatttacttttrtgggttttccatttcttttctcctagtacttcaagccagtctacttgttcttttaatgacatcagtctctcagccccataccatggcatacacatcattagcttcaacacccttatccatgtccctaagagatggaattttcttccagccacctctgctttccctaccaccctgaaagtacacctatgttggtcctatgactgcactggtccccaaaaagggactgtcccccatctttttcctcattaaactttgttttcatgggactcaaaattctgtgacagatttttggtcaagttg

SEQ ID NO: 169964 - DNA, 601 bp, Human
tcttcaacgggatcaattatgtcttcatttttcaaccattccacctaaagataaatgagaaaagtagataaatcctcagcatggatcccctgatggctgtctgtcctaacctgcattttgtacacttgatcttagccaaaaggccgagaagcgatacctgtgttttgtaatatgtacaatgttgttccaggccatgaacttctgcaaactggtgggaagtaactttccaaggtcatgttaagtatcactcacctgccaaacatgctgattctgtctgtactacattattctcaaatgtcartgaaccagttgggaaatacagtgttcaaattgttttcactttgccctgcaggcacgaatggggaatgtgtgctgccaagttcagaacccaataaaaaataataggataagcgtttcaaactgaactcaaacctttcactatttgatttgtttactcttggcaacttacctgctgcttttcagaaaagaatagaaagactatttttaaaagcacaaaaggcattttagacatcacatagctgtaataaaataacatttggatggtttacgtgtagcctcactgaaacgtatggattaaata

SEQ ID NO: 169965 - DNA, 601 bp, Human
ttctatggagttctggtgagtccaacctatgaggcttggacaagttattttaggagttaatgtaaaggacaagcagatggtagataggtagggtttcagtgagtgttccaaaaagcaacttaacctgctcaagtttacaaaattccctgccatggaattgtctgtataaactgcttactagcatactggcaagctgatatttggggtttaggatatatgtactgttctgctgggattttaatgagaaatgaataatcagaaattttcagagatgaaaaagtctttgaagatcgtaggtttrtcccttcatttacagagaaggaggcaagggctcagagaatcctggttaaaagaccctctgaagatcaggtagtgacagaaatactcctatgacccaatattcctgaccccagtccaaagctatttccttaattctaaatactaagttacttgcgtttgatccttcctaaagacaacacattcattgtatttatggatattgaaagcataatatacataggaagagatttgcatgtgcattaaacatctatataatacaactatatatagtctgccttcattagttatttatgactggcac

SEQ ID NO: 169966 - DNA, 601 bp, Human
taaagtactggtagtatatgccaggtgcagtggctcatgcctataatcccagtactttgggaggccaagatgggcagattgcttgagtctaggagtttgagactagccttcatctctacagaaaatacaaaaattaaccaggtgtgatggcacatgcctgtagtcccaggtacttgggaggctgaggagggaggatcatttgaactcaggagacagaagttacaggagccaagattgcgccactgcaccctagcctgggcgacagtgaaaccctgtctcaaataaaaaaataaaaaaaaaagaaagaaaattcaagtagtatacatataatttttgtttaaatgctatctctgggtggcagaattataggtataggtattttcttctttgaccttttctgtattccaaattttctttaatggatgtatatttgcaatctaaaaattacattaacaaaaaatatataaaacagttgctaaatatgaaatactggttagatatatatgttttctatggagttctggtgagtccaacctatgaggcttggacaagttattttaggagttaatgtaaaggacaagcagatggtagataggtaggg

SEQ ID NO: 169967 - DNA, 601 bp, Human
aaattgactggctatttgagttacttggcgattagttgatattgaaataaacacttactttgtgtataaaggccaattatgatgtctgatggagctgtcagcatatgtgattgtaaaacctacaccgtaagactgcacactattcagttctgcagacctctctttagaaaatactttgatatatatttttaatacttcaataatgtgagtctgtacaatattgtaattaaacaatttctaacaaaattatttccttgtagctaaaatataatacaactagtatatgcatctgtttcctgayactaaagaagtgtattagccattcaagtaacacaaaccttatatgtgcacagcatttgcccaatattttgttttctagaaacctatacaatagggaataatcatgaatgttatatttacagacagaaacattttttacagcaactttatttaatataaagatgaataattggaaacaactgtaatgttcaaaaacaagacaatggcaaagccagccacatatgttcatgtaatggactcctggacagccattaaaagtgatactgtagaaggctatttaataattcatgaggctgggtgc

SEQ ID NO: 169968 - DNA, 601 bp, Human
aggaggctgtgtatctgaacaataaaattgaaaacacaatagctactccaatgagtgcagtaaatttatggattatttcaaaattttagcttagctttggaatatattgtataacgaggcattttaaagggttttgtttttgcttttggcaaatattatcttcgatttacctagggataagagctggtagcaatatgagatagtacagaaagatgctaagaggtggagagatgcatgcactcttgctgtaggtactacagcaaataacaaaaaaatagatgaccaacatttacagataacraagaactgactgcattgtagtttcagaatccattatcccaagtaccaaaaaactttgcattccttataattcatttcaaatgttgtatttgcccttcaccagaaactgacaccaaatataaaatatttccatctaaaacattttctaaatttcagttccaattaatttctacggttttctgaagatcaaggattgttattcctaaaatgtgtggcttccagtgccattcaaatcctttgaattataaaatctgcaatcttggccccagcagttttgttgaataatataaagggattatat

SEQ ID NO: 169969 - DNA, 601 bp, Human
ggttaaaagataaaggttaaaggataaacatgaccaaattaggcaaaaaggagaagtaaggaggctgtgtatctgaacaataaaattgaaaacacaatagctactccaatgagtgcagtaaatttatggattatttcaaaattttagcttagctttggaatatattgtataacgaggcattttaaagggttttgtttttgcttttggcaaatattatcttcgatttacctagggataagagctggtagcaatatgagatagtacagaaagatgctaagaggtggagagatgcatgcactcytgctgtaggtactacagcaaataacaaaaaaatagatgaccaacatttacagataacaaagaactgactgcattgtagtttcagaatccattatcccaagtaccaaaaaactttgcattccttataattcatttcaaatgttgtatttgcccttcaccagaaactgacaccaaatataaaatatttccatctaaaacattttctaaatttcagttccaattaatttctacggttttctgaagatcaaggattgttattcctaaaatgtgtggcttccagtgccattcaaatcctttgaat

SEQ ID NO: 169970 - DNA, 601 bp, Human
atatggttataaacatacccacatgaaaaatgagaaaagcattaatatttcagtcatacagaactggctgtataagcaagtcccaactacttagagcaaaaacatttgctttgacctgcaccaatccagtgtaccaaaacactgacacacacacacacacatttctatttcaactctaattgatcagtgcatttttaattgtgggagtcagctcctataaaacaaaatctgaaattttaagctagctaagtgtcaaaatttgtttcataaataaaagctctcaaagggctcactgtgggaractgctctgacatttggaaatcaacacttgggaatgtaaagtgtagattatgtatatctctccagttcatttgtccagcccatctctgagaaaggttaaaagataaaggttaaaggataaacatgaccaaattaggcaaaaaggagaagtaaggaggctgtgtatctgaacaataaaattgaaaacacaatagctactccaatgagtgcagtaaatttatggattatttcaaaattttagcttagctttggaatatattgtataacgaggcattttaaagggttttgtttttgcttttgg

SEQ ID NO: 169971 - DNA, 601 bp, Human
agatatagtaaatttcaatcacacttcaaaatgcagcttaagcttctcacaaaaataggataaaaatattgaaataagagctttaaaatattaattttccctgaaatatataattatgatgatcaaggattcaatgtaaaacaatgctaaacatcatttcttgaacaccttaaccttttatatctacatattagtaaaaattatatcattttaatagtctacatagtttgagaaatctaagtgatttcatattcaaattattatgtaaatatattgtgtataatgtggatatggttataawcatacccacatgaaaaatgagaaaagcattaatatttcagtcatacagaactggctgtataagcaagtcccaactacttagagcaaaaacatttgctttgacctgcaccaatccagtgtaccaaaacactgacacacacacacacacatttctatttcaactctaattgatcagtgcatttttaattgtgggagtcagctcctataaaacaaaatctgaaattttaagctagctaagtgtcaaaatttgtttcataaataaaagctctcaaagggctcactgtgggagactgctctgaca

SEQ ID NO: 169972 - DNA, 601 bp, Human
aaaatggagaatatctagcttatagcacccattacattcctgagccaatcttcggcactcattttaaaaatgtatgctttatcaatatttatttcctttaaataaactaaatcatacccgcattataatttctaatacaaacccagaattttcaagaggttgcagagatgttctcactaaacattcgttctaaggtaaatctacctacagaaatgtttgtcatctttacatctattttacactccatggacattttcgttaggtacctgccatgaattaagaataaacggcttacattttrgaagtcttgttttgactctgtgaggagtttagagtgctcttttgtgctttctgataaaactaagtaatggttcccttccatataagtgatagaatcaacccttgctcatgaaaaagcaatattgcatgccatttgttagccggacatagttactttttattctggttcctggaaaattcgctttttccaattttgagagcaagctagaatattgctatgttattgcattttattgttgttgaaagaattctttatttctaatgtttccttaaaaaactccaaatggttcaatctccagcc

SEQ ID NO: 169973 - DNA, 601 bp, Human
atcaaacaagagacgtgataaaaatacaaacaaaaacaaacacaaacacaaacaaacaaacaactaaaaaatctcctcctatagcctcattcctcttccctgtcaatagacacacacttcatgccatcattactggcaaatatccaatcataaggaaaaaattctatgaatgcctaagaaatgatctagaagctaaggggttgctatgtcatgaaagtcttagtttgaatatatcatgtttgtatttgtcataatttaaaatgtgacattttctatgactaataaaaggttctgtctcgtsgcattgtattccttgttaaagaggttgttctgaggatttgtaaatatgcacaatggaagtagtaggcattaaatcacccaagattgaaatagtacattgagagagaaagaacgtgaaaggcagaaagatagaaaaagtccaactatttctactttgcaatcgcatgaatcagtttgttctagagtaaaggaaaaatactaagtgatgaaaatgttaaaaagactaacttgtatgtggtatgttgctattttaatcctcaacccaaacaaactctgtacctctagataaatggttagcaaa

SEQ ID NO: 169974 - DNA, 601 bp, Human
tctcacaaagccaggacttcttctctgtgccaaaactgaaaccctgatttccagtccccgggacccatgtccatatccagctccccgctcctggttatattggtgtccactcacaccgttacctctctagcttggagttgcagcttcatttttggcatttgaggatttctctaatttctttcttttggaccacgtattttctctctctctctttctgcatgcacatgtatgtctctactaagtttgcaatattttatccaacattttaatatattttcagtcaaaggtgtttgtattaagygcttaacaaggaaatatatctgaattcgttttgaacaaattaacaaataaatatcaacagtaatattttctatatatttcacattgtattcctcttaagtaccaagttagcttttgaaaaaatattatgctacattatctaggtaactctgaatcctactaacatccattatgaactctgaatttctcctatctagcagtacacctacatttatatcagaattatttgtatacaattttgaatagattcagaggttgtagttcttacctggttcactgaaagtagactagctttattttg

SEQ ID NO: 169975 - DNA, 601 bp, Human
acagtggacaattttcttgggtgattgggaactttgtattgtaagcttattgacaggtgtggcttatttttgtcttagactaatgaacttagttatgaaaggaaacttagatagtggcttgctgtttgctctgctggtgtcctagaagcttaattatacatctttcgtgttttgcttctagcactgtatcttagattccataccagagctagggtgaggttatggttttactatgggttttatttaaatgaagtcttcatttcccttttcctaccacttttttctatgtcttcccttggcyggtgggcaaaaatgttatagttgtttcttgtgggtaggtcaggcatttgtgagtttcagctttctttagggttcttatttccaagtctaggtctcacaaagccaggacttcttctctgtgccaaaactgaaaccctgatttccagtccccgggacccatgtccatatccagctccccgctcctggttatattggtgtccactcacaccgttacctctctagcttggagttgcagcttcatttttggcatttgaggatttctctaatttctttcttttggaccacgtattttctctctctc

SEQ ID NO: 169976 - DNA, 601 bp, Human
agtaaatgttggattttctcattctatcctccattagttttattctctcttttacatattcacttatgtattaacaaaacttccctgtattgtgagaagtttcataagatctacattccagtttataaattttctcttcagctttatctaaagctgtatctgatttttcatcttccaatgagttttaaatttcaatcattatgccttcctctctagacattccatttgtttttttctccaaatctgtctttttaacaatattctgttatttcatttgtgcttatgttccttttaaaaatayggtttgtctttttacatctactttactctatagtttccttcagattgctctatgagttcatgttagtagactgctaactcatttattattgctgactctcccttacagtggacaattttcttgggtgattgggaactttgtattgtaagcttattgacaggtgtggcttatttttgtcttagactaatgaacttagttatgaaaggaaacttagatagtggcttgctgtttgctctgctggtgtcctagaagcttaattatacatctttcgtgttttgcttctagcactgtatcttagat

SEQ ID NO: 169977 - DNA, 601 bp, Human
attttagctataacagtggaatcaaggaagtctaatgtaaataccattactattcttttcctgagcaatatatagaaaatggaaatttttaacttagtttgcaccttcccatattccatgttaatattgtctaccatttagctccatcttattttcagcttctcctcaattggtctcatcttattttaaggaaccaattgttgtttttcattttcagtagtttactcagtaaggtttatgagtaataaatcctctctatcttgattacctgaaaatcttttaaattttgttcttttattcrgtaaatgttggattttctcattctatcctccattagttttattctctcttttacatattcacttatgtattaacaaaacttccctgtattgtgagaagtttcataagatctacattccagtttataaattttctcttcagctttatctaaagctgtatctgatttttcatcttccaatgagttttaaatttcaatcattatgccttcctctctagacattccatttgtttttttctccaaatctgtctttttaacaatattctgttatttcatttgtgcttatgttccttttaaaaatat

SEQ ID NO: 169978 - DNA, 601 bp, Human
tccctgatatatgtagctttatttccaccatctcatttattgttttaatttactagttttccttttgccaatttcctacccttaaaatttttattttgaatttatgcattcaatttttatgtgtgtactcaagtcttaacattttagctataacagtggaatcaaggaagtctaatgtaaataccattactattcttttcctgagcaatatatagaaaatggaaatttttaacttagtttgcaccttcccatattccatgttaatattgtctaccatttagctccatcttattttcagctkctcctcaattggtctcatcttattttaaggaaccaattgttgtttttcattttcagtagtttactcagtaaggtttatgagtaataaatcctctctatcttgattacctgaaaatcttttaaattttgttcttttattcagtaaatgttggattttctcattctatcctccattagttttattctctcttttacatattcacttatgtattaacaaaacttccctgtattgtgagaagtttcataagatctacattccagtttataaattttctcttcagctttatctaaagctgtatct

SEQ ID NO: 169979 - DNA, 601 bp, Human
tggtgtgtgcctgtaatcccagctactcaggaggctgaggcaggagaatcacttgaaccaggaagtcagaggttgcagtgagccgagtgcaactgcactccagcctggcgacagagcaagactccgtctctaaataaatacatacatacatacatacatacctacatactcaacaatactgtaagttccatttcttaactttcaatcttttcctataattatgatttaagtatgtgactcataaacagaataaaactgagtttttttctacaattttggatttccttttacaggtgagttwaattcatttacattatgatccctgatatatgtagctttatttccaccatctcatttattgttttaatttactagttttccttttgccaatttcctacccttaaaatttttattttgaatttatgcattcaatttttatgtgtgtactcaagtcttaacattttagctataacagtggaatcaaggaagtctaatgtaaataccattactattcttttcctgagcaatatatagaaaatggaaatttttaacttagtttgcaccttcccatattccatgttaatattgtctaccatttagc

SEQ ID NO: 169980 - DNA, 601 bp, Human
agtctttgcccatgcctatgtcctgaatggtattgcctaggttttcttctagggtttttatggttttatgtcttacatttaagtctttaatccatcttgagttaatttttgtataaggtgtaaggaaggggtccagttttagttttctgcatatggccagttttcccaacaccattcattaaatagggcatcctttgcctattttaaagcaataaaagctgacaaccacttgcttctggcatccaagatcctgcatgagaacaggcttaaaaatgagacagatctgccttcacacattggytccagcactcatctgtggatgttgggagggctgtttcaattatatgcctcagtttcttcctttgtaaaagagaactattgttaggggattaacaaaagttctgtttgtaaggttttttttctaccttttgagtattaattaaattgagctcaattcaattttttcttaacttggtcatgtctgacacagtagactggggtcagaagcaactaatgccagggcctaaaatcaatgtattaggtggacagcaaacagaattaaaatgaaatctgaaatatctttaaactaccatataagata

SEQ ID NO: 169981 - DNA, 601 bp, Human
tatttctggttctagatccttgaggaatcaccacactgtcttccacaatggttgaactaatttacactcccaccaacagtataaaagcattcctatttctccatatcctccccagaatctgttggttccctttttttttttttttttttttttttttttgagacggagtttcactctcattgcccaggctggagtgcagtggcacgatcttggctcactgcaacctgcacctcctgggttcaagcgattctcctgcctcagcctcccgagtagctgggattacagtcgtctgccaccatgsccaactaattttttgtatttttagtagaaatggatttcaccatgttggccaggctggtctcgaactcctgacctcaggtgatccacctgcctcagcctcccaaagtgctgggattacaggtgtgagccactgtgcccagcctgtttactgactttttaatgatcaccattctaactggtgtgagatggtatctcattgtggtttcgatttgcatttctctaatgaccagtgatgatgagctttttttcatgtttgttggctgcataaatgtcttcttttgagaaatgtctgttcttattg

SEQ ID NO: 169982 - DNA, 601 bp, Human
gtttgctgcacccatcaacctgtcatctacattaggttttctcctaatgctatccctcccctagccccccaccccgacaggccccgatgttccatgttcccctccctgtgttggtgtgttctcattgttcaactcccacttatgagtgagaacatgcagtgtttggttttctgttcctgagttagtttgctgagaatgatggtttccggcttcattcatgtccctgcaataaaacatgaactcatcctttttttatggctgcatagtatttcatggtgtatatgtgccacattttctttawgcagtctatcattgatgggcatttgggttgattccaagtctttgttattgtgaacagtgctgcaataaacatatgtgcgcatgtgtctttatagtagaacgatttataatcctttgtgtatacacccagtaatgggattgttgggtcaaatggtatttctggttctagatccttgaggaatcaccacactgtcttccacaatggttgaactaatttacactcccaccaacagtataaaagcattcctatttctccatatcctccccagaatctgttggttcccttttttttttttttttt

SEQ ID NO: 169983 - DNA, 601 bp, Human
agccagggttggatcccagccctcaggctacacctccaccgtccttcttaagtactatgtgagcaataattagtagattcgaatgaggagagacaaggaaataacagaagagggcttggtaggcacctggcttaatttgtaatttggtgattgcatgagataaccctgctgatttggactgtaaaatatctctccatttgaaatattatcatttatagtcatgacacttataaagccaaaaatagcatagagaggttgtctcctttacatgaaaaaaatttccaaacagtgtcttctgttwcaagtgtggggcaagcaaagaggtgtaccaaacctcagcatttccactctaatgtgactggggagccttgctagagtgatgtagttgttaatgcatgataatcacattgcatttggcataaaaccctataagtaaatatttaaaggagaaacatcatttccctcaaaaatgatgccatgtggaaaaaaggaataaacatcaataattggaggagctctacacatcagaagaaaattccattttttttaattatacttcaagttctgagatacatgtgcagaatgtgcaggtttgttacat

SEQ ID NO: 169984 - DNA, 601 bp, Human
ttatctgaaactgcaatctcattccaggcacagaattggaattcattcattcattcattcattcattcatcatccgtttagcaaatactcttgaaccttattatattctgggttctgttgtagacatggggatactttcctgtttttactgaagtttaacagaaaataagcaagtaaacaaaataataagatcatttcaaatagtaaaaaagttcttttaaaaataaaccaaaagaacataatgtgtttggagatatcaggatggccaacttagggaattaaggaagaattttttttttttaattgagatgaaatttgacctggagcttgaaaaaaagaaagaatctgccaagttaagatcaggaggcaagtgcttgatgagaaacgacaataaatacgaaagtcctgacagaaagacagaatggttagagggtggggagcaagcaagaaaggaaagggaggaggtggggtcagaggacaggcagcaccaggtcacgtcctggtgggccaggatgaggagtcttgctctgtcacccaggctggagtgcaatggcacgatctcggctcactgcaacctccgcctcccgggttcaagcgattc

SEQ ID NO: 169985 - DNA, 601 bp, Human
gctgcgtcttgcaaaaggaaagcctatctccagctaggtatcacgtggtccgaaatttctccctgtaaagcagttctgagttttttgtccctgcttcccaccagaattcctgttcttgataggcagaccaagaatagagaatataacttcgtaacttcgatttgaatgtcaactttcacaaatattatgtagatttaaactactcaataaatgttttgtgccttatggtatttatctgaaactgcaatctcattccaggcacagaattggaattcattcattcattcattcattcattcatcatccgtttagcaaatactcttgaaccttattatattctgggttctgttgtagacatggggatactttcctgtttttactgaagtttaacagaaaataagcaagtaaacaaaataataagatcatttcaaatagtaaaaaagttcttttaaaaataaaccaaaagaacataatgtgtttggagatatcaggatggccaacttagggaattaaggaagaattttttttttttaattgagatgaaatttgacctggagcttgaaaaaaagaaagaatctgccaagttaagatcaggaggcaa

SEQ ID NO: 169986 - DNA, 601 bp, Human
aaatgggataaatgaaaccttgaaaagaaaaaaaaatgaaacaaaaatgggaacaaaatcaaattaatgagggaaagaaaataggaagcatgaaaaatggtttaattaaaaggaaaagaaacctgtggtcttttaaaattctgattcagtataaaattatgattttgcatctcctgtctgctctggagcctcactaagaattaataagcaggcagattgaattttagagcaaaaactggtctcgagtcactaactttggagtgcttaaagtctttcttttattgagcataaactctaatgsatctaatttatttcagacatcaggggtcattagcataaggaaaatcttttttccttatccctgccatatgctttaattcccaggacatattcagtaaggctctaaacagtttttttttcttttttatttaatcataacagcttgtgcttggtctaagagaactaaagaagacctgtcatcattggtcaaaggttaagtacccatttactgagctaagctgagaccacctctcccccgctccatctcaaatctactttttggattttctgttgtttcttgcccccttcatttaataggagt

SEQ ID NO: 169987 - DNA, 601 bp, Human
taggtcccatgacctcctaaaatgtgaggaaccacggccctctcctaacgctcacagccacatggtttacatggtgaaataactcatcatttcatttgccagtggctcatgagacaacccacactctaatgtcatggaatctttcacatattagcagtgtaaatgaattctttattgggaattgctctatctcttttggcattttgtgtttaaatgtaatgtatccaaaaggattttgctttcttttaaaaataattttcttcccaacatttccagaatattcactttcccatcaatcaartcaatgttagcaaattttcttcagaaaaccagtgatatcacaaatactcgtgattgggtgagtgctgctttcaaagtacttacttcacttctctgttgggttttatttgaggcactgctgcaggattctgaactctggtcagaatattatatctaaattcttattgttttactttaccaggtcatagttacttattcaacattcatgatttctagctcaacccatctgtcttttttcaaccctttctgttttggtatttgaaccctgccctttacttatatcagcacatttcatgatatg

SEQ ID NO: 169988 - DNA, 601 bp, Human
ttgtacaattctcctccaagttagacattggtaaagtcagtgcaccagaaaaagcatatttacctcatagtttctttcctgtgtacagtcacatacatttcgtagactctcccttggggaatggccccagcgggaatcagcaagctgactcctgaatagcaaaagagaaaagcagtcatttaagacttttgcagcacgtaaaagggaatgaggagattttgtgaccgcgcagccataagcctgcttcattttctctaaagacatgtaaatattccgagttgctccattttccttcctcatyggcctccttaccacggctccctctgaactcttatgcaattacttaaaggaatgatgtaactttttaaactcttgttttatttgaggaacagacagatggttccactgttgttttccttgcaagacaaggggaaaaccaacaactgctcaaaatttcaaacagctgtaatgatgcatcatttccatttttttttaaaatccccacaagattcaaagtcagggaaatgccaacttcaacataaaaaaaaaaacaacatgtattttttaaatatccggttagcatcaatgtaattccacaatg

SEQ ID NO: 169989 - DNA, 601 bp, Human
tgcattggtgcaatggaggaggatggcacattaggaagcagaaagtgctttgtgatcagaaaagcctgagtctgaattctgccttgctaaggtactaactgaaaccttggctttggaacccaattcccctgtgcctcagtttcttcatctttaaagtggagctcatcacagcttgcagaacgtagtgagaagtaaatgaaattaagagtttgctggatgaagggcagggatgctttgttttatgactatatcctaaagcacattcttgccattgtgttttacaataaaaatgcatctggtwcataacagaaaactagtgaagagaagacttctcatttatctgaaactgttatcctcctgtgtttgtttcttggttcatggtctgtagtgcatattttcttttgagatcttgaggttttcctagcttcatttttataaacagaacttcttttatgcacaccaaattcaacagagtaattccctctgcacctaacttcagatggtaggcatagcaaggagtgatttatagtttccgtttcattatagtcaaaggcagagaaccctaacagcagaaaagtgtctagctttatcaattttctgt

SEQ ID NO: 169990 - DNA, 601 bp, Human
tcgccgcctttccagagatctgtaaagcaggagaggtagaaatcctgagcacagccttgcagctctgcaccctctttggtcagagaccgcttgtcccatctctgtggctcattcaggctgttcagctgccagcctgcactttcgcttagagcatattcagcaatgataagacccctcttgtcacattcactatgccacatgtaattaagttcacgcctcccttcagacaattcacatccgcagatgaccagctggataccatccagctggaaacatacccagtttgggatgcaataaaagkaatcagagagaaggaaaatggagaaaaatgctcagaattttcctacgaatgcatagtaacatcacagctcctgatgtcctcacagagtcttcttccaaagaagttctgtcttgtatcatgtgtggatagaaaggatctttagtgagcaatagaaagtgtatccaaaaatgcaccgtaatacataggcagaggtttggtttgtgcattggtgcaatggaggaggatggcacattaggaagcagaaagtgctttgtgatcagaaaagcctgagtctgaattctgccttgctaaggtactaac

SEQ ID NO: 169991 - DNA, 601 bp, Human
atgaggaaccaaaggaaaaataattgggtttcttctgagcatatttttttcctcatggacatgcggatcttgtaacttaacacattcccttcttgaaaggcttagaaatagtaaattcacgacctggtactagcaaatgtgctgggaattacaccaactattttatattctaaccgctcgcctactttatcttatcttttataactttattttccccattttcttaccttttttatccacttatttaaatttatttctcttattgagaagtgttttcgtaaactatcttgaagcatttctytctaagtaggatttcaataaatgaacattgtcaagaacagtatgaggataagatttcaatatacctggactcactaactcccactgttagcctttttatggctcttccttcaaactgaggaacttgaggctcatgaatgagaaaggactctactaaaaggagaaagatcactgtgtttccttgagacagaataatgtcaactactattttacaaaattccaaaaaataacatgataagcaaatctatctctatacaattacctacatagggaattttggacctttatcctcacacattgc

SEQ ID NO: 169992 - DNA, 601 bp, Human
gacataaatagcattgaaattgcaaatatctgagcatatatgtaaggagttacgcaggataagatttaactatgtgaaaactaaggtcagagtgtgtaacacatttcctttatacaaaggaagctattaaatcacatagaagaaaatagcagaaaataaaaatatctcagattcttgtttttgcagagaaggacttctctatgtctcatgtgttttctaagcaattcaagcagtctgtaaatattaattgcagatgatatggaaatgaacatagagcaaaaattagcttcagaagcatcarttaagtagaaatttcagcaaagaacaatgattaaaattttaaatgttttccaaagtccaacaaggataatattccagtaaatgctggatgggtgctgagtcctctaggacaaagcccacagagagaaatttcagtttcctgtcagaaatattttctcatcctttgcttgtcattatcagtgaggagaacttctaatcaagagtgcataatttacaaaactttcacataagccattgcatttgctgctcatggtacacctgtatggcagtgtatgtctattacctcttttccagaagagga

SEQ ID NO: 169993 - DNA, 601 bp, Human
atggttaagcatttcctttataaaatgaagcagtgaagctccaaggaagttaagaaatttgttaaactaaccactctaagtattcccaacatgaaaggctcttaggctaagtctggttccatgattgtaatgatggcttttaaacctatgtacagaaatttacatttagcttttcatttgaacttaatagtttcaaggtaaattttgggtcatctatttcttcatgctctatcttccctccaaacattggctatctcttccggtcttttctcctccctaaatctgatatgcttgccatttgtgttctcattctaaccattgataactttgcaacacaagaacagggcaagggcagagaccttttcaaggacaccatttggaacctctttccagtctgatatcaatactttgagctatttagttccaccaaatataaacccattaaaatggacattgtttggttcacatcttttgatggaattcacatatatatgacaagggacacatcaaattcctttataattgcaatggtcacttgaaatggatttttctctagtttttgtctatggtttacgtattatttattacatattccagaagt

SEQ ID NO: 169994 - DNA, 601 bp, Human
tatggttaagcatttcctttataaaatgaagcagtgaagctccaaggaagttaagaaatttgttaaactaaccactctaagtattcccaacatgaaaggctcttaggctaagtctggttccatgattgtaatgatggcttttaaacctatgtacagaaatttacatttagcttttcatttgaacttaatagtttcaaggtaaattttgggtcatctatttcttcatgctctatcttccctccaaacattggctatctcttccggtcttttctcctccctaaatctgatatgcttgccattyatgttctcattctaaccattgataactttgcaacacaagaacagggcaagggcagagaccttttcaaggacaccatttggaacctctttccagtctgatatcaatactttgagctatttagttccaccaaatataaacccattaaaatggacattgtttggttcacatcttttgatggaattcacatatatatgacaagggacacatcaaattcctttataattgcaatggtcacttgaaatggatttttctctagtttttgtctatggtttacgtattatttattacatattccagaag

SEQ ID NO: 169995 - DNA, 601 bp, Human
agtatggttaagcatttcctttataaaatgaagcagtgaagctccaaggaagttaagaaatttgttaaactaaccactctaagtattcccaacatgaaaggctcttaggctaagtctggttccatgattgtaatgatggcttttaaacctatgtacagaaatttacatttagcttttcatttgaacttaatagtttcaaggtaaattttgggtcatctatttcttcatgctctatcttccctccaaacattggctatctcttccggtcttttctcctccctaaatctgatatgcttgccaattatgttctcattctaaccattgataactttgcaacacaagaacagggcaagggcagagaccttttcaaggacaccatttggaacctctttccagtctgatatcaatactttgagctatttagttccaccaaatataaacccattaaaatggacattgtttggttcacatcttttgatggaattcacatatatatgacaagggacacatcaaattcctttataattgcaatggtcacttgaaatggatttttctctagtttttgtctatggtttacgtattatttattacatattccaga

SEQ ID NO: 169996 - DNA, 601 bp, Human
tctttattacagaccaaacaacctcaatgtttccaccctcagctggaatagcatggtttccagatctctcctcgggtttctatcttcattttcatatggatgcttgtcattgttttccaggtcctcgttaaagtggtggcaccttgaactcaacactcaaatagtatgagagagtattttctttgatttgccatctgtgtttgtattcatgcctcacaaaattgttgctgttgattattcccaatcaaggaattacttacaaatattatttagcaggctccagttacatgggaagatagaratagtatggttaagcatttcctttataaaatgaagcagtgaagctccaaggaagttaagaaatttgttaaactaaccactctaagtattcccaacatgaaaggctcttaggctaagtctggttccatgattgtaatgatggcttttaaacctatgtacagaaatttacatttagcttttcatttgaacttaatagtttcaaggtaaattttgggtcatctatttcttcatgctctatcttccctccaaacattggctatctcttccggtcttttctcctccctaaatctgatatgcttgc

SEQ ID NO: 169997 - DNA, 601 bp, Human
gttttaaaaaatcatttcagaatgaggacactctagaactaaacttagtccaaatgactttcaggaataatttaggctagtacagcagattcattctttcaaatatgactagaaataatatagaactgtatttatacagcaacttaaaatgagatctcttgtatagttcatgctcagagaatctgggcagaaagaacctaaaatatgcagattctttattcttatatataaaaattgcctttaatcttttccctaacaggactgtaatcaacaagcaaatggataaattaacctagcctakcagtaaatttgtgaagatatagttccaaaggtattgagtggattgccccaagtctcacaactaagtgctagttagtgctgagatgaaaataaatgccctctcaacgacaacagtcaaactactcactcaatcagaagagcatagcttttgaaatcatggactcacagaattttagaagggcccttggaagtcattcggcagcaccttccatccagccagaacccctctaaaacatggctgacgtatagttagtgctatagacacatccagaattgttccattactgctaaaaggtcacct

SEQ ID NO: 169998 - DNA, 601 bp, Human
ccagcatctctttgatccccttccctccgacactggtctttctatggtagcttcctccaaatttatgtacagacactttcaagatggaatgagaatgaacagagtccctatgaagttacataagcagattttctgataattcttgccactggtctcacagggttttaaatacttttgtggtttcaggacctgacttgaaaaatagttttaaaaaatcatttcagaatgaggacactctagaactaaacttagtccaaatgactttcaggaataatttaggctagtacagcagattcattckttcaaatatgactagaaataatatagaactgtatttatacagcaacttaaaatgagatctcttgtatagttcatgctcagagaatctgggcagaaagaacctaaaatatgcagattctttattcttatatataaaaattgcctttaatcttttccctaacaggactgtaatcaacaagcaaatggataaattaacctagcctatcagtaaatttgtgaagatatagttccaaaggtattgagtggattgccccaagtctcacaactaagtgctagttagtgctgagatgaaaataaatgc

SEQ ID NO: 169999 - DNA, 601 bp, Human
tctaatgagtgaccatcattttctgtgtgcctgtcaatcagaagatataacactcaggaactagtctgcctgcctgtttctctctcattttgagggtgagctaaaattccactcatgttttgctttataaataaaaggcctcccataattgctcctgcttatctgcatggattattcttgcatagcatctttatcccgacagcagctcacctcccactgtccctgtgctgcctggttcttgagcagtattttccagtcctcggtattggggtctgcgcagtgatgcatagtgaggacgackgggcgggtgagcagagctcctgggggcccacagctcaccacaggggtcaaaagtgtctgagagtcatccatgggtggcctaggaggagagcagagaatggcttcagtgacatttccattgtattcatgaactatgcacttgggttctgaaggcaaacaggtcaagtagttttctcctggaattctttttttttttttttttctggggggttggggagaggaaataggtgatacagaattaaatgctctctataccaagaccttgatcttgcaggactggaagtctttatgataacaataa

SEQ ID NO: 170000 - DNA, 601 bp, Human
ctgcgcccggctaatttttctatttttagtagagacaggatttctccatgttggccaggctggtctcaaactcctgacctcatgatccgcctgcattggcctcccaaagtgctgggattacaggcatgagccaccccatatacatatatatgtatatattatatatacacacatatacacaatatatatacatagacatatatataatctatattccaaaaggaacatgtctacaactcttatgtgcacctttcctatgagttatctaatgagtgaccatcattttctgtgtgcctgtcartcagaagatataacactcaggaactagtctgcctgcctgtttctctctcattttgagggtgagctaaaattccactcatgttttgctttataaataaaaggcctcccataattgctcctgcttatctgcatggattattcttgcatagcatctttatcccgacagcagctcacctcccactgtccctgtgctgcctggttcttgagcagtattttccagtcctcggtattggggtctgcgcagtgatgcatagtgaggacgactgggcgggtgagcagagctcctgggggcccacagctc

SEQ ID NO: 170001 - DNA, 601 bp, Human
gttttaaaattattgagtatttttggataaacatattactgaaatacaggtgctaagtggagggttctaatataaagaactaggcttgtttaaagcattgtccttaagaagttctgatgacagcagctgcggacagccagaatgctgcagattttcttccttctagtggagctttggagacacaccctttctgttttccaaggttaagttcacaagaactgtatcccaggtacatgtctgcaagtaagtgcctaacattttctgatccagttgcaatgtttctgacctgcaaattatataygtatatatacatatactttttttttttttttgagatggaatcttactctgttgcccaagctggagtgcagtggtgcgatctcagctcactgcaacctccgcctcccgggttcaagcggttctcctgcctcagcctcccgagtacctgggattataggcacatgccactgcgcccggctaatttttctatttttagtagagacaggatttctccatgttggccaggctggtctcaaactcctgacctcatgatccgcctgcattggcctcccaaagtgctgggattacaggcatgagccac

SEQ ID NO: 170002 - DNA, 601 bp, Human
taaatgtatagtatagttttaaaattattgagtatttttggataaacatattactgaaatacaggtgctaagtggagggttctaatataaagaactaggcttgtttaaagcattgtccttaagaagttctgatgacagcagctgcggacagccagaatgctgcagattttcttccttctagtggagctttggagacacaccctttctgttttccaaggttaagttcacaagaactgtatcccaggtacatgtctgcaagtaagtgcctaacattttctgatccagttgcaatgtttctgasctgcaaattatatatgtatatatacatatactttttttttttttttgagatggaatcttactctgttgcccaagctggagtgcagtggtgcgatctcagctcactgcaacctccgcctcccgggttcaagcggttctcctgcctcagcctcccgagtacctgggattataggcacatgccactgcgcccggctaatttttctatttttagtagagacaggatttctccatgttggccaggctggtctcaaactcctgacctcatgatccgcctgcattggcctcccaaagtgctgggatt

SEQ ID NO: 170003 - DNA, 601 bp, Human
tgttaatgtcgttgttattgtaactactcaaacccagaaatggatagggtaataggaagagaatcatgcgaataatttaggatcacttcggattaagacgggatgtttttcagatacatcatttaaagcttaaacagaatgaaagttagatctggttaaatctggtcctaactcaacataaagtgtatttatttatttattatgtacgcttcggcaagcagtgatcccctgatatggtcaagagtagaacatgcccataggaaggaaatcccagtgaatcccagggatactctggtactcktctacatctaatactatattttcttaaaatattaggagctggaatcttcatgtgtattttttctaagaattttttcctaaaaaattatcataagtaatcacaaagcatataatatatactttgcatattataacttcctattttatatgttttacattttatacaagtataaatgtatagtatagttttaaaattattgagtatttttggataaacatattactgaaatacaggtgctaagtggagggttctaatataaagaactaggcttgtttaaagcattgtccttaagaagttctg

SEQ ID NO: 170004 - DNA, 601 bp, Human
caggacaaaggaaagcctccggtatcccctagtggtgacatggtgcagaaagcttcctagaagacatggccaaagagtaacgatgcccacgtcccagtcactcacaagtacaagggggctttcatgaggactgtcctcttctacttccctcatctgctcagtttattgttaatgtcgttgttattgtaactactcaaacccagaaatggatagggtaataggaagagaatcatgcgaataatttaggatcacttcggattaagacgggatgtttttcagatacatcatttaaagcttaaayagaatgaaagttagatctggttaaatctggtcctaactcaacataaagtgtatttatttatttattatgtacgcttcggcaagcagtgatcccctgatatggtcaagagtagaacatgcccataggaaggaaatcccagtgaatcccagggatactctggtactcgtctacatctaatactatattttcttaaaatattaggagctggaatcttcatgtgtattttttctaagaattttttcctaaaaaattatcataagtaatcacaaagcatataatatatactttgcatattataac

SEQ ID NO: 170005 - DNA, 601 bp, Human
gagaagctcagaacctccaggtttattccagtcccaaaggacacctggaaagcagctgctttctccaggacaaaggaaagcctccggtatcccctagtggtgacatggtgcagaaagcttcctagaagacatggccaaagagtaacgatgcccacgtcccagtcactcacaagtacaagggggctttcatgaggactgtcctcttctacttccctcatctgctcagtttattgttaatgtcgttgttattgtaactactcaaacccagaaatggatagggtaataggaagagaatcatgcraataatttaggatcacttcggattaagacgggatgtttttcagatacatcatttaaagcttaaacagaatgaaagttagatctggttaaatctggtcctaactcaacataaagtgtatttatttatttattatgtacgcttcggcaagcagtgatcccctgatatggtcaagagtagaacatgcccataggaaggaaatcccagtgaatcccagggatactctggtactcgtctacatctaatactatattttcttaaaatattaggagctggaatcttcatgtgtattttttctaagaa

SEQ ID NO: 170006 - DNA, 601 bp, Human
aaagatgtgaaaggttgccacctaggttattatttattaggccttgcaacatgatctgagctataataagagctgtgttttaatagcatcagtgaaataatttcttctactgaacctatgcccccagaggaagcccctaaaaaggaaaagagagaagctcagaacctccaggtttattccagtcccaaaggacacctggaaagcagctgctttctccaggacaaaggaaagcctccggtatcccctagtggtgacatggtgcagaaagcttcctagaagacatggccaaagagtaacgatrcccacgtcccagtcactcacaagtacaagggggctttcatgaggactgtcctcttctacttccctcatctgctcagtttattgttaatgtcgttgttattgtaactactcaaacccagaaatggatagggtaataggaagagaatcatgcgaataatttaggatcacttcggattaagacgggatgtttttcagatacatcatttaaagcttaaacagaatgaaagttagatctggttaaatctggtcctaactcaacataaagtgtatttatttatttattatgtacgcttcggcaagc

SEQ ID NO: 170007 - DNA, 601 bp, Human
aatgaacacttagttatacatttagttcagagggctacacaaagatgtgaaaggttgccacctaggttattatttattaggccttgcaacatgatctgagctataataagagctgtgttttaatagcatcagtgaaataatttcttctactgaacctatgcccccagaggaagcccctaaaaaggaaaagagagaagctcagaacctccaggtttattccagtcccaaaggacacctggaaagcagctgctttctccaggacaaaggaaagcctccggtatcccctagtggtgacatggtrcagaaagcttcctagaagacatggccaaagagtaacgatgcccacgtcccagtcactcacaagtacaagggggctttcatgaggactgtcctcttctacttccctcatctgctcagtttattgttaatgtcgttgttattgtaactactcaaacccagaaatggatagggtaataggaagagaatcatgcgaataatttaggatcacttcggattaagacgggatgtttttcagatacatcatttaaagcttaaacagaatgaaagttagatctggttaaatctggtcctaactcaacat

SEQ ID NO: 170008 - DNA, 601 bp, Human
cccacaaccatttgctgaaacagtgaatgaacacttagttatacatttagttcagagggctacacaaagatgtgaaaggttgccacctaggttattatttattaggccttgcaacatgatctgagctataataagagctgtgttttaatagcatcagtgaaataatttcttctactgaacctatgcccccagaggaagcccctaaaaaggaaaagagagaagctcagaacctccaggtttattccagtcccaaaggacacctggaaagcagctgctttctccaggacaaaggaaagcctcyggtatcccctagtggtgacatggtgcagaaagcttcctagaagacatggccaaagagtaacgatgcccacgtcccagtcactcacaagtacaagggggctttcatgaggactgtcctcttctacttccctcatctgctcagtttattgttaatgtcgttgttattgtaactactcaaacccagaaatggatagggtaataggaagagaatcatgcgaataatttaggatcacttcggattaagacgggatgtttttcagatacatcatttaaagcttaaacagaatgaaagttagatctg

SEQ ID NO: 170009 - DNA, 601 bp, Human
actttgcttcccactgtattccagtgggcctggctcagggtgtgtgtcccacaaccatttgctgaaacagtgaatgaacacttagttatacatttagttcagagggctacacaaagatgtgaaaggttgccacctaggttattatttattaggccttgcaacatgatctgagctataataagagctgtgttttaatagcatcagtgaaataatttcttctactgaacctatgcccccagaggaagcccctaaaaaggaaaagagagaagctcagaacctccaggtttattccagtcccaaaggacacctggaaagcagctgctttctccaggacaaaggaaagcctccggtatcccctagtggtgacatggtgcagaaagcttcctagaagacatggccaaagagtaacgatgcccacgtcccagtcactcacaagtacaagggggctttcatgaggactgtcctcttctacttccctcatctgctcagtttattgttaatgtcgttgttattgtaactactcaaacccagaaatggatagggtaataggaagagaatcatgcgaataatttaggatcacttcggattaagacgggatgtt

SEQ ID NO: 170010 - DNA, 601 bp, Human
ccaagtatggacaaagcctcacatgttccaagacaggctggaagttcagattttaatgtgaaatcttccaacttttaattaactcgaatttaaaagaaaatctcaggcaggagaaatccacgcgtgagcatgagtcagtctctgcactgtcagagacaagagtcagtcagtctctctgcaggggcaggaatcatgtcgactttgcttcccactgtattccagtgggcctggctcagggtgtgtgtcccacaaccatttgctgaaacagtgaatgaacacttagttatacatttagttcagrgggctacacaaagatgtgaaaggttgccacctaggttattatttattaggccttgcaacatgatctgagctataataagagctgtgttttaatagcatcagtgaaataatttcttctactgaacctatgcccccagaggaagcccctaaaaaggaaaagagagaagctcagaacctccaggtttattccagtcccaaaggacacctggaaagcagctgctttctccaggacaaaggaaagcctccggtatcccctagtggtgacatggtgcagaaagcttcctagaagacatggccaaag

SEQ ID NO: 170011 - DNA, 601 bp, Human
aagaatctacattttccctaaaaatctgtacgtgtgaaaagaattagataaattaaggaactgggcaataatatattaatatgcaattctactatgttctttcaaaactcacctgacagtttcttcctaaagaaatacactgctttttctaagtaatcttggccgtcagattctaagaaaagcaagacctgacaaattccatgacacgtaagatacatttctctgttactttttttgttgttgttgggtcagtatacttcttttatttatttatttatttaatttattaattgaaacaggrgtctcactctactgcccaggctggagttcagtggcaagatctcagcccactgcaacctccgtcccctaggcccaagtgatcccccaacctcagcctcccaagtagctgggaccacaggtgtgtgcaaccacacctggctaattttttttgatagagatggggtttcactatgttgccaggctggcctcaaactcctgagctgaagcgacccacttgccttggcctcccaaagcgctgggattacaggtgtgagccaccacgcccagccacaactttttaacatgttttatatatttagga

SEQ ID NO: 170012 - DNA, 601 bp, Human
cttctatatcataagttcttcaaaggcacttactatatcccttaaagcttcgaatgggataaaatgaatggcaataatcacaccaggaattaagctcatttattctgcaaagcagcagcctgttgtcaaatgctaacccgctccttcacagccctcataaaaagaataggaaagcatataaatgaagcagcacaccagaggaacatacagtgtgagcaattatgccaattccttttataggaagaacgcagctgagataaacatggaagcagattatttaccatccacgggtctcgttgcyaaattcttctaaatttttcattaaaagaaatcaaggaaggtaaacaaagtagcccttgggaggaatcagtgtaaacagctcatatatcagcatggcctcagagaaatgtctatcttttttaagtgcatccttttgggccaaacacgtgtccacacacttgggtgcacacacacagccacatctccaagtgtgcacagccgtgcaaaaccttggcttccaggtggaggtgaagagggcaggctaggtgggaggcacttaccttcagggcatcctgggtgtcatccagacagtagactcgga

SEQ ID NO: 170013 - DNA, 601 bp, Human
tagccaggatggtcttgatctcctgacctcgtgatccacccgccttagcctcccaaagtgctaggattacaggcgtgagccaccacacccggccgagggtctttatttattgtttgcttctgtgtttattcacgctgttccctccacctagaaatcttgtatttttccctctactattgctggtcaaaacccaatcctccattagggccaatcatcaaatattagctccttttcagatttcctcaaagtaatgatgcctccgtctcctgagctcccatatagcactttgcatgtcagccaytgtggcatttctcaccctctgacttacctcctcaaccttggcatacttcttttattcctccttctatatcataagttcttcaaaggcacttactatatcccttaaagcttcgaatgggataaaatgaatggcaataatcacaccaggaattaagctcatttattctgcaaagcagcagcctgttgtcaaatgctaacccgctccttcacagccctcataaaaagaataggaaagcatataaatgaagcagcacaccagaggaacatacagtgtgagcaattatgccaattccttttatag

SEQ ID NO: 170014 - DNA, 601 bp, Human
taggcttaccagaaataatatgcctgcagagagtcttcttttttttttttcagacagagtttcactctgtcgcctaggctggaatgcagtgaggcgatttcggctcactgcaacctctgcctccccagttcacgccattctcctgcctcagcctcctgagtagctgggactacagatgcctgccatcatgcccggctaatttttttgtatttttagtagagacggggtttcaccgtgttagccaggatggtcttgatctcctgacctcgtgatccacccgccttagcctcccaaagtgctrggattacaggcgtgagccaccacacccggccgagggtctttatttattgtttgcttctgtgtttattcacgctgttccctccacctagaaatcttgtatttttccctctactattgctggtcaaaacccaatcctccattagggccaatcatcaaatattagctccttttcagatttcctcaaagtaatgatgcctccgtctcctgagctcccatatagcactttgcatgtcagccactgtggcatttctcaccctctgacttacctcctcaaccttggcatacttcttttattcctcct

SEQ ID NO: 170015 - DNA, 601 bp, Human
tccgtggtactttgtcagagctgcccaaactgtctaagacaggcacaatctctacaccccaaggcatcctgacccctgagtttgcttctatgactcagaggcaggaacttgaccttccgccccatccattgagcgctcgtcatgggattctcgaaaggccacttgaacaggactttttaggcttgttctctccatctcactcccctgtcatcattcagctccatcacacgttcctgcatactttgactcaccttttcactgaagtcaggctgatatttctaatatgtattttcaatcatgycttttttctgtttaaacctctccaatctccattaactcaagaactgaatctcagctcctctctctggccgtaaaggtccatctagacaaaattcctatctattattctaggcttaccagaaataatatgcctgcagagagtcttcttttttttttttcagacagagtttcactctgtcgcctaggctggaatgcagtgaggcgatttcggctcactgcaacctctgcctccccagttcacgccattctcctgcctcagcctcctgagtagctgggactacagatgcctgccatcatgccc

SEQ ID NO: 170016 - DNA, 601 bp, Human
tgccccaatacctagaccaattagatcagaacctgtgggagtgaggccctggagtgggtttttataaaagcttccacctgcttcctctgtgcgctgagaattcctgattttggaagagcatgagcgtgagtcaggatgggggcaggcctgaaggagaaggaggccttcaggaggtgtgttgcaagaggaagtatttctgggcaacagtggttagagaagtagcgagatgggagagagtatgttgggaacattagcagggcgccaagaaggcagagttttagtaataaagggctttttgagytaatcagccccaaatttccaattcaagcgtgggtgtgaggaagagatggcgtgactgaaataattgtctcttcggtatgttggagaggccatttgcctataactaggattttggtatttctgcattattaaaaggccatgaggtgcaagaaagcctcatccattattcatgtttgtttcaggctaagtgctagatccccagatgctgagaatttataaatgtctatttagaaagcattgaccatgatacaaactgctcttgagttgtttttgctgcttaaacctgttcatcactctttct

SEQ ID NO: 170017 - DNA, 601 bp, Human
agttccaaaaagatttgggaaagtgtttaggataatagctcttaactttggtggcacaatagaataacccagggagtattaagaaaataaaatgccccaatacctagaccaattagatcagaacctgtgggagtgaggccctggagtgggtttttataaaagcttccacctgcttcctctgtgcgctgagaattcctgattttggaagagcatgagcgtgagtcaggatgggggcaggcctgaaggagaaggaggccttcaggaggtgtgttgcaagaggaagtatttctgggcaacagtrgttagagaagtagcgagatgggagagagtatgttgggaacattagcagggcgccaagaaggcagagttttagtaataaagggctttttgagctaatcagccccaaatttccaattcaagcgtgggtgtgaggaagagatggcgtgactgaaataattgtctcttcggtatgttggagaggccatttgcctataactaggattttggtatttctgcattattaaaaggccatgaggtgcaagaaagcctcatccattattcatgtttgtttcaggctaagtgctagatccccagatgctga

SEQ ID NO: 170018 - DNA, 601 bp, Human
agatgatgtgaatgctactagaataagtttgggcagagagactgtgatttaagtcatgacactgaatttgagggaatgatgggaataaaatggatggaaagacagaccacaaggcaagtactggtagggcaggatccacagagctctgtgcaaaggaactgaagtgggcatgagtagaagtagaaccatccagcctgggcagtgaagagatgccccagaaagggtcatggggtatgagaagtactggcacatttcctcttggccttggggtttgttaggggtacagtcttcgctggaggcrttgtgaggtgttaccaggaagatccactggcagttaatgagagcaggtggagcaatgggaaagggaatgacgtgaggttgtaggaaagtttgttcttagtagaattaaagttccaaaaagatttgggaaagtgtttaggataatagctcttaactttggtggcacaatagaataacccagggagtattaagaaaataaaatgccccaatacctagaccaattagatcagaacctgtgggagtgaggccctggagtgggtttttataaaagcttccacctgcttcctctgtgcgctgagaa

SEQ ID NO: 170019 - DNA, 601 bp, Human
gatggaaggtcagatggttgtagtcagaaagggggagtctgacaggtggagatcttggcagtggagcaattgctaatgaagatgaaatccagagcacatctatgccagtgaatagataatgtaagatgatgtgaatgctactagaataagtttgggcagagagactgtgatttaagtcatgacactgaatttgagggaatgatgggaataaaatggatggaaagacagaccacaaggcaagtactggtagggcaggatccacagagctctgtgcaaaggaactgaagtgggcatgagtagmagtagaaccatccagcctgggcagtgaagagatgccccagaaagggtcatggggtatgagaagtactggcacatttcctcttggccttggggtttgttaggggtacagtcttcgctggaggcattgtgaggtgttaccaggaagatccactggcagttaatgagagcaggtggagcaatgggaaagggaatgacgtgaggttgtaggaaagtttgttcttagtagaattaaagttccaaaaagatttgggaaagtgtttaggataatagctcttaactttggtggcacaatagaataacc

SEQ ID NO: 170020 - DNA, 601 bp, Human
ttctatctctgccctagtccagcatttctgtggatttttctgcaatttgtaaagaatccccagcacatagcagttactatacgaaaatatcaaatgctggtaaatgcagcctcaggcatcatttgctatgctgaagatggaggtggtcaggaattggattaaagcacaaacaaggaagcagagatccttttcatcagagtcagatgaagtgagaagaggctgaagtaaaaggtttggagagtagaggaccgcagctgggggagctttcattgagtggttaggtcactgctaggcaagatgygggctttaaaacagccagggacttcctgagagcagaagatacatggaagaactgccgtgggaatcgggtaagtcaagaagagctaaataaaaggattacggagaagcagggaaggcatcccttagaacaggtatcttgagagtataatagacccaatcagaaatgtatgatttttcatagcaactcatcaacctggaagtagaagtagtgggcttattcagtggagggtatccttggttataaattagaaaaggctgcagcagctcataatgacgagagagttcagtgtggaagcgagtt

SEQ ID NO: 170021 - DNA, 601 bp, Human
ggcagtctttttgcaatagctctcctggactcattccctgagaataagtactccactgggcttctatctctgccctagtccagcatttctgtggatttttctgcaatttgtaaagaatccccagcacatagcagttactatacgaaaatatcaaatgctggtaaatgcagcctcaggcatcatttgctatgctgaagatggaggtggtcaggaattggattaaagcacaaacaaggaagcagagatccttttcatcagagtcagatgaagtgagaagaggctgaagtaaaaggtttggagrgtagaggaccgcagctgggggagctttcattgagtggttaggtcactgctaggcaagatgtgggctttaaaacagccagggacttcctgagagcagaagatacatggaagaactgccgtgggaatcgggtaagtcaagaagagctaaataaaaggattacggagaagcagggaaggcatcccttagaacaggtatcttgagagtataatagacccaatcagaaatgtatgatttttcatagcaactcatcaacctggaagtagaagtagtgggcttattcagtggagggtatccttggtt

SEQ ID NO: 170022 - DNA, 601 bp, Human
aagacgggggaaaaagaaaagctctgatataccaaactcaaccttttcaatagacttgacctctctatttgaattgattccaaactattctcacaattcttagcatctttatccttttatgtgaacacaactagagcattgctcccagtggtccttcaagcacatgcacaggaaaaagccctcctgaaaggtataaaataattccactgttgcccatcagccttgacttttgctctggtagtcactgccaacatgctaattctgtatcagtgctttcaaattgctaaacacagcttttaartttcaggtgaccatttttgccccaaggcttaacaaaaccctggaaaattgttacaaaagctgccaagctcaaagaggtgagtagggagaagaaaaaatgcatcacagttgcttaagactgagtgtgttatccatccatatggataatataaataaatgtacaaatatatattatatttatgtaatatataatatatatttatatattatatttatgtaatatataatatatattatatattatatttatgtaatatataatatatattatatattatatttatgtaatatataatatata

SEQ ID NO: 170023 - DNA, 601 bp, Human
gttatgttaatacacattatttgatttatatcacaaatacatttgtcagaaattcaataaatatcatacactgcccataatgtatgaaaataactccttttttaggttctgaatctcagagtttagtataaaaccctttattccaaaaagagactgtcaggtattgtaccctttggatactgggacagaaatgacttatttccacatagacgtatgtttctcctaggtgtttttaaacttactccaaatataaccttgctcttggttaatttctggtctatttatactaggatttaagtcwttgcaaataatgaaaggaaaacacctttttcattaatcacctgaagacgggggaaaaagaaaagctctgatataccaaactcaaccttttcaatagacttgacctctctatttgaattgattccaaactattctcacaattcttagcatctttatccttttatgtgaacacaactagagcattgctcccagtggtccttcaagcacatgcacaggaaaaagccctcctgaaaggtataaaataattccactgttgcccatcagccttgacttttgctctggtagtcactgccaacatgct

SEQ ID NO: 170024 - DNA, 601 bp, Human
tctttcattcttctcttctcttttcacataatacaagctttcacagagttactctattacagttgggattagggcacatgaaatttatccaaggaaggtcttctccatgcccaatgagtccatcaaaaaaaaaaaagccaggttatgttaatacacattatttgatttatatcacaaatacatttgtcagaaattcaataaatatcatacactgcccataatgtatgaaaataactccttttttaggttctgaatctcagagtttagtataaaaccctttattccaaaaagagactgtcakgtattgtaccctttggatactgggacagaaatgacttatttccacatagacgtatgtttctcctaggtgtttttaaacttactccaaatataaccttgctcttggttaatttctggtctatttatactaggatttaagtcattgcaaataatgaaaggaaaacacctttttcattaatcacctgaagacgggggaaaaagaaaagctctgatataccaaactcaaccttttcaatagacttgacctctctatttgaattgattccaaactattctcacaattcttagcatctttatcctt

SEQ ID NO: 170025 - DNA, 601 bp, Human
ctgccttacttcttccctaataataacaaggctggactctggtgcccatctgcaaacatctccccgtcaagttgcttcgtttctagggctctgcctgctgttcccacagctgctgtggccacggatgcttggtctgagctgccacttccagcctgcacagtcagggcagtttgtgacacttttaaagccaaatgccaacgggtggtgctcaggcaagcagcgtgtcacttgtctacctctgggcgtgctcttaggacaacagttctctctcacatctatgtattaggaacaggactttgtmggtttttctaggacttttgaagtcatcttgtgtttcttttctcctgttaacacattatttttaaacttctatattagttttctactgttgccataagaaatcaccactaacatagtgacttaaaaaataacacaaactgattatctcacagttctggagggtgggagtaacacagttctcgttgagttaaaatcaaggtgtgtcagtggggctgccctcctctccagagccccgagaggagaatctgtactgggtcttctccaccttccagaggtttctcacattctttggctcacggtc

SEQ ID NO: 170026 - DNA, 601 bp, Human
tggatgaagctggaaaccatcattctcagtaaactatcacaagaacaaaaaaccaaacaccacatgttctcactcataggtgggaattgaacaatgagaacacagggacacaggaaggggaacatcacacaccggggactgttgtggggtggggggaggcgggagggatagcattaggagatatacctaatgtaaatgaggagttaatgggtgcagcgcaccaacatggcacatgtatacatatgtaacaaacctgcacattgtgcacatgtacccgagaacttaaagtagaataaaaaawttttttttttgtcgggacaaagtcttgccttgttgctccttgaactcttgcactcaagtaaacttcccacttcagcttcccaaagtgctgggattacaggcatgagccactgcgcccagccccccttgtacagttctatctgcacccctctaacttttccttgcaaagacaccctcaagagtaggtcatcaataaatgtgtctgtagcccatgcacatctacacacgcgaaccatcagtcaccagaagcaggccacctgcctcagagcccagcgtccgccagggatctgagcaatcctgt

SEQ ID NO: 170027 - DNA, 601 bp, Human
tgaataaagaaaatgtggcacatatacacacgaaatactatgcagccataaaaaatgatgagttcatgtcctttgtagggacatggatgaagctggaaaccatcattctcagtaaactatcacaagaacaaaaaaccaaacaccacatgttctcactcataggtgggaattgaacaatgagaacacagggacacaggaaggggaacatcacacaccggggactgttgtggggtggggggaggcgggagggatagcattaggagatatacctaatgtaaatgaggagttaatgggtgcagcrcaccaacatggcacatgtatacatatgtaacaaacctgcacattgtgcacatgtacccgagaacttaaagtagaataaaaaaattttttttttgtcgggacaaagtcttgccttgttgctccttgaactcttgcactcaagtaaacttcccacttcagcttcccaaagtgctgggattacaggcatgagccactgcgcccagccccccttgtacagttctatctgcacccctctaacttttccttgcaaagacaccctcaagagtaggtcatcaataaatgtgtctgtagcccatgcaca

SEQ ID NO: 170028 - DNA, 601 bp, Human
attttggttatttatatgatacagatatgtaagaggacagaaaaataacaaatatacaactcaataagacatggctttacagttcaatgttttcctctgcttcctctccctgggaacattcattcaacatcagtgagacacgttaggctgccaggaaccatgtcaggtctggagcacacagacaagtaagtccctgtcactgctttaaactgctaatgggctaatggttcatgggggttggggggtgacctgtaaacatgtaaccacaacacagtgtgctcaggtctaaaaccacttccaracaggctgctcttgaatcacaaaggttaggatatttcacacaccttaaaatagaatatgaacaaaatatatttaatgtcagaagatttaggaagacttaagagaaatatcgtgaccctggaaagaaatgctatagtaaggatgcggatcatctggcctctttgttctcagaaacctgaacgtcaagttcctttgcagaagttgtccttcctactgggagttcccccacctcagtggcctagtttggctctaggtgaatccacctgttgctttgatgagcttgttttgcttctgtgagaag

SEQ ID NO: 170029 - DNA, 601 bp, Human
gagtgcagagtcttcatgggagtcagcccaagaatcaggctcagttttttgtttcttcagcaatgatttgaaaagtcatggtgaagaattctccctagtggggaaaaagcctagactggcttggaggagcccttttttggatagaaagtaccaagtgccattttaaagacagtggggccacagaacacactccttccatagacttaagctcgccatttctccatcacccaggagtgacacaaagctgcagcacagggctggaaggaacctgacttttttctcccttccaatgggacataarccctggggaaagacaaactgcccatcaggacacacccatgcttagagcagaggctataaacatgtttgccagaatagtctaccagtcaaaacattgagcatgcatatttataaattacatatctctattatcagtatgttaatatattgcattataaaatatacataaaatttaaaaatacataagatcctgtattaatctgtcttagcataaagctaagtactaatactgtattttttttggtcccagtggttcactgggcctggggtgtgtaaactccatattggagactgctggctc

SEQ ID NO: 170030 - DNA, 601 bp, Human
cctgggatgtctaaaagaagatgcattgtattccaggaggtaattgtacccaacaatgtataatccacaccccattcctacaatcaacatagactgccagaggatatgaagagcattatcagttttcttggcaggcaggacattgaaaaaaacccaaactgcctattggccatgaccttgaagtcaggaaatctaacacggcattttgagtgcagagtcttcatgggagtcagcccaagaatcaggctcagttttttgtttcttcagcaatgatttgaaaagtcatggtgaagaattctcyctagtggggaaaaagcctagactggcttggaggagcccttttttggatagaaagtaccaagtgccattttaaagacagtggggccacagaacacactccttccatagacttaagctcgccatttctccatcacccaggagtgacacaaagctgcagcacagggctggaaggaacctgacttttttctcccttccaatgggacataagccctggggaaagacaaactgcccatcaggacacacccatgcttagagcagaggctataaacatgtttgccagaatagtctaccagtcaaaaca

SEQ ID NO: 170031 - DNA, 601 bp, Human
tcttcattatgtcgaaattatctccctgggatgtctaaaagaagatgcattgtattccaggaggtaattgtacccaacaatgtataatccacaccccattcctacaatcaacatagactgccagaggatatgaagagcattatcagttttcttggcaggcaggacattgaaaaaaacccaaactgcctattggccatgaccttgaagtcaggaaatctaacacggcattttgagtgcagagtcttcatgggagtcagcccaagaatcaggctcagttttttgtttcttcagcaatgatttsaaaagtcatggtgaagaattctccctagtggggaaaaagcctagactggcttggaggagcccttttttggatagaaagtaccaagtgccattttaaagacagtggggccacagaacacactccttccatagacttaagctcgccatttctccatcacccaggagtgacacaaagctgcagcacagggctggaaggaacctgacttttttctcccttccaatgggacataagccctggggaaagacaaactgcccatcaggacacacccatgcttagagcagaggctataaacatgtttgc

SEQ ID NO: 170032 - DNA, 601 bp, Human
agaacctgttttagacatttagttcaatctcttatagttacttcaagtacagaaataaaaatataaaaagtttgcttaaaatgatttatgcataattcccaattattaaaaaaattagaatatgctaattatatattctattaaaggaaaatattccgatacagattaggaaggtttttaaacaccaaatattgaactaaacagttactccaattacattttcaaaagaatatttttgtttctcgagaattgtggctgatgaaaaaatttgctacataattttcttatactatacagataacaacataaagacagattctatatatacttccatttctcaggctagttaatgggagttaatgaagcatttccaactgcagctgtaattatccaaacagcagcaaaccattagttatcaatgaacaaactatcttgggtctcctctgctgtctgaaccatccctatgcacgttactcctctcatgccttaaaagttttaatggtacaaatacacaggaaatttgtgacccattttaaaataagggtccaggaatatatggattttagaaaaaaagcaaaatataattttttctttggtgcta

SEQ ID NO: 170033 - DNA, 601 bp, Human
cattccctcaaatatgtctgtgtttctcaaaaatcctaaataaccccaaactattttggagaaacaagtaatgacatatgattaatttcaaggaaggggatttcctatgtctatataattttagacctctttcttagagatgtctccagaccttttgttcggcttgggaaccttacctgatatttagccagcaatttgctcttccagagggaatgggcgatatcgtgaattgacaggcgcaggttgtgggtgctgcctttaaaatgaagagccttaggttcttctaggagctgtcctcccrtctgtctctcaagatgtaaaatttcctataatgacatgccccaaacccaaagcacgttattgatttggatcacttctgtcagctctctcattgaataagtttctttactgcctcctgaatggcaggcggaacttgtgcaacaccttgaacacccacttttgcagcctcgagaccctctaactaaactaactaaagcccctcccattttgtatgggaccagaccctaataacaaactatgttttggcagtctacatcacactgttgaggagcaatttcatacagtttgccctttaccgact

SEQ ID NO: 170034 - DNA, 601 bp, Human
aagaaaaagggagcagagaagcccctctcctttcttccactccacccagcagcaggtgattaggggaaagggaggagagttgctgagaaagaagcagaaagggaggagagacagatggaggatgggggaacatggcacgctaagggatgcatggggagaagttactccatgtgcacgctccttaaattaaacctttacttgaaattcagatctgtttttacaagttagaacataattcttaaaattcatgtcataaaaattaagacttgtttttcaaaaaggatcccttaatatatatatwtttttttctgcagctagcttccattgctcattacaaatattattctattaacaaataggatctatagaaagcttttgaggacttcccatatggactatgttgagatacccttttagcccacacactctgtcttcctgagtgtcgcactctcccctgatttcagacagacaggagccacttacctctgacacggtgcagttgagctggaagatctgcccttctccttccacctgccgcacacagagtttgcaaaccagctccactgtgttcaggctaaatctttccagagtgaaggtgcag

SEQ ID NO: 170035 - DNA, 601 bp, Human
acttctatttgtggcatatttcccccatcccggaggaaagtgtatctctctttatatttagagaatgatagagagaaaggagatcaagagatttctcctttcttcctttgaatggagaagaagaaaaagggagcagagaagcccctctcctttcttccactccacccagcagcaggtgattaggggaaagggaggagagttgctgagaaagaagcagaaagggaggagagacagatggaggatgggggaacatggcacgctaagggatgcatggggagaagttactccatgtgcacgctcyttaaattaaacctttacttgaaattcagatctgtttttacaagttagaacataattcttaaaattcatgtcataaaaattaagacttgtttttcaaaaaggatcccttaatatatatatttttttttctgcagctagcttccattgctcattacaaatattattctattaacaaataggatctatagaaagcttttgaggacttcccatatggactatgttgagatacccttttagcccacacactctgtcttcctgagtgtcgcactctcccctgatttcagacagacaggagccactt

SEQ ID NO: 170036 - DNA, 601 bp, Human
ccctgttatccttatggcatcagtggcaccagtaaaaatggtgaacatagattaagcatgtgctctgggccaagttctgtttagaacacttacttactaacaaacattctcccatttaattcccacactggcccaagataatattctataccaatttacaatggggaaactgaggcaagaaaggattaagtaattggccctatctatctccatggaacagcctacttgggaatttcccatgatggatgtctgcctgtaactgaaacaaaatagaagatgtgaaaaaactgtaaatttatcmtctgtcctctgcaccatgttttcttttcttttggagataatgagtagcttcctggttactctctctgcacttgtctatgaaaccaacaaacaaaatcttttatcatcttttacattttgacattcatttgtgtcaatacagttagttagtcttccagacattttccttcttaaacttcatctctgtgaaattaattaaagcctttgtctctagttaaggaatccctggctaaatcacccagagacaactggctggcccttgaaataatcagagtacatgtcacgcacagcctggtctctg

SEQ ID NO: 170037 - DNA, 601 bp, Human
gactgctgtgctagcaatcagcgagactctgtgggcgtaggaccctccgagccaggtgcgggatataatctcctggtgtgccgttttttaagcccgtgggaaaagcgcagtacttgggggggagtgacccgattttccaggtgccgtctgtcacccctttctttgactaggaaagggaactccctgaccccttgcacttcccgagtgaggcaatgccttgccctccttcggctcacgcacggtgcgcgcacccactgacctgcgcccactgtctggcactccctagtgagatgaacccggyacctcagatggaaatgcagaaatcacccatcttatgcgtcgctcacgctgggagctgtagactggagctgttcctattcggctgtctctctctttttaaagcacgtaacttgttggtgttcctcactagttgccagaggatgaactaactggccacacccagtttcagccatcatgaagtgtttggttcctgctgagtgctcagctcaggggctcaacaccaccatcatcacccagagcgccccccatatgctgccctgcaccgcttcagtggcctccccagccgtgaatgcactggcac

SEQ ID NO: 170038 - DNA, 601 bp, Human
gctgctttgtttacctaagcaagtctgggcaatggcgggggcccctcccccagcctcgctgccgccttgcagtttgatctcagactgctgtgctagcaatcagcgagactctgtgggcgtaggaccctccgagccaggtgcgggatataatctcctggtgtgccgttttttaagcccgtgggaaaagcgcagtacttgggggggagtgacccgattttccaggtgccgtctgtcacccctttctttgactaggaaagggaactccctgaccccttgcacttcccgagtgaggcaatgcctygccctccttcggctcacgcacggtgcgcgcacccactgacctgcgcccactgtctggcactccctagtgagatgaacccggtacctcagatggaaatgcagaaatcacccatcttatgcgtcgctcacgctgggagctgtagactggagctgttcctattcggctgtctctctctttttaaagcacgtaacttgttggtgttcctcactagttgccagaggatgaactaactggccacacccagtttcagccatcatgaagtgtttggttcctgctgagtgctcagctcaggggctcaac

SEQ ID NO: 170039 - DNA, 601 bp, Human
ggaaacagcctgaccttgaggagaaagtcctgggcaaatgctccagtagttctgctaaactccacagaagatgtctcagttctgcttttgttgaatgaactggaacatagctctcctctaaatgatatcaacttaaggctaatttcttaaaaaagaaaatggtaaacacagtatattattgccttagggcaagttgttaatggcatcctccaattgctgtatatccttattttttaaaaatctaattttagtagagaaaaccataaattggctcttaagatagtctcagctcataaaacarcacaaatgcaaaatctgaatttcatctgcaggagaaattctaatcattttctgatcacttgtgctggttggaaaagcaaaagcaaatggtgcctgggaactattaaagcaataaaagaaaatctacttaatctactataaatgccatctctctctattttttttttcttttttatttatttattattattatactttaagttttagggtacatgtgcacaatgtgcaggttagttacatatgtatacacgtgccatgctggtgcgctgcacccactaactcatcatctagcattaggtat

SEQ ID NO: 170040 - DNA, 601 bp, Human
agctaaccctacgtctaatagttatcggtcctggagggcactaacagaaagaagctagtcttggggccagaccatacccacctgtccaggttcagcttatgggccagcatcctccagtcatggcctctcgtctggggggcatccaggctgctacagagcttctgccggatagggagagggatgctgaaagcactgggccccgtgaccgtggtgatggtgttcgcaggatccagcagcggcaaatcgatgccagtaggttcctgtagttcagggacaggaacaacacagcattatttctgargacaaaagcaatctctattgaaccaatcaacataatgccttgctttgagtgataagaaaagaatgaatgctgttattcttcttaggaagaatggcttcttcttagcctgaaagttgtgcatcactagatgtaacctggctcagagatagaggtacatacattttgagctaactttgcatagcctcagatttgtgagtctttggtgaggactgggctggatggaaagctctggtgtgattcgataacagctttactaatgggattctccaggctgagagagaagagagggaatatcagagc

SEQ ID NO: 170041 - DNA, 601 bp, Human
gtgttggcatgctaattattaatcaaacattaggtcctgctcaactgcagaggaggagcaataactacggtagtgaatggctatatgatttggggaatttagcccatcagcttggcaaagtgcatcacaaaacttgatacttaccaatgccagataagctcagaatgtctcttagcactctttgcaagcccgtagtgcaaggtacaaggacagagcttaatgcatatttgcaaaatgaaaaattaaatagatgtgtggatggaaaaaaaaatgaagctaaccctacgtctaatagttatcrgtcctggagggcactaacagaaagaagctagtcttggggccagaccatacccacctgtccaggttcagcttatgggccagcatcctccagtcatggcctctcgtctggggggcatccaggctgctacagagcttctgccggatagggagagggatgctgaaagcactgggccccgtgaccgtggtgatggtgttcgcaggatccagcagcggcaaatcgatgccagtaggttcctgtagttcagggacaggaacaacacagcattatttctgaggacaaaagcaatctctattgaaccaa

SEQ ID NO: 170042 - DNA, 601 bp, Human; identical to SEQ ID NO: 85381

SEQ ID NO: 170043 - DNA, 601 bp, Human; identical to SEQ ID NO: 85382

SEQ ID NO: 170044 - DNA, 601 bp, Human; identical to SEQ ID NO: 85383

SEQ ID NO: 170045 - DNA, 601 bp, Human; identical to SEQ ID NO: 85384

SEQ ID NO: 170046 - DNA, 601 bp, Human
aggccgaatttgggattgtttggaggatagaggcatctaatgaaaggtccctgctgggaatatggaacaaaaagaaggttctccctcgtgggtgggatttccatccaggcggatgattcaatagctgcacccacctccttaaattcctggatttgggtctgttcgaacatggagaacacgttggagttggcgcccccggctctcttctttgctttcttaggtgcctgggggaaaaaagcatcgattaaaagagtgagaggctgggagtcaaaaaactaggtcaggcccctactctgggtgwgttcatctctgttgcagggctcagctgcccatctgtgaaatgtgggtacagcatccacactcaggtctccaaacggtgatgctggagggagcaaaggacatgacatgaagtttctccagagccctctggtaccagtggatcataagcgtttgtgcatcttgcagtggctccttcaccaactaggagaagccacaggtgtgtccctggggatggaggccacaccttcagatcgcccctgcaggatccagccacttttgttctgatgcatttcacaaaaagctcagtaatgcacagaaggag

SEQ ID NO: 170047 - DNA, 601 bp, Human
aaatggtttcccctttgatataaagcacactagggcagggtgtagtggctcatgcctgtaatcccagcactttgggaggtcaaggcaggagaattgctcgagcccaggagtttgagaccagcctgggcaacacagggggactcaatctttacaaaaatcacaaaaattagctgggcacagtggtgtgtacctgtggtcccagctactcaggaggctgaggtgggaggattgattaatctgggaggttgatgctgcagggagccgtggttgtgccactgcactctagcctgggtgacagagygagactctgtcacacgcacaaaaaaagaaagcagtctggtctctttagcatcattttagcatagttccctctggaaagccaggtgggaatgtggatgagtcagtgtgagccctcgcaacggctggaaaatgaattctgagcctgtccatccaagcccgtgtgcagtttggcctaattggtactttggttctcttcataaggtccattgccatcaaatgcgatggggtttcaaatggggctagtggttaataatcaaagactgtaaaatgtaaaacccagaagatactgcttttcacctct

SEQ ID NO: 170048 - DNA, 601 bp, Human
tttccccattttctgttgtgagctgacattgcattcaaaatcacacaaaaaagttatttcaagagaaaaaaaagatatctgaaggtactcaaagactaaacacttctttcccatcccctgaaatttgtcttaaagaccagttgtggcagagttgtttctttgggaaatgacaccatcttgagcttttctgatggtcccacctcctgctcctcatggatgtgagataaagagaccctcatgcagggctagagagggtgacataccaagggcagcaaaggtgtctctcagatcgttcttgtcratgaagccatccctgttctggtccatgatagtgaaggcctgtggaagggaagtgattggcagctcagcctgggagaaactggcagagttgcccaagagattgggccaaggacttggcaggagtggattctgggatcttcaaagatcattgtaggacctcagattaaaagtcaacaattgaagataatccaacagtttcttcaaaacgtcaggcctcgtgttatcatatgacccagacattccactgctagatatatacccaagagaattgaaaacatgtccacataaaagcctgtacaca

SEQ ID NO: 170049 - DNA, 601 bp, Human
gggtagcagattgggcatgtatattttgaagaaactccatgtactcatgctcacactgttgagatgatacattttagaagataaattcgaaagagaatgattccaataatttaaaaaactaaaacccaaacctaacagacatgtctagaaagacttagaggagggactggaatgttcacagtggaatatgaccttctgggtgatgtcattttctcctttatacttttctgcattttttccccattttctgttgtgagctgacattgcattcaaaatcacacaaaaaagttatttcaagagaaaaaaaagatatctgaaggtactcaaagactaaacacttctttcccatcccctgaaatttgtcttaaagaccagttgtggcagagttgtttctttgggaaatgacaccatcttgagcttttctgatggtcccacctcctgctcctcatggatgtgagataaagagaccctcatgcagggctagagagggtgacataccaagggcagcaaaggtgtctctcagatcgttcttgtcaatgaagccatccctgttctggtccatgatagtgaaggcctgtggaagggaagtgattggcagctc

SEQ ID NO: 170050 - DNA, 601 bp, Human
aagaaaaatctgtcattttttaagccaatgtatgttttaagtataaaaagctacactcactacaaatgtgaatacttccctgtagaattgtgcagtgcgcagtctgcacagctgtgtatggttgccctgagttctaaggtcaggagtaagtggtggtggcgggtagcagattgggcatgtatattttgaagaaactccatgtactcatgctcacactgttgagatgatacattttagaagataaattcgaaagagaatgattccaataatttaaaaaactaaaacccaaacctaacagacrtgtctagaaagacttagaggagggactggaatgttcacagtggaatatgaccttctgggtgatgtcattttctcctttatacttttctgcattttttccccattttctgttgtgagctgacattgcattcaaaatcacacaaaaaagttatttcaagagaaaaaaaagatatctgaaggtactcaaagactaaacacttctttcccatcccctgaaatttgtcttaaagaccagttgtggcagagttgtttctttgggaaatgacaccatcttgagcttttctgatggtcccacctcctg

SEQ ID NO: 170051 - DNA, 601 bp, Human
cttcaagaaatctagtctagaaatcatcagagatggggtggatggaggcaaagatcttttctgagaagatgttcttgacagtgttatttataataaccaaatgactggaagcgaccctaacatctgatgtgggaaggtgttcgttatttatttatttttctttgagacagggtctggctgtgtcacccaggctggagtgtagtggtacaatctcgactcactgtaacctccgcctcccaggttcaagcgattctcgtgcctcagcctcccaagtagctgggattgcaggtgcatgccaccrtgcctggctaatttttgtagttttttggacagacagggttttgccatgttgcccaggcaggtctcgaagtcctgggttcaagtggtcctccagcctacgcctcccaaagtgctgggattacaggtgtgagccaccatgccggccagttcattatatttaaaatagtgtcttcagaacctggaacatttgatgcagatattttcatttttcactcaaatgggaaaggctcatgttgtaaattagcccttcacagttggaggcgggagagacagatcaggatcacctgagggaacttttaca

SEQ ID NO: 170052 - DNA, 601 bp, Human
atacacacagacacacacacacacacacgaccttacccttaagtttctccccaaacattgtgaggaacacagtaaagttaattggacccggagcctccttgatcatttcatcaatttcttcatttttcacgttcactcgccctagggtaggaaacacacactcagggactccgagctggggagaaagaaccattatgacactgccattggctcctgggattccacttcaagaaatctagtctagaaatcatcagagatggggtggatggaggcaaagatcttttctgagaagatgttcttsacagtgttatttataataaccaaatgactggaagcgaccctaacatctgatgtgggaaggtgttcgttatttatttatttttctttgagacagggtctggctgtgtcacccaggctggagtgtagtggtacaatctcgactcactgtaacctccgcctcccaggttcaagcgattctcgtgcctcagcctcccaagtagctgggattgcaggtgcatgccaccatgcctggctaatttttgtagttttttggacagacagggttttgccatgttgcccaggcaggtctcgaagtcctggg

SEQ ID NO: 170053 - DNA, 601 bp, Human
gagggctgagaacccaaggtcaaacatcatctagatttgaaagcctgggattcaaatcttaaccctggcacttgctagccatgtggcctcagacaagggactttctgtctcttagtctcagttccccatctgtaaactggtgataagaatagagcatacctcctagttgctattaagtggggtaatgcatataaagtggttagcatgaggtctgacttaggttaagtcttggagcaatgttagttgctgtgtttttgttttgttttgttttgttttgagacagagtctcaccttgttaccmaggccggagtgcagtggcacaatgtcagctcactgcaacctctgacatcccggttcaagggattctcccgcctcagcctcctgagtacctgggactacaggtgcacaccaccatgcctggctaatttttttgtgtgtttttagtacagatggggtttcaccatgttggccaggttggtcttgaactcctgacctcaagtgatctgcccgcctcggcctctgaaagtgctggggattacaggcatcagccactgcgcccagccaagttgctgttttcattatttttttccaatggtgcttt

SEQ ID NO: 170054 - DNA, 601 bp, Human
tccctacctcatagggtggcagagaatgaaatgaggccaggcctcagaagacatagctggttctctgtcagtgtggggtcaggggtgctttagacgagaggggagacggagccccccagaaggagaacccaggagctgggttagagggagtgcttgaaggaccccattacctcctccttggaaaacctctccgcctgcgtggtcagcatttcccgaacgctgcagagaaaggaaagcaggtgttggtgtcagttgtgtgtgtgtaggggggacagggggcaagcagggaacccccttcctcccccacagaccccactcactaatcagccttcagcacccctttgccttcagggtcaaacactttgaatgcgttgagaatggtttcctcagggtccgctcctgaaacggaacacagggcttacatgtactgggggtggctgggaaccactggcaccccaggcagcagggcccaagttcccccagagatgaaggggccagagcaaggctgctttgcatggaggaaaaagaccctgctttcgtctgatcactgagcctctgtatttcgaagagagggctgagaacccaaggtcaaacatcatct

SEQ ID NO: 170055 - DNA, 601 bp, Human
ttgcctatctgtaaaatggcagttatgccagtccctacctcatagggtggcagagaatgaaatgaggccaggcctcagaagacatagctggttctctgtcagtgtggggtcaggggtgctttagacgagaggggagacggagccccccagaaggagaacccaggagctgggttagagggagtgcttgaaggaccccattacctcctccttggaaaacctctccgcctgcgtggtcagcatttcccgaacgctgcagagaaaggaaagcaggtgttggtgtcagttgtgtgtgtgtaggggrgacagggggcaagcagggaacccccttcctcccccacagaccccactcactaatcagccttcagcacccctttgccttcagggtcaaacactttgaatgcgttgagaatggtttcctcagggtccgctcctgaaacggaacacagggcttacatgtactgggggtggctgggaaccactggcaccccaggcagcagggcccaagttcccccagagatgaaggggccagagcaaggctgctttgcatggaggaaaaagaccctgctttcgtctgatcactgagcctctgtatttcgaagag

SEQ ID NO: 170056 - DNA, 601 bp, Human
agtatgtggcggcccttcacgccataataatgtcatgctctaagcaggtctctatgcatcgtgagcaaggcagaacctgcagtcacgcagacctaggtttgaatctaggtcctggcatttactattagtgttgttattttattttatttttgagacagagtcttgctctgttgcccagactggagtgcagtggcatgatcttggctcattgcaacctctgcctcccgggttcaagcgattctcgtgccatgcgtcagcctcctgagtggctgggaatacaggcgtccaccaccatgcccarctaatttttgtatttttagtagagacagggtttcctcatgttggctaggctggtctcaaactcctggtctcaagtgatcctcctgccttggcctcccaaagtgctgggattacaggtgtgattattgttattttagatgagtgactttacttccctgggtctcagtttgcctatctgtaaaatggcagttatgccagtccctacctcatagggtggcagagaatgaaatgaggccaggcctcagaagacatagctggttctctgtcagtgtggggtcaggggtgctttagacgagagggg

SEQ ID NO: 170057 - DNA, 601 bp, Human
caacaaatacacagtctgatgacttttatgaaactgacatttagaagaattgttcagtgcacaactcacatgacagtatgtggcggcccttcacgccataataatgtcatgctctaagcaggtctctatgcatcgtgagcaaggcagaacctgcagtcacgcagacctaggtttgaatctaggtcctggcatttactattagtgttgttattttattttatttttgagacagagtcttgctctgttgcccagactggagtgcagtggcatgatcttggctcattgcaacctctgcctcccrggttcaagcgattctcgtgccatgcgtcagcctcctgagtggctgggaatacaggcgtccaccaccatgcccagctaatttttgtatttttagtagagacagggtttcctcatgttggctaggctggtctcaaactcctggtctcaagtgatcctcctgccttggcctcccaaagtgctgggattacaggtgtgattattgttattttagatgagtgactttacttccctgggtctcagtttgcctatctgtaaaatggcagttatgccagtccctacctcatagggtggcagagaatga

SEQ ID NO: 170058 - DNA, 601 bp, Human
tttttagtaaaatgtggaacttgatggaaacaggcctgtgaggctatgaggggagcatttaaaatcgactcattaaggttcactaataaggttgacggcaccattgcttgctcatacagaagctttggcaaattagcaaaagtgccccttctaccaaactcactaccgcaccacctgagttgaaaaaaaaaaaaattattaccagacactttactgccagttctggaaagctgttgcaacaaatacacagtctgatgacttttatgaaactgacatttagaagaattgttcagtgcacaaytcacatgacagtatgtggcggcccttcacgccataataatgtcatgctctaagcaggtctctatgcatcgtgagcaaggcagaacctgcagtcacgcagacctaggtttgaatctaggtcctggcatttactattagtgttgttattttattttatttttgagacagagtcttgctctgttgcccagactggagtgcagtggcatgatcttggctcattgcaacctctgcctcccgggttcaagcgattctcgtgccatgcgtcagcctcctgagtggctgggaatacaggcgtccacca

SEQ ID NO: 170059 - DNA, 601 bp, Human
ctaacagacaaggtagggacagaggcggtactcgggggagagagatgagggcagggaccactctgcaaagacgagcccagggcgcagcagcgagccccctcctagtccttctcttctccgtgggtgatgatgtgcaccaggttcttgtagtccaagttgccagtcacgtcaggggggaaggcggcgaacatctggtcaacctgcaatgagccagcaacacgtgctaaggacgaggggaggggaactgagacggagggtggggggctgtgggcggggcctgagtggacggatagctggggggtgggggatgggaacatgggccactcagagggtcctccggggaaggacttccccagctgctgcagggccccctcgcccaaggtcatgccctttctggggcagcccacagccagcggatgggattggtgtgggggtataaaggcacggccatctcgcccaacttggtacctctcaggagagctgtagaataagctccctccctgggtagtcagcagtgccgatctttgggcctaaatcttggctcaacttcttccttcatgcacttttccttccttgcccttccctgttcttcctttcttgc

SEQ ID NO: 170060 - DNA, 601 bp, Human
aagaggtacatgtcacatccatctgcctcttagggctgttgcaaagataattaaagaatacaatacacaaaaggtgcttagtacagtgctgggatataggaagtgtccaaattttagttatgactatggttagggggcacttcaatggatatcgttccaaaagggaacaatttaattaacccagggaccgtccagcgttgctggggacccagtccctgcctttacgaagcccatagggaagcaagtgagacaaacacaccactcgactatctcgagagggagacgcgccaggtataaactraatgccctcagacggcacagggagggaggttcggggcagggcttccctgagataacaaacgggaaggcctctcaaaggcggatgggaaagagagggatcccgattacctctccgtgtcttcctgggcaacagccctcgccgcgggcttttcccgggccagtgctttgggaagggaagccctccgggcccagacccggctacagggaatgcggcgaggccgcgggactcacccgcggcgctgaagccgaagccggcggggacaggcgagtgttccgcgagctccaatcggataacaaccag

SEQ ID NO: 170061 - DNA, 601 bp, Human
tactatctacacatccacttccgcagataaaatgagctggctggccgggtgcagtggctcatgcctgtaatcccagcactttgggaggtcaagaggttgagaccatcctggctcacatggtgaaaccctgtctctaccaaaaatacaaaaattagctgggtgtagtagcgtgcacctgtagtcccagctacttgggaggctgagagaggaaggagaattgcttgaaaccaggaggtggagttgcagtaagccgagatcatgccactgcactcccacctggggacaaagtgagactgtctcaaaaaaaaaaaaaaaaaaaagaaaagaaagaaagaaaaaatgagctggcagagcaggggaaggcacgacatgtttatttggacacattaatgatctgccactgaactaggtggtaagaaattctccctggtagccgggtgtggtggctcacacctgtaattccagcactttgggaggccgaggcaggtggatcacttgagaccaggagtatgagaccagcctggctaacatggagaaaccttgtctctactgaaaatacaaaaattacccaggcgtggtagagggcatctgtaatcccagc

SEQ ID NO: 170062 - DNA, 601 bp, Human
ggaaatccaaacctaccagttctgaccacctccatgttggagatgtagtactatctacacatccacttccgcagataaaatgagctggctggccgggtgcagtggctcatgcctgtaatcccagcactttgggaggtcaagaggttgagaccatcctggctcacatggtgaaaccctgtctctaccaaaaatacaaaaattagctgggtgtagtagcgtgcacctgtagtcccagctacttgggaggctgagagaggaaggagaattgcttgaaaccaggaggtggagttgcagtaagccragatcatgccactgcactcccacctggggacaaagtgagactgtctcaaaaaaaaaaaaaaaaaaaagaaaagaaagaaagaaaaaatgagctggcagagcaggggaaggcacgacatgtttatttggacacattaatgatctgccactgaactaggtggtaagaaattctccctggtagccgggtgtggtggctcacacctgtaattccagcactttgggaggccgaggcaggtggatcacttgagaccaggagtatgagaccagcctggctaacatggagaaaccttgtctctactga

SEQ ID NO: 170063 - DNA, 601 bp, Human
attacatttggcaataccataatgcaagcaggtatcttctatcacgaaatcctaactgggacaaacattcagggctactaaggtggaaatccaaacctaccagttctgaccacctccatgttggagatgtagtactatctacacatccacttccgcagataaaatgagctggctggccgggtgcagtggctcatgcctgtaatcccagcactttgggaggtcaagaggttgagaccatcctggctcacatggtgaaaccctgtctctaccaaaaatacaaaaattagctgggtgtagtagygtgcacctgtagtcccagctacttgggaggctgagagaggaaggagaattgcttgaaaccaggaggtggagttgcagtaagccgagatcatgccactgcactcccacctggggacaaagtgagactgtctcaaaaaaaaaaaaaaaaaaaagaaaagaaagaaagaaaaaatgagctggcagagcaggggaaggcacgacatgtttatttggacacattaatgatctgccactgaactaggtggtaagaaattctccctggtagccgggtgtggtggctcacacctgtaattccagcact

SEQ ID NO: 170064 - DNA, 601 bp, Human
aaatctggccgggcgcggtggctcatgcctgtaatcctaacactttgggaggccaaagtgggccgatcacctgagatcagaagtttgagaccagcctggccaacatggcaaaaccccatctctactaaaaatacaaaaagtagccgggagtgatggcgcatgcctatagtcctagccacttgggattctgaggcacgagaattgcctgaacctgggaggtggaggttatagtgagccaagatcacgccactatactccagcctgggtgacagagtgagactcatgtctccaaaaaaaaaaaaaaggaaaaagaaatcttaatcttaaaatatatcttaaaataaagagctgtattgctactttacaaaatgattccagtgaccacataatataggaaaggttcccatgggagtgaaagatcagagccatcacaaattgctatcaaaacagaatcaacgccatgcacagtggctcatgcttataatcccagcactttgggaggccaaggtgggcagatcacttgaggccaggagttcgagactagcctggccagtgtggtgaaaccccatctccactaaaaataaaaaaattagcctggcat

SEQ ID NO: 170065 - DNA, 601 bp, Human
cacagtgcagtctgcaaagggagcaaccatcctggatttagggggtaaaaaaaaggtacaggccttacctgttctttgtctgtagcaacatcacctatgactaagacctggtatgttgggaatcaggaggctgtagagtagatctcatacttagtaactgctatttctactggccaccaagccatcaacagcccagcaaagctaaaatattaggctgctgtagcccagttgataagaagcccagagtgaatggcagacaccaagtgcagctgatacatgagattccagacctagatttcaytgcagcacgagagcctcaaactaagctttgcttttttttttcactctctggctcttggaaggaaagaacaactcatgctgctttggggaattccacaagggttcagaatcagcatactaaaaaaggacttggtctcagaatgccgattccctgaacttaggaaagggaaggagaaaaaggacctcttgaataaagtcaaatacttggaatggttcatttctgctggtggctctttttaattctggaagggttgcaatgggcttgtacacagaggggttcggcccctgcactcacgtggta

SEQ ID NO: 170066 - DNA, 601 bp, Human
gtagggacagggtttcaccatgttggccaggttggtcttgaactcctgatctcaggtgattcgcctgcctcagcctcccaaagtgctgggattacaggggtgtgagccactgcacccagctgacatttagactttcaaagaagaaaaacagaataaaaatattttaataacacctcacagcaatgaccaaacattttttttttttttgagacagagtttcgctcttgttgcccaagctggagtgcaatgacccgatctcggctcactgcaacctctgcttcccaggttcaagcgattctcygcttcccgggttcaagcgattctcctgcctcagcctcccgaggagctgggattacaggtgtgtgccaccatgcccagctaattttttgcatttttagtagaaacagggtttcacgttagccaggctggtcttgaactcctgaactcaggtgatccacctgcctcagcctcccaaagtgttgggattacaggcataagccactgcgcccggccatgaccaaactttaaaaaaaaaatgtacatccaggtaaatgacaaatatttcaaattagaatagtaaagagcagtagaaacagataga

SEQ ID NO: 170067 - DNA, 601 bp, Human
gctgggattacagacatgaaccaccacgcccagctaattttagtagggacagggtttcaccatgttggccaggttggtcttgaactcctgatctcaggtgattcgcctgcctcagcctcccaaagtgctgggattacaggggtgtgagccactgcacccagctgacatttagactttcaaagaagaaaaacagaataaaaatattttaataacacctcacagcaatgaccaaacattttttttttttttgagacagagtttcgctcttgttgcccaagctggagtgcaatgacccgatctyggctcactgcaacctctgcttcccaggttcaagcgattctctgcttcccgggttcaagcgattctcctgcctcagcctcccgaggagctgggattacaggtgtgtgccaccatgcccagctaattttttgcatttttagtagaaacagggtttcacgttagccaggctggtcttgaactcctgaactcaggtgatccacctgcctcagcctcccaaagtgttgggattacaggcataagccactgcgcccggccatgaccaaactttaaaaaaaaaatgtacatccaggtaaatgacaaa

SEQ ID NO: 170068 - DNA, 601 bp, Human
tctctctctctttttttttgagatggcgtctcgctctgttgcccaggctggaatgcagtggcgtgatctcagctcactgcaacttccgcctccctgttcaagtgattctcttgcctcagcctcctaagtagctgggactacaggcacgtgccaccaagcctggctaattttttgtatttttagtagagatgggatttcaccgtgttagccaggatggtctcaatctcttgacctcatgatccgcccgccttggtctcccaaagtgttgggaattacaggcgtgatccactgtgcccggccraccccccgatctgaataaaattttttttttaaatcagccaggcacagtggcaccctcctgtggtcccagctactagggagactgaggtgggaggatcgcttgagcatgagaggctgagcctgaggctgcagtgagctgtaatggtgccactacattctagcctgggcaacagagtgagatcttatctcaaaaaacaaatgaaaaattctgatcattagcccacagtaagaaacacccatgacacacacaaaagtgaaatgagtttcacaaaacaatattaattgtactacatcctaatat

SEQ ID NO: 170069 - DNA, 601 bp, Human
tcatgaggtcaggagatcgagaccatctggctaacacggtgaaaccccatctctactaaaaatacaaaaaaattagctgggcatggtggcaggcacctgtagtcccagctattgggaggctgaggcaggagaatggcgtgaacccgggaggcggagcttgcagtgagccgagatcgcgccacagcactccagcctgggcaacagagcgagactccgtttcaagaaaaaaaagatgtagtgagctaaggttgtgccactgtactccagcctgggtgacagggaaagaccctgtctccaaaamaacaacaacaacaacaaaaaaaacccgtccggtttttactttgtattctttaacacagttgttcaatttgttagggtgctgaaagtatagggtaatttttaagttttacgtctattaattttgtagtgttgtttttacaatagcttaacaaaattttatttttgttgagacagggtctcgctgttgcccaggctgcagtgcagtggtgagatgttggctcactgcagcttctgcctcccagactcatgtgatcctcctacttcagcctcctgaatagcagggactacaggtatgcgccac

SEQ ID NO: 170070 - DNA, 601 bp, Human
gtcaagagatcgagaccatcctggccaacatggtgaaaccccgtctctactaaaaatacaaaaattaactgggtgtggtggtgtgctcctgtagtcttagctactcgggaggctgaggcaggagaatcacttgaatccgggaggcggaggttgcagtgaactgagatcgctccactgtactccagcctattgcgccactgcactccagcctggcgacagagcaagactctgtctaaaaataaagatgggctgggcacggtggctcacgcctgtaatccaagcactttgggaggccaaagcrggtggatcatgaggtcaggagatcgagaccatctggctaacacggtgaaaccccatctctactaaaaatacaaaaaaattagctgggcatggtggcaggcacctgtagtcccagctattgggaggctgaggcaggagaatggcgtgaacccgggaggcggagcttgcagtgagccgagatcgcgccacagcactccagcctgggcaacagagcgagactccgtttcaagaaaaaaaagatgtagtgagctaaggttgtgccactgtactccagcctgggtgacagggaaagaccctgtct

SEQ ID NO: 170071 - DNA, 601 bp, Human
acaccgtctatacaaaagaaaaattaaaaaactagctgggtgtggtgatgtgcacttgtagacccagctacttgggaggctgaggcagaggactgcttgagcccaggaatttgagcctgcagtgggctgtgattgcatcactgcactccagcctgtctgacagagtaagaccctgtctcaaaaaaacaacaacaaaaaccaaaaacactcacacacaaaaaccacgaacaaaaaaaccccactatttgagatactatttttatgcatcagaacacccaagagctgagacatgagaaaagasgcacttacacactagcactggagcatgaactggtataaactctttcgaagacaacttggcaatatctataaaaacaaaaaatttgggccaggcacggtggctcacgcctgttatcccagcactttgggaggccgaggagggtggatcacgagatcaggagttcaacatcagcctggccaacatggtgaagctccgtttctactaaaaatacaaaaattagccgggtgtggtagcgtgtgcctgtaatcccagctactcgggagggtgaggcaggagaactgcttgaaccctagaggcgga

SEQ ID NO: 170072 - DNA, 601 bp, Human
caagtgtattatttatttatttattttttgagatggagtctcactctgttgcccaggctggaatgcagtggcgtgatcttggctcactgcaacctctgccgcttgggttcaagcgattctcctgcctcagcctcctaagtagctgggattacaggtgcctgccactgtgcccagctaatttttgcatttttagtagcgacggggtttcaccatcttggccaggctggtctggaactcctgaccttgtgatccacccaccttggcctcccaaagtgctgggattacaggtgtgagccaccgygtccagcccacaaatgtacttttaagacacttttttttaagcatcagaaagttttcagtagcagaaactattctgtgactgacggtaaaaattctactgcttctttgttttgcagtcagtggttaaataggtgccttcgagatgatagctgtgataaggaagttatgaggaaaagtggcattcttggagagtcaagtactctgacttcattgcatttgctgaaggggaaaaaaagggcacttattctaaccaaagggctttagacttgggagtgccctattcttgatgtccagtcttact

SEQ ID NO: 170073 - DNA, 601 bp, Human
gccaaacaaacaagagtcctgattccagaggccatcaggcctaaaaggagtagtgcaggaagctgtgctcccatggccagtcccagattcaggtacatacgtactgagctattttctgcagatctctggcctaaggccttctgagagacattctaggcccacatgcacccatggctggagtcagtcaaagccaagagcctgtttcccagactctatgctacatcctgcccctgccctcctgacacccctggggtgcctggtgaactgaagctagcaccgagaagcacttttttttttttttgagataaggtctcacaggttgcctaggttggagggcagtggcatgatcacagctcactgaagccttgaaatcccgggctcaagtgaccctcctgcctcagcctctcaaatagctgggactacagttgtgcaccaccatgcctggctaattcttttgttttttgtaaagatagagtctcatcatgttgctcagactggtctcaaactcctggcctcaaaggatcctcccacttcggcctcccaaagctctgggattactggtgtgagccaccgtgcctggcaagaaacactttcaagtggg

SEQ ID NO: 170074 - DNA, 601 bp, Human
acgctcacctgatagacctggtcattcctcaacagagcttgtgtgtcggcagctagaagaaccagagagagacatcaatggcctagcagatgggactgtgagatccaccctcccacaccctcagaagtctgcatgagtgatatgaacacacaagttctttcaacagtcaaagttctaggagtctttaggagattgcaagagtaactcccagctgagactaaacctaccaccagccccattccttagctggtgcataagctcactggtacacacacacacacacacacacacacacacacaaacacactctcatgctctgctcttccactaacccccagacagccttccagtctcatgtccagcaaagcagaagactcccaaagcaaggagcagagtggcaatgacatcagtgacaatgatgccagccacggtggctggatccagctccacacagctctggcacactgtgggggaagggaggagagaggagaggttgagagcctttaagatcagggaaccatcctctgcctcctagggcaacccttagatctcttatgccaaaacccaaacttcaataagaccctgggagaaaggcctggtg

SEQ ID NO: 170075 - DNA, 601 bp, Human
caacgctcacctgatagacctggtcattcctcaacagagcttgtgtgtcggcagctagaagaaccagagagagacatcaatggcctagcagatgggactgtgagatccaccctcccacaccctcagaagtctgcatgagtgatatgaacacacaagttctttcaacagtcaaagttctaggagtctttaggagattgcaagagtaactcccagctgagactaaacctaccaccagccccattccttagctggtgcataagctcactggtacacacacacacacacacacacacacacacacaaacacactctcatgctctgctcttccactaacccccagacagccttccagtctcatgtccagcaaagcagaagactcccaaagcaaggagcagagtggcaatgacatcagtgacaatgatgccagccacggtggctggatccagctccacacagctctggcacactgtgggggaagggaggagagaggagaggttgagagcctttaagatcagggaaccatcctctgcctcctagggcaacccttagatctcttatgccaaaacccaaacttcaataagaccctgggagaaaggcctgg

SEQ ID NO: 170076 - DNA, 601 bp, Human
tatttattggctgagcaagaagggaaggtacagttggtaatggctgcttctagaagccaccagtctcaggttcacttgttccgagcccagtttcctccaaggtggctgtactgagcatcatctcgatctcggaggggctaagagaggagaagagaaaacggtcaggaggcagggttagaactcttcaaggaagggccccagcaggccctgacgatgagagctcctgcctgacctctccagtcacacccagcaatgaactccccagtaggacccttcccacgtgcaaacagcattcagtgtsagcctctctatccccacttaccctcccttcattcctgcctccttcccctcaacgctcacctgatagacctggtcattcctcaacagagcttgtgtgtcggcagctagaagaaccagagagagacatcaatggcctagcagatgggactgtgagatccaccctcccacaccctcagaagtctgcatgagtgatatgaacacacaagttctttcaacagtcaaagttctaggagtctttaggagattgcaagagtaactcccagctgagactaaacctaccaccagccccattccttagctg

SEQ ID NO: 170077 - DNA, 601 bp, Human
tctgcatagatgttataacaaagctgtggtctttttcccattcttagaggattgcctttgtctggctgcttgttttgatgggtgtaaaacaaataagattagaccgagcagcccaactgaaagcgatagctgggaggaaaacccaatgaaaggttgccggggaaacgaacagaggagaagccgagtagggagcaggtggctatcatgagaacacactgcaaacagtgtaaaaaaaaaggggagggggacaggacctcgattatctttgctgttctttgtggccagcccaactttaattatwcgttattaataggtgttaattacatttctaactctggtttacagtgatttttagaaatctatttttaagcatctgttctgtctcccctgtttttgtgtgtgtgtgcgtgtgtgtgtgcgcgtgtggtttttgttgttgttgttgttgtttaaaaaacccagagaggaggtgagggggaagggagggtagggaatcttgcttttttttttttcctttttcccccttttcccctggtgtgaaattgtacatgcgaaaaatcgcaaggaatcctgtgagaccatttgaaaaaatgtaaattat

SEQ ID NO: 170078 - DNA, 601 bp, Human
tggtcctgattctggtcttggcacaaactgagtgaaaagctgatttttatattagtgtctttggacgtctgggacccatgtgtgcactgggtgacaagcatctctcttttttctctaaatgtgctttactaatagtctctttttctcatgatggtgggtaccataaggattgaaaggtgtagtatttgggtgaacaggagatagcgtaaaaacaattgaaatggtgatctgttagggttttttactaaaggacaaaatagatgcatgatcagggagctaattgtaagcccaaaaatgagakatttaaaaatgctgaaatacactaaaagattaggaaatataattggctttattgaaagtacacttaatttttgctctcttcattgcaaatccccccaattcttttttccttgcagatgcgtctttttgttttctcttcttattaggggatttaaaaattttattttcactcttgaggtaaaaataaataaacttgtattttttgtcatacacttgaaacttgcggccatatgttgagtgcataagcctgtgtcacctttaaaaaaatagaatttttttaagtctccaatatagtttcttt

SEQ ID NO: 170079 - DNA, 601 bp, Human
attataggtgggttcttttcctatatgtaggccaaatactatttcttccatgaggagatatgctgcttcatttagccctgagcatcttaacaccttattttaatttttttaaaaaaagaaacaaattgtctgtatgtacctcaagtaagaaatggttgtcttcatagaggtcatcatacatagacgaaagtactttggccttgacaaatttcttcattagctccaatgatctgtggccaccaggcagttaatttatatgcctagacatttaatatgtacatttgttggtgagctggccagmggatgctaaacacacgagtatgcgctggcaaatgctgcaatgcagtatttttttcccaatgtcattgggaattttggggctaggaagggacatgaacattttcaagcttttatcttactattgtccagtcgatgggccatgttgtacagatttggtcaattctccttttgaaagtaaagtcaaccttttatttaccactatccattcccccatccatgtaatgtatatgtggaaagtgtgtgtgtgcgagaaagagaagcagagagactctgtgtgtatcagtataagtgtgttgcagat

SEQ ID NO: 170080 - DNA, 601 bp, Human
gtccacatcttcagcctcaggaagaaatatagaagtttggactgttgaaaggaacttgtctttcagtcagcagcccatgaagcttggctgaaactggttaattttacagaaacacgaatgtcttgcctccttgcttctgatgtaagtggctttttgaattccttttcctctgttacctcccaggagcatctgaacagatagtgaccgttttggcatgccaaattggaagtttgctagtggagcagaaatcatagttactttgtcatatacatctaaatactgtggtgtgtgtgtgtgtgtctgcgtgtgtgtgtgtgtgtgtgtgtcatgtgttgtagacagctgggagccccggtgtgccgtgggatgtgccaataatggcttctcaagtactctgtgttttcctaagctgccagtctaaaccctttaaaggtttgctttctaatttgtacatgaaaaataacaggctgagttgaactttttttttcaagtgccccctttgaagatgcagcagtagtaaatactgctctaatgataaactttagttctaagtgctacttaaaagtctgtagtagaaaggctgagaacttgccatctttac

SEQ ID NO: 170081 - DNA, 601 bp, Human
cacatcttcagcctcaggaagaaatatagaagtttggactgttgaaaggaacttgtctttcagtcagcagcccatgaagcttggctgaaactggttaattttacagaaacacgaatgtcttgcctccttgcttctgatgtaagtggctttttgaattccttttcctctgttacctcccaggagcatctgaacagatagtgaccgttttggcatgccaaattggaagtttgctagtggagcagaaatcatagttactttgtcatatacatctaaatactgtggtgtgtgtgtgtgtgtgtgygtgtgtgtgtgtgtgtgtgtgtcatgtgttgtagacagctgggagccccggtgtgccgtgggatgtgccaataatggcttctcaagtactctgtgttttcctaagctgccagtctaaaccctttaaaggtttgctttctaatttgtacatgaaaaataacaggctgagttgaactttttttttcaagtgccccctttgaagatgcagcagtagtaaatactgctctaatgataaactttagttctaagtgctacttaaaagtctgtagtagaaaggctgagaacttgccatctttactaa

SEQ ID NO: 170082 - DNA, 601 bp, Human
gctgaaactggttaattttacagaaacacgaatgtcttgcctccttgcttctgatgtaagtggctttttgaattccttttcctctgttacctcccaggagcatctgaacagatagtgaccgttttggcatgccaaattggaagtttgctagtggagcagaaatcatagttactttgtcatatacatctaaatactgtggtgtgtgtgtgtgtgtgtgcgtgtgtgtgtgtgtgtgtgtgtcatgtgttgtagacagctgggagccccggtgtgccgtgggatgtgccaataatggcttctmaagtactctgtgttttcctaagctgccagtctaaaccctttaaaggtttgctttctaatttgtacatgaaaaataacaggctgagttgaactttttttttcaagtgccccctttgaagatgcagcagtagtaaatactgctctaatgataaactttagttctaagtgctacttaaaagtctgtagtagaaaggctgagaacttgccatctttactaatgaagctttccttaggaaaatgctcacttaaaagggagtaaatgaccaagtccctgaaatttgtgatttttaccagatttgac

SEQ ID NO: 170083 - DNA, 601 bp, Human
tggacaggataataatattagtaagttactagattctagttttacctatggatagtttattgggtctcgaccggcattaaaaattaaaacaatggaatgatagaattgaatgaaatagaaaagaaagtatcattgggtggtacttattaagggttagtattatttcatgaatctttgcttcagttacctatgttatgagttgtgatatgaagctgtggtgttccatatggtgttcaatatgttccttacttttttattttactttgttgggtcatggtcagaaaagtttgagaaatactgktctagataatagtgagctctgtattatacaaaggaaaaataacagtcagcttttttagaactatgcaatgcaagatctctagtatcttctgagttattaaagaaaggatgacttctagttgttttagatttaatatgaagcatcatatcctacatctttgataactactgatgtctgcatgatatatgttggggctctttattaaccaaagtatttattaactaggaaaccttatgccttggttgtgctacatagcaaaacctggaatgtaataataaaagtgacaataatcagtagtga

SEQ ID NO: 170084 - DNA, 601 bp, Human
gttcaatatgttccttacttttttattttactttgttgggtcatggtcagaaaagtttgagaaatactgttctagataatagtgagctctgtattatacaaaggaaaaataacagtcagcttttttagaactatgcaatgcaagatctctagtatcttctgagttattaaagaaaggatgacttctagttgttttagatttaatatgaagcatcatatcctacatctttgataactactgatgtctgcatgatatatgttggggctctttattaaccaaagtatttattaactaggaaacyttatgccttggttgtgctacatagcaaaacctggaatgtaataataaaagtgacaataatcagtagtgaatgtgacctagaggtgggactagaaataataagattagttttcatttcttgagctcttgatatgagtcagacactgtgccttacaaacaccatcccttttaatccttagaacaaacttaaaaggtaaatgttaatttctctattttatggacaagctaactgaggttttggtgggtaaattacagccagtaattggttgggccaggatttgatttgaacccagatttgtct

SEQ ID NO: 170085 - DNA, 601 bp, Human
tcttagtgtgaaaagcaaatcccatggcagagacatttggagaatgataaatggaaggtgggcttccttagaatggaaaattgttattatcattgttaatgttatttttacaatgccatttactagctttataaattcaagcaagttatattacctctctaagcctcagtttccacatttttaaaaggattaataccactcaggattgttaggattaaatagacccatttgataaaaacttactgagacttactatttggtagtctgtaaatatgtagtagtaaaggagacatggcccccygtcctcaaagagctgaatatctggtgaatgtgctgtgagaagtgggattcagactcccaccacctgcacaggtcactattgataggatgcagcactctacagtcctccttggggtatgtatatattgtcatatacatgtctcaattgcatcatcagaatttcaagtttattgagggtgagtgagctcaaatattcatctgtttatctccacctacccctaagtttcatccttgcctgttgacacaatgttaccttatacagtagttgctagatgaatccagcccaattcagcaaatattt

SEQ ID NO: 170086 - DNA, 601 bp, Human
ttttaaaaggattaataccactcaggattgttaggattaaatagacccatttgataaaaacttactgagacttactatttggtagtctgtaaatatgtagtagtaaaggagacatggccccccgtcctcaaagagctgaatatctggtgaatgtgctgtgagaagtgggattcagactcccaccacctgcacaggtcactattgataggatgcagcactctacagtcctccttggggtatgtatatattgtcatatacatgtctcaattgcatcatcagaatttcaagtttattgagggtkagtgagctcaaatattcatctgtttatctccacctacccctaagtttcatccttgcctgttgacacaatgttaccttatacagtagttgctagatgaatccagcccaattcagcaaatatttaccaagtggctcagggtacagtgctgggaaagggagggtaacatttgctgaacagagttgaatttaaaacaactttagagcataaaaggggaacagtgtcatgaagtggtgatatactacactagtgctaaaaatacctgtgatctactcaggaagaaattagggctctaaagaaaat

SEQ ID NO: 170087 - DNA, 601 bp, Human
tctgtttatctccacctacccctaagtttcatccttgcctgttgacacaatgttaccttatacagtagttgctagatgaatccagcccaattcagcaaatatttaccaagtggctcagggtacagtgctgggaaagggagggtaacatttgctgaacagagttgaatttaaaacaactttagagcataaaaggggaacagtgtcatgaagtggtgatatactacactagtgctaaaaatacctgtgatctactcaggaagaaattagggctctaaagaaaattcggcagtaagcctaaaaataatgtattttttcactctcccagtgctgttttgtttgtgtttcatggagaaacagtgtatttgctataagcacacaattaagatgagatttcagagatggctacttaattcatctgtggctcaggaccaagtctaggtagcttcacaaaacccaggagcccctctgtggccagactcctctcctttccagcctcccatcttgggtctctttgccttctgttcatgctccactgtagaactgcaccacggtgttccctactgttgctcacacagatccctcggtctccaacatctttctg

SEQ ID NO: 170088 - DNA, 601 bp, Human
ttgtgtcccattcttcaaatttttgttgagtgcctgccagacactgttctaggtaatggtgatagcagtgactaagacaagtccttgcctttatggagctttcattttagaggaagaagacagagaatagagtaagtaagtagtaagtagaacatggcatagtagtgtgtgcctgtagtcctagctacccaggaggctgaggtaggaggatcacttgagcccgggagtttgaggctgcagtaagctgtgatcacaccactgcactccagcttaggtggcagagactctgtatctttatttaaaaaaaaaaaataaaagtagatattatatattatgtcgtgttttataatttcacatagtgaaatgatgtttaaaaaataaaagatgctagattagagagttacactaacgagtccttgtttgtggcacacagtgaggccacaatagttcagccagtgccttgcttctgcttgatgagctggaaccgtcaatgccctactctgaaaggctgagcttcatatgtccaactactaactcttggagacaggcttgcctgacctgcatgtggtgtaaggtggtcatctgtggaatgattggacaa

SEQ ID NO: 170089 - DNA, 601 bp, Human
tgccctactctgaaaggctgagcttcatatgtccaactactaactcttggagacaggcttgcctgacctgcatgtggtgtaaggtggtcatctgtggaatgattggacaattggactgaggtgtctgagcctcaggaaaacttaagatagagaactcataaagaggccaggggtcccagcctttgaagagaggtcctattctgtgaaatgggacaaatgttccaggagggtcaggaggaggatttggccaatcattcaactaagaacagggtcagccagaatgtcttctcaattaaggctkttaagatctcctgatggctccttgcaggagcctgaacctagaaggtgagttagccttggcattatcataggattctacctttccatgagtgttctgctggttaagggcatcttaggagtctgcaaaatggggtgtttttttccttcacttacttgtagtggggtcttggtaaagtcattagcctgtctgagcctcagtttccttatctgtaaaattgggctaataataccttcctccaaagcttgtttagaagatgaactaattaacatgtgtaaagaacctgaatcggggcccggcacc

SEQ ID NO: 170090 - DNA, 601 bp, Human
ctagaaggtgagttagccttggcattatcataggattctacctttccatgagtgttctgctggttaagggcatcttaggagtctgcaaaatggggtgtttttttccttcacttacttgtagtggggtcttggtaaagtcattagcctgtctgagcctcagtttccttatctgtaaaattgggctaataataccttcctccaaagcttgtttagaagatgaactaattaacatgtgtaaagaacctgaatcggggcccggcacctagtaggcatctaataaaggaagatttttaaaataagytcagtccccctagggtgtgcattttaggtattggtaatttattttggggctcacagggagagaagagaaaaatgagagctacttcccattctataactttcaaaaaagtgagcagataatctcaaaaccaaagatatgtcatctcagaaaggactgtgaagaaaataaaattagatttgctgtaaatcagtatgattgagactggtctctgtcaaagactgtgttggccccatcctcttggtgtcacaggcttttagaggcctggggctctgtgaagaaaagcacttggttaaaatggct

SEQ ID NO: 170091 - DNA, 601 bp, Human
cacttacttgtagtggggtcttggtaaagtcattagcctgtctgagcctcagtttccttatctgtaaaattgggctaataataccttcctccaaagcttgtttagaagatgaactaattaacatgtgtaaagaacctgaatcggggcccggcacctagtaggcatctaataaaggaagatttttaaaataagctcagtccccctagggtgtgcattttaggtattggtaatttattttggggctcacagggagagaagagaaaaatgagagctacttcccattctataactttcaaaaaartgagcagataatctcaaaaccaaagatatgtcatctcagaaaggactgtgaagaaaataaaattagatttgctgtaaatcagtatgattgagactggtctctgtcaaagactgtgttggccccatcctcttggtgtcacaggcttttagaggcctggggctctgtgaagaaaagcacttggttaaaatggctctggagtcttaaatcctgagtccaattctttctagtaataagttagaatatttactttttagtgggggatgaaggggatggatgatttggttattttcatatgtcaaa

SEQ ID NO: 170092 - DNA, 601 bp, Human
ggctcacagggagagaagagaaaaatgagagctacttcccattctataactttcaaaaaagtgagcagataatctcaaaaccaaagatatgtcatctcagaaaggactgtgaagaaaataaaattagatttgctgtaaatcagtatgattgagactggtctctgtcaaagactgtgttggccccatcctcttggtgtcacaggcttttagaggcctggggctctgtgaagaaaagcacttggttaaaatggctctggagtcttaaatcctgagtccaattctttctagtaataagttagartatttactttttagtgggggatgaaggggatggatgatttggttattttcatatgtcaaaaatttcaaggaaggactcctgtgctaactggaattatacataaacctaattgatgctctggtgagagcaactggaaagcactagttttagaatgtagacataaacctttatgtattgtatctcctgtctccattgtgtatactgttacataaaattaaagattaaaattaaacttttaaatttcactgattaaaatcaatttacctgattaaaattaagattgaagagaaagagagaaaa

SEQ ID NO: 170093 - DNA, 601 bp, Human
gtgctctgcctctaaactctcctagcaccctgcacctgcctctgatagctgatccattcagtgggcattggttgaattccccatgtactgcctgctgggagtaagaagtcaaccaaaattcaggccttattttcaaggcattccctgtcagtggggagacaggcaggtaaaaagcgactcaatatagggtggtaagtaccaggacagaggagagagaggagttgtctgaagctatgtaggtcagggaggtggactccagggagtcttgcaaaatggcagggtaatttagatggtgatggcraaagcatttcagtggacatatatgcaaagacatggaagggacatactgccaaaggcattcagattatggtacttggctcactgcatctggaactttgttttcaaatgtctactaaccttccaagactaaattcctagagggcagtgatcaagtgccatggaactcagttatccaacagtaatagatttaatctttgccacattcctgtgaaccacatttctgtgaagcctataacattatcctattgatatgccccaagttacatttggaaaaccgagacacagaatggttaagtgactt

SEQ ID NO: 170094 - DNA, 601 bp, Human
gatggcaagggaagacaccacctatctctcaggatcttcaggaaaattaagtggggtggtgagtgtgaacgtacttacaaaatcctctgagtccagcatgtaatttaattattataaattattataaaaaattattttattattttgtaagtgagggttttgtaagggctttgtaagagtctcatttcttcagggggaatgacacttgctctgttatctctacacttcccaccacacctttctgactgtgccctggaaaaatcctctggaagtgcattctgtcagtttagctgcttattgrggtatacagtaagaaaggagcagtccaagtggaggatggaccaagaacaaccctgctcttccaccctgagtttccttgtggggagccggaaaagccctctgctgtcagtatgcagagtgcactgtggcagtgatctgaaatttcccaggaaaacatgatggttttccttgtaggaaagcagaaaccctaatgactcttattaacatttgaagtacctcacttgggccattcacagtggatggctttttgaaagggcaaaagataccagaaattgtgtttgtaagtgtcaaacatgctact

SEQ ID NO: 170095 - DNA, 601 bp, Human
gtccaagtggaggatggaccaagaacaaccctgctcttccaccctgagtttccttgtggggagccggaaaagccctctgctgtcagtatgcagagtgcactgtggcagtgatctgaaatttcccaggaaaacatgatggttttccttgtaggaaagcagaaaccctaatgactcttattaacatttgaagtacctcacttgggccattcacagtggatggctttttgaaagggcaaaagataccagaaattgtgtttgtaagtgtcaaacatgctactttcattatttctttttttagaawccacatagcccctccccctttgctatgtgtttactggtttggcattattgtgagagcttattagtggatgtttgtggagcattgtgaagatgaatagctattggcataggtgatgagtagtaatgtttttaagtatacttttctatttcagaaattaaattccaaggataaatcttaccagctcttagattagtcaactttgccacctgcagcacattttaatgggcacatatttcagaatgttaccttttggacaaggaaaatgaacatgtactgagtgcttactgtgtactgagctct

SEQ ID NO: 170096 - DNA, 601 bp, Human
tggctaaaccaaggtcaaggctggtggtggatttccaacccaagtcggatcacctccaaatctcatgctttttccattataccatgtagaattttgaattttgaattatggtctttcctgtaacacccatttattgggcagtatttactgactaataaacagcagatacacaggctagttgattttaatagggttagataatttacattctctaagattactaggttgcatttcatagtgataggaaaagtcctcagacttagagattgaagaaagggcacaaatttggtttcagccttgrgttcaagttacaatcctagttaagtgacagtggactctgcctgaagactcattactccatcatgtgtagagtgacagcacttctacatctgtaaatgagaggaatgacaatacccacttctcaaagttgtgtgagaattaagtgaagtgatgtatgtaaagacacctctcaccatttcttattagtaccattggaaggacttaatgataattacttgcctaaatattttcctgtgtaactcaaagcactttttaatcagcattataacaggatttccctttactgagtgtttgtcatatt

SEQ ID NO: 170097 - DNA, 601 bp, Human
gtcaaggctggtggtggatttccaacccaagtcggatcacctccaaatctcatgctttttccattataccatgtagaattttgaattttgaattatggtctttcctgtaacacccatttattgggcagtatttactgactaataaacagcagatacacaggctagttgattttaatagggttagataatttacattctctaagattactaggttgcatttcatagtgataggaaaagtcctcagacttagagattgaagaaagggcacaaatttggtttcagccttgagttcaagttacartcctagttaagtgacagtggactctgcctgaagactcattactccatcatgtgtagagtgacagcacttctacatctgtaaatgagaggaatgacaatacccacttctcaaagttgtgtgagaattaagtgaagtgatgtatgtaaagacacctctcaccatttcttattagtaccattggaaggacttaatgataattacttgcctaaatattttcctgtgtaactcaaagcactttttaatcagcattataacaggatttccctttactgagtgtttgtcatattccaggcactttgt

SEQ ID NO: 170098 - DNA, 601 bp, Human
atttcttattagtaccattggaaggacttaatgataattacttgcctaaatattttcctgtgtaactcaaagcactttttaatcagcattataacaggatttccctttactgagtgtttgtcatattccaggcactttgtatgtactttttccattactacacttatgacattagacagtaatttcttatttacttatttatttacttccttgcaggcaggaactctttctctctccttcatatctctggcattcaacataatggtttctggcccatcgaaggaactcattaatgttaggraacttagcttggcttttgttccttcttttgagagctaacttcagtttgggggaggggctgctccaatgaagtactaaattaacatcattaaattgtgtctcataacttgccctcaaatatatacctgtaactaaagaaattttagattgctctaattgacaatggatgattctgaatatgtgttaacattttactttttaaaaaaggtaaatttctgggataaaaagaatatattaagagttgcaagagtttaccaaacaaattttctttgtatctgtgattcaaaggacaagcttaccc

SEQ ID NO: 170099 - DNA, 601 bp, Human
tctctccttcatatctctggcattcaacataatggtttctggcccatcgaaggaactcattaatgttaggaaacttagcttggcttttgttccttcttttgagagctaacttcagtttgggggaggggctgctccaatgaagtactaaattaacatcattaaattgtgtctcataacttgccctcaaatatatacctgtaactaaagaaattttagattgctctaattgacaatggatgattctgaatatgtgttaacattttactttttaaaaaaggtaaatttctgggataaaaagaayatattaagagttgcaagagtttaccaaacaaattttctttgtatctgtgattcaaaggacaagcttaccctactcagaaaagtaatgttttagtttcaaaatacatgtattatatccatttgataaatatacatgataatatacatgtatcatatactaaatattcttagggacatagtaaattaattctaaaagggtcttatctgagaattgtagattatgcagcttgaattataatacaaatgtaatttttgaaattttatcatgtcttttttataatttaaaagttttatttttgat

SEQ ID NO: 170100 - DNA, 601 bp, Human
attaaattgtgtctcataacttgccctcaaatatatacctgtaactaaagaaattttagattgctctaattgacaatggatgattctgaatatgtgttaacattttactttttaaaaaaggtaaatttctgggataaaaagaatatattaagagttgcaagagtttaccaaacaaattttctttgtatctgtgattcaaaggacaagcttaccctactcagaaaagtaatgttttagtttcaaaatacatgtattatatccatttgataaatatacatgataatatacatgtatcatatamtaaatattcttagggacatagtaaattaattctaaaagggtcttatctgagaattgtagattatgcagcttgaattataatacaaatgtaatttttgaaattttatcatgtcttttttataatttaaaagttttatttttgatttttaaaaatgccaacttgacttttgcccaattagtgagtgtgacctttcaaaagcatattttgaaaaggcaaaagattgtgaagacagaaatactaacttatttattctcttataatctaaaattctatttttatgtggcaaatcataaaaataca

SEQ ID NO: 170101 - DNA, 601 bp, Human
tcagaaaagtatggaggtagacatgtctccacaagtctgttgaagtacattctggtcctccactttaaaattacagggttgggcttcatggaccctaatgttctctggtatctgttgaattcaagaagggtctgctctttgtctttgttatctctgtatccccagagttcagcacagatctcggctccatctctgtttatctaacatacccagatctagccatagtggaagtaaaccctttttaaatgtgcgtatgacctgacatatccaggaactagtgttacaggtaacttgggtagayaaaaggagcctggattgtgttgagagaggtgccagaagggaacagaggggtggctttttagtttccaagagcaggaggctggctgagcctctgctccttacctcccctctgcagatataaacgaccctggtgatgatccggcagctgcacgtctgaagccttccctcttgcttttgttgtatattttgcagaaaagagtggtgggaggggtgaggttaatgcattgagtgtgagtaattagtcattcaaaccatcgacatttacgatgacaggatttgagtgcctacgttattgtgcacc

SEQ ID NO: 170102 - DNA, 601 bp, Human
ttagtttccaagagcaggaggctggctgagcctctgctccttacctcccctctgcagatataaacgaccctggtgatgatccggcagctgcacgtctgaagccttccctcttgcttttgttgtatattttgcagaaaagagtggtgggaggggtgaggttaatgcattgagtgtgagtaattagtcattcaaaccatcgacatttacgatgacaggatttgagtgcctacgttattgtgcaccgctctaatagtttatccctgaaattttctgcctgtataatgtttcttaaaatatatcmcagaaacataaaagatttaatgtagtgctttgtacatccattagagttcgaagtcaactgaacctcctcaatgatctatcctggatgctgactgtaattctgttcttaattgctattcaaatgaggaaaggagggcaagtcaggggcttggaacctggtcagctgcaaagttggctgtgagacccacacagaatgtttcattaaagtacatatgcacacttgagtaactgatatatttatttgcaatgaaaattgtgctgttagaatatcaaaggcgttagcctgaggaagcaagtgttc

SEQ ID NO: 170103 - DNA, 601 bp, Human
ctcatggctccttttagaagctagttgggaccagttgggctgtctaatctacagacaggactcacctcctggagtcaacatagattaggaaatccacatagaatgcaaggaaggccacaaagctgatgcggggactgaaattactttgctgcagccttgttacttcacaggccttcctggaggaggtggacctgtgagatgttcacatggacaagtgctggctttcaccacgtgtctgaaaacgaaagatgaacctgactatcaggtgacctttatgagttttggtcccacagaatctcarcatgaaattcttccacatactccatcactagcaccaaataagctgccttggtgtgggatattttctaggtgtttgttggggagctgaaagaagggtaacctgaaaaaggtagaaaacagagaagagtttctaaagattgtgggcctggggggtttttgccattaaatcgaatgtagtagtccggcctcctgaatggataaattctgattttcatgttcattatcgagttggcagtgcttcttatgtttgttgcctggacacctgactcagtgaagcagtgagacaacacagcaaatggag

SEQ ID NO: 170104 - DNA, 601 bp, Human
ctgagcaggcaaatggtaataataatggaagctactagttatcagatgtctgctatgccttggtttcctcatctataagacatagagaatattagaatatgcttcattgccttcttgtgaggagacagtgagagaagtcacattggatgattggcagagtaactaataaacatcagtgattgtggttatgtgcccaccactgttctggtgctttacataagtcatatcactggatcggttcttaccgctttgccatacggtggcattgttcccatttttcaaatgaggaaaatgaagactsttaggatttaagtcccttgccaaggtcacacagctagtaagtggcagagtatgatttcatttccaaggagttgatgatcagtttctgaggagatggaagccattttatgatggacaaatagaggacggtgtaagacaaaatggaaagttgcgaattatgggctgcgtttggggccaggaaatccgggtgcaggcctggactttgcccccatttttctatgataacagagaagtaactggacatctctgggcttcatctcgaatgtgagtgttgagctagattttgttcccttatgtgcct

SEQ ID NO: 170105 - DNA, 601 bp, Human
ttcacatgtaaatctgttccccttataaattaagtagtttgcaaaatcataaaacttaaataccactgctactttccaaaatacaagtcacctaacactccagacataattttcttatttgaaaaactggaagataatgcttgtctcaaagggcttattgtgaggattaaatgagagactagatatattgcatctagcacaatgtctactgcacagtggtccctcagtaaataaatctattattgtaagtacagctagtatgcttcaaggaaagtggccagaacagaaaaaaaagtatctrtcaaattctccaaatagggccaggctttgattatcttgtaccagagcactggaacatctatccttaaacagaatttcccatacgttcagaaagccaatatttagattcctgaataatctttatataataggatgataattcaaaccaaattaaaaccagttaaccatatgattcttcctcctactcctatatagaaaatgtatttttagtatagccttaccttcaaaatacagactctgccagctatattagtgaatattattaatcaccttttcagaattccttcagaactgtagcgag

SEQ ID NO: 170106 - DNA, 601 bp, Human
ctccaacacctcctacagatctcaatgcatctcgatcctgtgaagtttacaaggagttctaaatatccagtgggaggattggggggtgggaggtggcaaagagataagaattcaagattaagattttccagccccaaccactccctaagagaatgtaatggattcccttagaaggttctggcttctgcaatgttaaaatctctttacagagagaggaagtgactctgttgatagccttaccagcaggctagattcatccctggctgtgaattgtcaatgaattctccgtttgagaacagakagaagaaatttggtcatggagttaagtgttatgtgctggggacataaacatcaccatttatcaagcacttcatctgtgctggatacttgctaagcgctggacataccctatttcatttaacacggagcctccattttcttagatgaggaaactgaagcttggtgatttccccaggcagcatagttattagcaggtggtggagctgggagtcacccctactttccaaaagcatgattttatttggaggcatgtacagggtaaagaccctgcctaacctgcacttcataacccaatgcaaca

SEQ ID NO: 170107 - DNA, 601 bp, Human
tgttttggaaaatagcacacagtgcattaaaaagataaatttttggtattaaacaggtcactgcttagctaaacaaagaagactagacttggagtggttttttcacttctgatattctcttttcgtgaaatactcttcagtatgttcaccttttctttattgtgcaggcactgtattgaaatggatgctgcctacaatttaagcataataaaaacccagcctcatttaggcatatccaagaaaatcccaagatattgattagctaaatgaacttttctacatgcacataagacggaaagtsattagtgatgggaagagtacagcaaatggtagcatttatcagcatattttgctgctgatttggaaaatgtgcttagtacaatgtgatgtatctcctgatttcagaggaaaatcaggcagattcgcatctgtcattttatttaccacctccctgcagtcatacatattctacaaagaagaataaaagagttttgatttgttgactcgggaagagggggttggctattgttggaggtgagtggaaaatttttaggtatggagaagatttggcagcctaatggggttgcaaaacaggagaatt

SEQ ID NO: 170108 - DNA, 601 bp, Human
gataggagaagatatttctagtttggagagaagataaaattcagatagagatcatatatttgtataaggtttttatatttgtaaaacattttcaatcaaccaacagtatttatttagtgtctactctctcagaccaaatagatattattccctttccttcccttctctgaaattctgtatcacagtctgtgaggaggtcaaaatggataagtcatagtttgtgcccatgtgttgctgcaggaccaacgagccagggaaaccagaacaaatgacagcccttcatgaaagtctggaagtgacrgggagctggctgcttattatgcatattaactacacatctaccttgctgttttgtgggcgggggcaagagggaagtggaggttgttttgttttgttcttcaccaaggcccaatcttacttttccttggtcctggctattaatgtcattggaaggatggtgaaaaaggattcataatgatacaatgaagttggaggtttgatggaatgcctactgcgtgtcagctacagtgctaggcatattatagatgttatctcattgaagctttatatcagtgttgcctgatcagtgattttattccca

SEQ ID NO: 170109 - DNA, 601 bp, Human
gatcagtgattttattcccattttgcagatgcagaacccaagacctagaattagtcagctggtgagtggggttagggcatctgactgcaaagtctatggtctttctgttaccataccactctgtctgtgctgaatgaagacaacatcagttatgggtgttcaaaggagaaaaagatgacaatagactgagattctcaaagcaagtgtcaaagaaaagcgagccttcaacttggccctgaatttggtagagattagattgtaggagaccagtccatgcagaggaggcagctgagcgaagctycagagacattgttatggaatgaatgtttatgtccccgcaaaattcttatgttgaagttctaacccccaatgtaatagtttttggagatagggcctctgcagaagtaattaaggttaaatgaggccataatggtagatccctgatctgataagattagtgatcttataagaagaggaagagagactggaattttctccatacatatgcaacaagcaagaaggcagctatctgcaagccagaaaaagagccttcactagaacccaaccatgctagcaccctgatcttggatttccagactcc

SEQ ID NO: 170110 - DNA, 601 bp, Human
gagatacaaggcctcataaacacaaagtggatacagctagctagggtaataactctaattcctatggccgctaatggaatttctcatcacaaacttctggaatcagattaaataattttattggtgatataagcataaaatatacacttagcaatccctgatatttgcccttagtgtttgttttcagaggcttttatactcagtacttcctttgacgagtcaagagcacttggctgcttatttttcttgctctttcttcctctcttttctttgcctggtttgttgttgttgttatattttttgtgtgtgtgtgtgtgtgtgtgtgtgtgtttgtcctgcttcctctttctgccttcttgttttttgacatgtcactttgatccaaaaaggattttcattggcttattagatagtatggaaaaaactaaaattgaaatagccatcaatttttttaaaaaacagaatagaaggaaatggatatagaatggtaaaaggagaccagaggaaatttagtaaattaattgtggttaaatgactcaaacggaccacctagtttgagttttctttttttttaattattattatactttaagttttaggg

SEQ ID NO: 170111 - DNA, 601 bp, Human
ttccgtctttctcgtgagggtttctgcagtgagttctgtctggtttctcattacccagagccctgagctggacaacaaacaggaaactcaaatgtcactctcatatcctggtcctaactgtggaaactggaactagtcctcaaccacctttgctcttcccagtgcccctcaccagtcaatggacacagatcaccctctaagtacgagagagagacagcactacccaagagctccgcacaccccagcacacacacacatcccccaaacacttttctggcatgcatgtgcgtgcacaggcacrcacacacacacacacacacatcccccaaacacttttctggcaggcatgtgcgcacgcaggcacacacacaaacacatcccccaaacactttctggtcagaaataccaaacccagtgcatcagactaaccagaattgagacagacttcactgaaagtcctgccttgccttccccaccccatacttgatagatgtatttgaaaccttatgtaagtcatgttatccctttggatctccatttcctcaatacacagtagagaagataaatcttaaccctaccttctttggatggtacttgtgaa

SEQ ID NO: 170112 - DNA, 601 bp, Human
gttccttgagcagccacataggatccttgtgtttgggaagctggtgtccacatgttgcccatttgaatggcaccatgtaataaactaataaccaaaacatcagatttaaaaaaccagagaggaagaggaggtatagggtgtttgtatatatagatatgtgtatctgtgtctgctaagggaatattttaggcctaagctaatccagcacggtgctagacaggatagtctagtgattaagagctagactacctatatctacgtctctgccttatcatttactagctgtgtaacaggcaaattyttaacttctctgggcctcaggtttatcatttataaaatagtgatactgataggattattgtgaacattaatttatgtaaactacccagaacaacacctggcatatagtaatataattcttacaggagttctgtgagatgtaggtattattagctccattttatagatgaggaaacagctgtgtgatcttggataagaaagtaacttatctaagatcacacagcttctaagtggcaaagtcgaaccaatgtttatttgactccaaagcctctgtttgtatttactatactgtactagcttc

SEQ ID NO: 170113 - DNA, 601 bp, Human
tgtggcttggtcttattttcaactggcaggattgttatttcaggaactatagttcaggtttggggaccagatcccccaccttaagtaaaaatcttgagacagtattcagtcctgtttcaaagggtaatattcatttgagaattccatctaaaaatcttttccaaaggcgcttaattgataatgttttttaaaaggggttctgtgaccaaatgagtttgaaaaactgaagtgaaccaagtttaaaagtgatttattggtggggcatggtgcctcatgcctataatcctggcactgtgggagrccgaggcaggcggatcacttgaggtcaagagttcgaggccagcctggccaacatggtgaaaccccatctctactaaaaatacaaaaaattagctgggctttgtggtgggtgcctgtaataccagctacttgggggactgaggcacgagaatcacttgaacctgagaggcggaggttgcagtgagctgagatcacaccactgcactccagcctgggtgatggagcgagattccatctcaaaataaaaaaaaaaaatggggggctctttttatcagtacttctctgaacctgtgctaacacg

SEQ ID NO: 170114 - DNA, 601 bp, Human
attggacactgattcagagcatacacagccttctggagaactttgccccagccctgcaaaatattgtcacctagttggttttgtaattgtgacttcaaaggccattccatcattctatcaatccagctgcttcaggatgatggggaacatggtaatatcagtggaattccatgagcaagagcccactgctgcacttctttagcaataaaatgagtgctttggtcagaggcaatgttgtgtggaataccatgatggtggataaggcattccgtgaatccatggatggtagtctcggcagaakcattgtgtgcaggataggcaaacccatttcgggagtaagtgtctattccagtgaggacaaacctctgccttttccgtgatggaagagagtctaatataatcaacctggcaccaggtagccggcttatcaccccgaggaatggtgtcatatcaagggctcgatagtggtctctgctgctggccaattaggcactcagcagtggctgtagccaggtcacccttggtgagtggaagtccatgttgctgagcctatgcataacctccatccctgccaccgtggccactttgttcatgacagggg

SEQ ID NO: 170115 - DNA, 601 bp, Human
tccctttctttccagtgtttctcatcatactttaaaccaatgcttcttaatccttcatgtgcatttgacttacctgaggattttgtggaagtacagattttgattcagtaggtctgggatgggacctgaagatctgcatttctcacaagtccctgggtgatgccagtgatgctgatacaggaaccacaccttgagtagcaaggttttaaaccattcttaagctgggcatggtggcctgtaatcccaacactttgagaggccaaggcaggaggaatgcttgagcccaaaagttggagaccargctgagcaacaaaacaagacctgatttcttaataaacaaataaatttagccaggtgtggtggcatgcacctgtaatctcagctaccctggttgctgaggtgggaggatcgcttgagcccaggagtttgaggctgcagcaagctgtgatcatgccaccatactccagcttgcgcaaaagaatgagacaaaacaagcaaacaaacaaaaaaaccccacatacttagtttgaggaaattgtgtgaatgaccaaaagaaaataaatcctctgactagttggctgtagtaacactgggcttgcag

SEQ ID NO: 170116 - DNA, 601 bp, Human
ccccatgttaatataatcttcacagtgatactttgattgtgagaattaagggattatctctgttttttccagataagagagcatactgataaagcttaaatgacttaaccaaggttatacagcaagtagttttgaaccacacacacattgatacatgcagtaacaaccattcatctgaccctttcttgggtgtgtttgggtagatttaagcctgctgaaagcaagaaagacctctcagaatgggcagtgaaggagtcccaggatatggagttggctgcaattaacctagtatgtggattaytgccatgcaggtaattttgaggtgactggggattttatcatgcactttcagaacaggatttcagcctgaactaggggttctaacttccataaaaattccttactcaactcagaagttttcaacagcagctacccatctggctgcctcctcaggggctttgtagatgaggggagtaactgttcggtttctggagaatgatggtttttaaaaagcgaaagagcaaggtgtgcagattggcagtgcagaaatgctgaggttctttctggccagcttctctactgcagccatcaaccataagga

SEQ ID NO: 170117 - DNA, 601 bp, Human
atctgaccctttcttgggtgtgtttgggtagatttaagcctgctgaaagcaagaaagacctctcagaatgggcagtgaaggagtcccaggatatggagttggctgcaattaacctagtatgtggattattgccatgcaggtaattttgaggtgactggggattttatcatgcactttcagaacaggatttcagcctgaactaggggttctaacttccataaaaattccttactcaactcagaagttttcaacagcagctacccatctggctgcctcctcaggggctttgtagatgaggggagtaactgttcggtttctggagaatgatggtttttaaaaagcgaaagagcaaggtgtgcagattggcagtgcagaaatgctgaggttctttctggccagcttctctactgcagccatcaaccataaggatgtcaggatcagaataatctccaggatcctaaaggcaaggaaaagctacgtctatccagaatggctgggaaaataaggggttataaccagctatgctctcaacactttctagagattaaatataacaaaaatgcttaacacaaactactggagataatttactctttcacag

SEQ ID NO: 170118 - DNA, 601 bp, Human
gttaaaagagaatgcttagatccatagagtgctttttattagacttagctgaactcctatgatggtgagaagcatgttaagaaaacctgttcatgaactaggctaaccacaggtagtttcattgtggtaccagactatctcatatctttcaattcacaggcaagtttttctgcctctgtcctcctcttgttctatgcaatgttctgttttagagcttgaagttcattatttcatatcaaggagaatcatcatcatttttcctcttcctttctgaaatgatgttcatctgttttttgtttgtttttttttttttcattttcccaaaagcaccctcattcttgatgttaaatgcagtctctctctaaagttagagcaggtgataacacagttgtgctaattgcagtcaggaactaaggtgatggtggatttgggactgatagaagcaggtggcttgacatgatacatcttgctgggcagggctcctttccctcatttgaccttcagaatcttcctaggacttgaatgtattttccttcctccagaagcaaaggtctaaaacaaaaataaaatatagaatgtgaaaattatgcccattatattt

SEQ ID NO: 170119 - DNA, 601 bp, Human
cagaatcttcctaggacttgaatgtattttccttcctccagaagcaaaggtctaaaacaaaaataaaatatagaatgtgaaaattatgcccattatatttattttagattttcatcaatatatgagtaattttagaaagatggatagtgtgtcaggagcatgtaccactcgtaagcatgattcctccacatatattccatcagtataaataaatcaagtactactccaatgtgagttaggtctaatttttgctgttaagtggtgttttgtttatatttttcataatttattttaattttaygcaaattaaattgggctggatagattgaccatctgaccagtttcctagaacttatgcataaggtttatcattgagataattgttttaaaaatatcctttaaaagcagctcaacttggtgaatgtttttaaaaagtgattataagaatacttttgtacagcaatttttaaagcttctcatatatgcaaggtaaatatgactgagaaatttgcatgatgaaaatgtatttaattaggtgaattatttagctaggtttgatgaggtgacaccaaatttcggataaatgatatttttaaaccaa

SEQ ID NO: 170120 - DNA, 601 bp, Human
aacattgcttgggaagttcaggctggttttgcagccaccccaagctctgtgtttcttaaagggtatgtcagaaaatgtaaagtttcctaatgatatttctggctgatgacacatggcagagctgatggactatttataatcagtggcacgattgcaagcacattatttttatttcacttggggggagccctgtcacttgctacctctctttgcagacaagttgatgccatctccacctaaagtagctaaatcctcttttcagagtttatttgcactcttagctttgtgttaggagctcccyagctctttccagtagaaaccccctctcctttttctttattgttctttggctcagggaatgatgagggtaaagaatgatttgtagcaactgctttgaattctagccatgcctgcatccttaactatacacatctccagtctttgctactcaagtcttgctacatccctctgaatgtgggtgtggctggcatgaccgaggcaatagacactgctactgtgtccagcacttgcctcaattttacaggcctgagcagagcatagctgtcttttgttgagcacctactccaatctagacaatgta

SEQ ID NO: 170121 - DNA, 601 bp, Human
ttacttttgcaattgagtttagcttatttctaaagatgattgctttccctgatctcatacagcctgatacacaaagatcccaaaatggacctgattcaggctcctcagtctaggcttagaatcatttcctatgagttctctaatgaggaaataatcaagagttgtttaattatggggtagtcctctgagaggcaggaggattaatttctttcaaagtaaaaacatacctattttcatgctttaagtaaagacggatgctcatgtcacctgactctttgatgaggccacactagactgagacctgtatttgtaggtttgattgattttctgtgctatccagttcagcattagaatgtcagatgtctactcttcccttgacagacaccctgaccttgaactgaaaaaggtacttttctttacagttttcttgaaaccccaactcttctccaggggcttaggatcaaataatcaactttccattttgcttttttttttttaagtattccataaggccactgtggttccccaaagactgagtagacctggcttttctggtctcagatgtaccccctagcccatcatgccatcagatgctttatct

SEQ ID NO: 170122 - DNA, 601 bp, Human
cacctgccttgctaagggcctccattccgctgaggcatcttttctttgcattcggcataagcaattatttctcctatcactgctcttaatgcttcctggagagttagcagatcattttttgctgatggatatcaccccacacagaaatgatggactgcctccctcagtcttgttaatagtaaaaaggcattttctctcctcctccattaccgctagtcacaacctgggcgagaatgcttctctgccaaggtcagcaggggcggctggatcactgaatccccagggagccaagagagagcaygtggcaatgccagcagaaaccagagacacgtttaccccagttgtgctagcagccctctcttgtgggagattttatttggctgctctgcttcccagtgccctgttcacttcctttgagtgaataatttcaaatacaaggataggagttggagaaatggaaatacaattcccctcttctctctgctcagtgaaggtgatacgttcccagtatcttgaagttcattcatagtgtcctgtgtccacatctaaaaaggaaattagaccggtatgggttgggaaggcacaggttttcagaagtaca

SEQ ID NO: 170123 - DNA, 601 bp, Human
ttatttggctgctctgcttcccagtgccctgttcacttcctttgagtgaataatttcaaatacaaggataggagttggagaaatggaaatacaattcccctcttctctctgctcagtgaaggtgatacgttcccagtatcttgaagttcattcatagtgtcctgtgtccacatctaaaaaggaaattagaccggtatgggttgggaaggcacaggttttcagaagtacatggaatggggtctgggggctttagctgtcttcaagtgtaaaagaagccaacaatgtgatgtgagctgcttcaaaaaaaaaaaaaaaaatcagcacaactttagttgtgttgggagaattatggactccatatcacagaaaatagtggtcctttcttgtccactctggtcagcccatcctagtgtcttatgtcccattctcggcttcatattttaaaagattgtctaaaggtgaatgacaaagatgggaaagaagtctctgcacccacccacagattcacctcacaatggttgcttttctattctctaggaaagaaaattctgcagtgaccctgaggcattagtttgatcctatatttcaagaatctgggaag

SEQ ID NO: 170124 - DNA, 601 bp, Human
ttcccagtatcttgaagttcattcatagtgtcctgtgtccacatctaaaaaggaaattagaccggtatgggttgggaaggcacaggttttcagaagtacatggaatggggtctgggggctttagctgtcttcaagtgtaaaagaagccaacaatgtgatgtgagctgcttcaaaaaaaaaaaaaaaaatcagcacaactttagttgtgttgggagaattatggactccatatcacagaaaatagtggtcctttcttgtccactctggtcagcccatcctagtgtcttatgtcccattctcrgcttcatattttaaaagattgtctaaaggtgaatgacaaagatgggaaagaagtctctgcacccacccacagattcacctcacaatggttgcttttctattctctaggaaagaaaattctgcagtgaccctgaggcattagtttgatcctatatttcaagaatctgggaagagaacctgtgtagctatcagagtagaatgtttgccttgggtggtaatgaggctccgatcatcggaagcattcagatgaactcataagggatgatgtagacaggatttcagtcccacagtggagtctgac

SEQ ID NO: 170125 - DNA, 601 bp, Human
caggaaactgagagaacaatagacttaaggttccatataggtgagaaatactaaacaggaattagacttggtagagaatgattgatgtgctgttcacctttgggatttgttgctgcctttggggatttagggtctgtctctggagatgtgttgcagtaattctccctagctgagattctacctatgttggaatcaacttttggggaaatggtttttgttgtgtcaccaactttcaagtgccagctcctcttccctggcagggttcaccctgttccctctgtaccctagctctggctgtgcrgaactaatgggagttaaggtcatgactatccattatgcatttattgggtgccaggtactgtgctaagcccttgatcttcatcacctcatttgtcctcgtgacagaggaaggctattatcaggccaccattacctgactccaccaccacctttctcaccaccagtctcagctcagctgtgtctccttcccggcccttttaacctttgattaatctctccctcctctgtgttttagtcacactcatatgtatccctggcataacacacacatcttgtggcactgtgataattggtctgtatg

SEQ ID NO: 170126 - DNA, 601 bp, Human
tagaggcgactggtccttgcagatgtgacgacaaggtcacatatccagtttcgcaagcagatgttcattcagccctatttcaccagcactttgtcatttggtgagagcagacctcatgggaacagactggagcaacacaaaggatggaacataaaaaaatcttgcagagaacctgattgcttttatgtattcaggaagaaggggatgggggtagggagggtggcaaggagagaaatgtgcagagcagaatttcatgaggtttttttttttttttctggtttattcaaagattattatgtgytggatacagtaaatcatctatacacccacttccaggaggtaaatcttcagaactccatgtgtgggtagctctgcatttaacagctgccatacagtagctattttgttctgcacttagagacccttatctgtgcatttgttttaagttattgtcaactctcctgttgttcctctattgttgttctcctggttctcattactattacaagggtagctaaaaatctgaactactgagtgatttaaactgacaccatgagttgtaacggtagatgaggggctgtcatcttggttgtggactcag

SEQ ID NO: 170127 - DNA, 601 bp, Human
caaaaagtcattacaaatttcacatgctcccatgcactaactgagcgctctatgcatatgaagtcatttgctattcactctgccaaatgcagtaggtaatctcaacatttccacttacaaatggggaaactgaggttctaagaagttacaaggaatatgcccagaatatggaatatgaccatgctagtcagtggggtggccatccctggaacctgcatgaccttggggcaacgcttctgtgctactccacaatgtcccatgagccctccctaagtagaggagcagaggaggacaagacagrgtagaagccccctgactttggggaggcagcagcaagaacctacaggggcctttctggaacccgggtgtattcattagctattgctctgtaacaatattactgcaaccccagtgacttaaagcaacacacatttcttatctcgcagtttttgggaatcacaagtctgggcccagcatggcagggctctctccttagggtctcccaaggctgctgtgcaggggtcagctagggcacattttcatctgcagctttctccacttccaagctcattcaggttgtttgtagagttcacttccttgc

SEQ ID NO: 170128 - DNA, 601 bp, Human
gaaatgctgggggtcatctcagcatggcaccctgcatgccaggaaagcgtgatcctgcttccttctgccattctccatgcctccctccaaggctgcaagtgttcctgccctacagagagccttggtccacatcacacagccagaggccttccaaacgaacatttcttagccgccaggcctcgttctgaactgggtaattgtgatgtttgcagacccatccacctgcctgagttggggcctacatgcattgttctgatcatgattgcctcaatctacaatcatccctccagaggaggctagkctcgcagagccctggaagagcaggcagggggctctggagcattcagtctttcagtgtttgccattagcgacctggggagtgatgcgaatggcttcaattgctccgtggagccagcaatcacagcaggctttgggggtccctgacatgagctggagaaaagcctctgtgaagcagctgccagggtaatggaaatgccctgctgccttgctgcgcttccatggagctgggcaagagtctagggctgcgtgccctgctcaagagaggcccagtgtgaactgcagggccgacatgggctttcct

SEQ ID NO: 170129 - DNA, 601 bp, Human
ccaggctttggtagccctgaactggtcagtcattccagcacagagtggaggtgttagaaactcccagtaggggagggggttcctgtgtctcaagggcaaggctcaggagaagtcacagttataaactctaagccatgtgaagcctggcatctggggaacaggtgcacttgctagtggaaagtaacaggaatctgggcagagcacctccagcatctgttatagtggccacgactttactgagagaggagagggaggatgcctagactaagaaagtgtcctgctgcaagaaagcacaggaccyacatttctaaaagcaaatgagctaacaggaggcctgttacaggaggaacctctcattgcctacagatgctctccaaatagtcagctcccagtatgcacttaaaatagggatcaatttatgggcattccattcatccagcttcccaggaataagttcattgcattctggaaggttatatctaaatatccatttagccagcataaaaggagattaggattaggtgcacttaatcagtacattagaatcttctaccaaaggtatctgatcctgtttctgagaataaatgcagaataaacatgg

SEQ ID NO: 170130 - DNA, 601 bp, Human
ttccctattctaatctttgactgagtctagctcactgtcaaagtatggcgtgtgtagaggtgggtggaaatcagtcagaaatctatgagacacatttttatggccaccaaactatcttcatctctttgccttagttcccaatcactgtttgcaaactttctcaaatgatctaggactttgcagacccctcagttccctgggattgagacagcacttcctgactgttaccttgggtaagttatttagttttgtctcagcctcaatttcctcctctgagaaatgggtattggtcaaatatctrtttctaggagttattgccatgactaagttagataatgcctataaggttttgactatggtgcaaacattcaacaaatgttcactatcaatcatgttaatagtcgtggtaataattgccttcattactctgaccttgtgtatctgatctctagggccacaataatgcacctcagtgacataaaccagtaagttagaacttacatttgggaaagagagacatattataaaactaaatccaccaggtttatttattataaagaaacacttagcacttactatatgcccagcactgttcaaatca

SEQ ID NO: 170131 - DNA, 601 bp, Human
atattaaattttctttcagagaaatatctcattctctctctcactgtctatatcctgctctctcaatttctgaatgtgcccttgggaattcagacggtctttggttttagggaggttggagctggcagggtgtctctttcaataactggaactgatcgccggtataaaagaacctggaccactcaaagcacatcctcatgctgtgtcttccacagtcaacatcaatccaccctccttcgcttttaggtcaggagtttcgtaaggcaaaggaagtttctgattgggagaacttagattagcyatcaaattatatttggggtaagtgaatgttcatttcaaactggggggtctaaaaaaagttttgtttctggggcagtgtgggtttcaaagtatcgcatttacagtttcaccccgggcgtgtgcccagatccaaagtcttgcatcagaattcaactacaaacttctgggcgacagaaatgctatcttcatcttatacacacacacacacacacatactgacaattcccacacaataagtgctcaacatgtgtcttaaatgaatctacaattagacttatgataaggtgccataacttgctta

SEQ ID NO: 170132 - DNA, 601 bp, Human
aaaggaagtttctgattgggagaacttagattagccatcaaattatatttggggtaagtgaatgttcatttcaaactggggggtctaaaaaaagttttgtttctggggcagtgtgggtttcaaagtatcgcatttacagtttcaccccgggcgtgtgcccagatccaaagtcttgcatcagaattcaactacaaacttctgggcgacagaaatgctatcttcatcttatacacacacacacacacacatactgacaattcccacacaataagtgctcaacatgtgtcttaaatgaatctayaattagacttatgataaggtgccataacttgcttatttgtcactgcatctgtatttgaaatcccaagaacacatgtaaatcataagctttgtcctttcctttgtcccatcttgtcaccatataaaattatctttctacctccaaaattggcagggaggaaaagcatcttaattcacttcatgactgaaattttaaacatacctttaccgaagtctgagacttcaaagctgtgtgcccttcagcccaggtaactagtgagtgtcctcaagcattgacattatttaatggaattcattttat

SEQ ID NO: 170133 - DNA, 601 bp, Human
ctgtacatctgcacatacggagacacccacgtgcaaactcagtagaggcaatgcataatttccagagttagcacatgaatatcacatgaatgtatagtgactatatgtcagagatttacttacttcattagtgagaaaaccagtaggcagatcaagtcagttcacagagtatttgaggaacaaagatttatatggtcagtcaggaaagggaggttaaaaaaatttgtttaattgggttcaaaactgattaatgccctccaggccatacaactacaatgcttgggattatcttttctaccasagatatatcatttgcttctttactagatgaaagtcatgtgctcaatcttgtataaagtaacatgtaacttgtcagtctggtctctaatcaagggtaaataacaaaaacttttgacggtgattgacatgtttattacttttattgtagtgatggtttcatggcaatatacatatgttaaaatttaacagattttgaaataaatgtgtgcattcgttgtatgttctttatacttcaataaagctgttagaaaaaaatagtaagcccaaacaagttacattcccctaaaaaattacataatcc

SEQ ID NO: 170134 - DNA, 601 bp, Human
catccagaatctcataagctcttagggctctctgtccacggtattgtatctcagtgatgaggactctggattcgaatcctgattctgccacttactagctatgtgactctaggctacttaccgaacccctctgtgttttggtttcctatctataaaatggggatgatgaaggcacccacatcacatagagctggtgggactatgatactgagttatcacataccaggatctatacagtgctgggaggactctacatgctcagggatcatccctgttactatgagcacctgtgaatgagtgrtcgggcagccaagggtcccattcagcaagcctgaggagtgctggtggacttctcaaaatgatgagacttgaaaatgtaatttttatatgcaggacaattcccctttgcggtgtcacccagcaataactccaaaggtgtatttgggggtactaatacaagctgtctggcagttgtagatgtggtttagtgacatttgtacattttgtgatctacatgtcacacacaccctgggactggaaaaaaggtgttaacacccacaaaggggctgaccaggcagttctcagggtggcctagccagac

SEQ ID NO: 170135 - DNA, 601 bp, Human
ttccttagagtctgttgcaaattttcctctgccaatttggtaattctcagtaattattttaatagatgtagttaaagtaggtgaagttcgtaggtctcctccctcatgacattgaaactaggtattatatttaaggaaaacaagcctcaggatggattcttccctcaccaaaatatttcttagcaagcagacacaatactagttggaaaacttgttctataaacacaatgaagtatgcattttctgttcacttgggcattccaatcagcaccttgcataatattctagtggcaggattcargtgaccttgcagtcagatcagattaaaacaaacaaacaaaaaaagtggttcttaaagtgcattccctgaaccaccaccagcagcagcatcagagaatgagaatcttagaaatgcaaattgctaggccctaccccagaatcacttactacatcagcaatctgagttttaacaagtgctacccatgagaatcggtcaggaaactcccctaaccatgacagaatcaaggagcaaatgtaagccttaggttaatggcatacttagactcactacacacacacacacacacacacacaaacacac

SEQ ID NO: 170136 - DNA, 601 bp, Human
caatgccaggcctccccagacccagcaccctaaaatacaaaacccaagcagaggccgcttttcacgatgctgtcactaatcctggactagcccagggaaggggcatatcagggaagccagacttcccttctcagaagaaaccagatcaagactgtgcctatttatatccagacatacagatatagaatcccatttaggaatggtgtggggtggaatgttctgggaaatagattagccaagcttgaaaggaattgggctttaatgctagtgcctcttctcagagacactgtgggagagggtracaattctgtgggctggttaaagtacttgtcacttgagattgttcttcagccaaattctcctataagaagcatactaatggtgtttaacacatgctatgttatcagatattgaaaacaacatagtgggaaggaaaagggaccaccacctcagatcaagatggcctcctcaatgctggggagccgcgttcttgtgtttttggatagtttggatagtttggatagtttatcataaggttacccttatgggaaaccagagtttcccactggatccttgcaaagaccttcagccctaagtcatg

SEQ ID NO: 170137 - DNA, 601 bp, Human
cagaggccgcttttcacgatgctgtcactaatcctggactagcccagggaaggggcatatcagggaagccagacttcccttctcagaagaaaccagatcaagactgtgcctatttatatccagacatacagatatagaatcccatttaggaatggtgtggggtggaatgttctgggaaatagattagccaagcttgaaaggaattgggctttaatgctagtgcctcttctcagagacactgtgggagagggtgacaattctgtgggctggttaaagtacttgtcacttgagattgttcttyagccaaattctcctataagaagcatactaatggtgtttaacacatgctatgttatcagatattgaaaacaacatagtgggaaggaaaagggaccaccacctcagatcaagatggcctcctcaatgctggggagccgcgttcttgtgtttttggatagtttggatagtttggatagtttatcataaggttacccttatgggaaaccagagtttcccactggatccttgcaaagaccttcagccctaagtcatgctacacatggatccttccactctgggggaccataagaaggacctgtgg

SEQ ID NO: 170138 - DNA, 601 bp, Human
ggcaccattaggagactcagaacccatggccccgtggagctttcagtcagcttgggaggtaaatgatgttgggagtctgtaggacatgtgaattggtgaggttaaaataacatcgcgtggtcaagagtggagcacaggcacagagtcacccccaaggtgggaactccacctctcacacctaccagcctaatatggagataatgtgatttagggcagcacttctcaaacttagtgcttgatatgttgttcagtacgtgatccaatccaataagtctggggtggaactcctaacaagctcccwggtgaggccgatgctggtctggggaacacatttggagtaccaaaggtttgggggtttctatataatccccctagtttcatataaagttcttagtttgattcctatcacattgcaagttcttgacaaataactattattatgaagagtgttttgacaactaacagctgtgcggcatagaatgttagaatagatgcagctgattttgcctaacagggaaaggctgcttcaaacctggggcaaattctggtgattcagaaaatggaaggaatcacctcttcaccagtttcactcaccccttca

SEQ ID NO: 170139 - DNA, 601 bp, Human
ccacctctcacacctaccagcctaatatggagataatgtgatttagggcagcacttctcaaacttagtgcttgatatgttgttcagtacgtgatccaatccaataagtctggggtggaactcctaacaagctccctggtgaggccgatgctggtctggggaacacatttggagtaccaaaggtttgggggtttctatataatccccctagtttcatataaagttcttagtttgattcctatcacattgcaagttcttgacaaataactattattatgaagagtgttttgacaactaacagytgtgcggcatagaatgttagaatagatgcagctgattttgcctaacagggaaaggctgcttcaaacctggggcaaattctggtgattcagaaaatggaaggaatcacctcttcaccagtttcactcaccccttcaatgaggggacttagggagttgtctcagcagcagtcactgtgcttaacaatatattcccttagaataagtgctttgcatcttacggttgcattctcttcaagaaatttcatccagtgaaaataatagcaccaaacccatttttgatcatattcccatgccattaca

SEQ ID NO: 170140 - DNA, 601 bp, Human
tcagtacgtgatccaatccaataagtctggggtggaactcctaacaagctccctggtgaggccgatgctggtctggggaacacatttggagtaccaaaggtttgggggtttctatataatccccctagtttcatataaagttcttagtttgattcctatcacattgcaagttcttgacaaataactattattatgaagagtgttttgacaactaacagctgtgcggcatagaatgttagaatagatgcagctgattttgcctaacagggaaaggctgcttcaaacctggggcaaattctgrtgattcagaaaatggaaggaatcacctcttcaccagtttcactcaccccttcaatgaggggacttagggagttgtctcagcagcagtcactgtgcttaacaatatattcccttagaataagtgctttgcatcttacggttgcattctcttcaagaaatttcatccagtgaaaataatagcaccaaacccatttttgatcatattcccatgccattacagtcagggaaagagattattagtctccaaacaaatccaagtactggctctttctggagggcaagaatagaaacccagagaaaa

SEQ ID NO: 170141 - DNA, 601 bp, Human
cacactcacctctcttcctgggccctaaactcatatttcagttcagagtcttcagcaggaacgcatttttaccctaaggcacctaactaagtaagccccttgacagggaagaacagttttctgtggagtccatttgctcctcatgtcattaaggtttcagatagacttaagtgtagcattaaagaataaagagcttttcaaattacccttgacactgaagaataactgcagcctgcccaccgtgaagcaagtatcttgacagtgacagaccctcagatgtttccgtttctgatgctaaacrtctgtctcagatgtttctgtctcccaccactactgctggggctgggaacatttgtccacaactggttgcagaagttagaaattgttttgagggccacaagggcaccctataaccttgcaaatcaatcatatagattaaatctgatttgcaatcctaaaatcctgtaggaatagtcaatcaaaggcaaatttgtttttacatcttgtattttacttcatgcattgttttaaaatatgttccagaagtccggcgcagtgtctcacgcctgtaacccggcactttgggaggtcagggcaggtg

SEQ ID NO: 170142 - DNA, 601 bp, Human
tgcagtgagccaagattgtgccaccgcactcccacctgggcgacagagcaaggctccatcttaaaaataaaaaattaaaaataaactatgttccagaaaacactaaccccaccttagaagctccatgaaaaggggattttacagacacatatgaacagaaaaaatataccatgtgtgtctataggaaatgtataatgctctggggatattaagattgattttgaaaaatttcagaatttttgcttaattctttttaggctaaggatctgcaaatattttctgcatagaaccaggtagtaaytattttcagcttttgggggcatatagtctttccactcaactctgttgttgtagcatgaaaggagccattgacaacagataaacaaatggatgtgtgtgtgctccagtaaaactttatttatggaccctaaaatttgaatttcatataattttcacatgtcacaaaattttttctctgagtcttttaaatcattttaaaaatgtaaaaaccatcctcagctcaaggccaatacaagaacagctggatttggcccgtgggccctaacttcccgaaagcccctggttaatgtagcctgcccct

SEQ ID NO: 170143 - DNA, 601 bp, Human
gtctcatggtctcatggcttaaccatcctttaagactgtatttctggcagaaggagaaacagagggaggagaatacctgcttctgaactgccttagactgacagggacacactttgttctactaccactcatggactgtctctagccacagagcaccacttccttgcaatgggaattagaaatgtaattcctggctgcacagccatttcccagagatcatgctctaccatgcaacagtgaggttaaagtgcacagttgaccatctccgctacaagacaagagcccatgccttcttcaaatrtgctactcacagagaatttttcattctatcagatacctaccccatcgggccctttgcccccttcccttcgatggcctggggacatggcttcctcagaaaggcctgttgcaaacccatgggcacccatgataccagacatgtcccctagtgtaattatcatcatcctgaatcatctaattccctcttttgcttgcatctccccaattagactgaattctgtaaaggcagggaatttgcctatcttgtccatcactgtatccctagtgcctaacactgcctggcatattacaggtgctcaat

SEQ ID NO: 170144 - DNA, 601 bp, Human
gcagctcaccctcacacaagcccttttggcaacctctgatgatgactgaaatagatgaaagattttctgcctttggcttccacatgcttctaaacacaatggaacactattcaacaacaaaaattgaatgaactattaatacatgctgcaacatagataaatctcaaaataattatgctaagtgaaagaaggcagacaaaaagtagtacacactatgtgatttttatttatataaaattataggaaatgcaaactaatgtatagtgacagaaagtagatcaggctgggtgcggtggctcaygcctgtaatcccagcactttgggaggccaaggcaggcggatcacaaggtcaggagatcgagaccatcctggccaacacagtgaaaccccgtctctactaaaaatacaaaaaattagccaggtgtggtggtaggcacctgtagtcccagctactcgggaggctgaggcaggagaatggcgtgaacccgggaggcagagcttgcagtgagctgagatcacgccactgcactccagcctgggcgacagagcgagactctgtctcaaaaaaataaaaaaaagaaagtagatcagcagttttctg

SEQ ID NO: 170145 - DNA, 601 bp, Human; identical to SEQ ID NO: 26509

SEQ ID NO: 170146 - DNA, 601 bp, Human; identical to SEQ ID NO: 26510

SEQ ID NO: 170147 - DNA, 601 bp, Human; identical to SEQ ID NO: 26511

SEQ ID NO: 170148 - DNA, 601 bp, Human; identical to SEQ ID NO: 26512

SEQ ID NO: 170149 - DNA, 601 bp, Human; identical to SEQ ID NO: 26513

SEQ ID NO: 170150 - DNA, 601 bp, Human; identical to SEQ ID NO: 26514

SEQ ID NO: 170151 - DNA, 601 bp, Human; identical to SEQ ID NO: 26515

SEQ ID NO: 170152 - DNA, 601 bp, Human; identical to SEQ ID NO: 26516

SEQ ID NO: 170153 - DNA, 601 bp, Human; identical to SEQ ID NO: 26517

SEQ ID NO: 170154 - DNA, 601 bp, Human; identical to SEQ ID NO: 26518

SEQ ID NO: 170155 - DNA, 601 bp, Human; identical to SEQ ID NO: 26519

SEQ ID NO: 170156 - DNA, 601 bp, Human; identical to SEQ ID NO: 26520

SEQ ID NO: 170157 - DNA, 601 bp, Human; identical to SEQ ID NO: 26521

SEQ ID NO: 170158 - DNA, 601 bp, Human; identical to SEQ ID NO: 26522

SEQ ID NO: 170159 - DNA, 601 bp, Human; identical to SEQ ID NO: 26523

SEQ ID NO: 170160 - DNA, 601 bp, Human; identical to SEQ ID NO: 26524

SEQ ID NO: 170161 - DNA, 601 bp, Human; identical to SEQ ID NO: 26525

SEQ ID NO: 170162 - DNA, 601 bp, Human; identical to SEQ ID NO: 26526

SEQ ID NO: 170163 - DNA, 601 bp, Human; identical to SEQ ID NO: 26527

SEQ ID NO: 170164 - DNA, 601 bp, Human; identical to SEQ ID NO: 26528

SEQ ID NO: 170165 - DNA, 601 bp, Human; identical to SEQ ID NO: 26529

SEQ ID NO: 170166 - DNA, 601 bp, Human; identical to SEQ ID NO: 26530

SEQ ID NO: 170167 - DNA, 601 bp, Human; identical to SEQ ID NO: 26531

SEQ ID NO: 170168 - DNA, 601 bp, Human; identical to SEQ ID NO: 26532

SEQ ID NO: 170169 - DNA, 601 bp, Human
tacctagggaagctacgaaaaaaaaatcataataactattgagtgactaattcctccctcagcctctgcatatggaattcaaagttcattacctaccttcagctcatcccaggcagtgtcatttctgttgcagagaagcaagctgcagattgttgcttcattaggaataagatgaaaaaaatgtttggagccaaattttgcagtgcacacatctttcacacttccataactattaggacatattgagcctagggatccaataggctgtgttcctattttttaaagattagaaaatacaagwtgtataagcaaaagtggagcaaacaaccatttaaaagtatatttattcctagccaacataaaagccccacaagcatataatttaaaatatgaaatacaggataaataagatgaatattcctaaactgctaagttatattctgctattaaaatgatatacaaataaagtaaagtagaagttatttttgtttacagatctctttgaaaatcttttagaagtcattttgtactgtcttcccagaaaagggcacatacaattttgcatacattttcaaggaattcagaaaaccctcaaagccca

SEQ ID NO: 170170 - DNA, 601 bp, Human
aaaattaggagtatcataaagcggtataaatttgttgaaatatttgggtataactttggcacacgcaggtactactttaaagtgtcacaaaaagggaacataattctggtttttgtttggaaagaatagacaagttgatacctgaatttgagggttgttttgattggaagaagctaaatactacactagtatagaatatacacgtttccaatgtctcaggagtcaagaaggatggaaagttattgtaggagtccttacccttgtaaatattgtttgaatgtaattaatatttatggaatasttatgctgcagtaggcactgtggaaaatgctttacatatagtgtttcattaatgcttaaaactactcgagttagtggcatgtaattaagtcagtttttccttcactttaggatctaccatacccattgactaactatggaagattataccaaaatagagaaaattggagaaggtgagtggttttagtaaaataaattttatggaatgatttaacaatgctacaacttctgtaatatgaacacatttaaatatttattaaaattcaaccattaagatgtcttgtagtaccagtgtgcatta

SEQ ID NO: 170171 - DNA, 601 bp, Human
aaggaatgtttagatctatatatggcacaaatgaggggtatatcccttcgcctgttcctcgactccagcagaacattctcgattctccaggtacaaaataatttgctaatagaatccagtttatataggttctgccagaagaaaattcccaactatatttttaatgtgatcaaagaccccacttgacaagaaatagtgaaaaacaagggggaatactggagggaatttagtggaataggagtgacaagttagtgtggtgttcgattggaggtgtgtgtgtgtatacatatatatatatatwtttttttaaatcacttaaatacctcatacccattctactaaacaaattttgctgctgaattaaaaatatgtgattagtatgtctaatgctgtgtagtgtgtttcttaaattcccagagaatttgtgttggttttagtttggcataaaaagagaccttcttaaagtataaatatatttttctttaagatgatagaactccaaacatacaggagactgcagatttgacttctgagaaaagtactttaattgctactagaaataggagcagttaaaagaatgtaattttaaatttaatccatt

SEQ ID NO: 170172 - DNA, 601 bp, Human
taaatacctccagactttactattttaaatattacaaaaattgttctctggtttcttctgaattacagaaatctgagtgttgtgatactaatctttgaaatccttcctgtcttaagaaaatgtctttttggatcatagagtagcagtatccatgatggtggaaccttgcctggcatttagtaggcatttgataaatacttgcttaatgaaggttttctgcttaagggcctccataacttgatcatatcctacatatttttcttttgtttctttttgtttcctgggataaatcttccattaratttagactgatctccttctaggcttacctgtgttaatgatttttgcctccttagttatttatacttagttaaataccctagagtatttctgtctttagaattcttagttcattttggaggatatgccatgtatttcaaaaataattttggatgattaaccaatagaaagttctgctttgtttaacccctcttccagtagttcagtgagaagtgatattatctctaaaattcaacacattgagtgttggccactggttaattgttaattctgaaaattatttaggattagatgagattgt

SEQ ID NO: 170173 - DNA, 601 bp, Human
gagatcacttaaacagtatgccagatgattgtgctactggtttacctactttttgtgtttaatgagagctgaatttacatccaaaaaaatgtagattttaagtatatgaaggttgcctacttttaaggatggctgtgaggattaaatatagtcaattctcctttaatgtagagtaattttggttatcaaaaagttatacattaatccacaatttaatcaaaatagtataaaatgactcatgtcagtttatagttttaaaatgacaccagtatttaagaaaacatagacttttgtatagagrttctgtcaaaaaaattaagcttaagtagcatcaatttgctactgctcaaactgcttaattttttaaccaagcagttggtaatttgttggttgttagccttttttaaaatattgctactttcagagaaactcataaaagctatagaagaggccttcttcctagaacagtgcactctaatcacttttgaagttaaaccaatgccatggaaagcaagctattcaacaaaattttgtgtgtatttaaggggttcaggacctccctaaactccaactcgagtttaaaaagacttatctagggaat

SEQ ID NO: 170174 - DNA, 601 bp, Human
tctattttgttctgtaaaatatgctggaacattaatggtaatttagatgtatagaaaacttgtgatgactacatgaattttatttttaagccatacagattgtagttactctcaatttctttttggaagcaatgagggtatgagtaagatacttcccatatggccacaccagacatttctatcatgtgacccttatgggattcaatgatcttgaaatcctttagtttgaccaggtgcggtggctcacgcctgtaatctcagcattttggggcggcgaggcaggtagattgcttgagctcaygagttccagactggcctgggcaacatggtgaaaccccatctctaccaaaaagacaaaaattagccgagtgtggtggcatgtgcctgtagtcccagctacttgggaggctgccgtgggaggatcccctgagcccaggaggaggaggttgtagtgagccttgattgacccactgcactccaacctggacaagaaaacaagaccctgccataaggaaaaaaaaaaagaaaaaaagatctttagtttgtggggtgtgtcacacagcatattatttactttgtttcaggtacctatggagttgtg

SEQ ID NO: 170175 - DNA, 601 bp, Human
cctagtactgcaattcgggaaatttctctattaaaggaacttcgtcatccaaatatagtcaggtatgttgtaatatctgaatgtaagccattttctgcatgctatttcaaatataaatttcaacttggaaatctttacatttgctcaatttcttggtctagccttactgagtggactagaaccctatttttggtagttgagaatgccgcacatatgtaaaagagaacaggctgttaaagcaggaacagagttggaggagctgggtgatgtagattaatatttgggcctagaatagcaaggyaaattggccatgggagtaaagccgttttcatagagctttgtcaactctctcctacttggggaactctagttcctgaagaccctttagttagagtcttaagaaaagtagctaggtcaaatgaaaaagattttttttccttaaagtatttgcattgggtgtttttggagacctgtcttcctaacagtccaagttaaaatctaattgtacttggctggggctagagattggaagtagcttttaaggtcagataccactttaaaatttatttgtataattcacttcaatgaaaaaataagctct

SEQ ID NO: 170176 - DNA, 601 bp, Human
gcctagaatagcaaggtaaattggccatgggagtaaagccgttttcatagagctttgtcaactctctcctacttggggaactctagttcctgaagaccctttagttagagtcttaagaaaagtagctaggtcaaatgaaaaagattttttttccttaaagtatttgcattgggtgtttttggagacctgtcttcctaacagtccaagttaaaatctaattgtacttggctggggctagagattggaagtagcttttaaggtcagataccactttaaaatttatttgtataattcacttcartgaaaaaataagctctcagcaattagtagccaacctagatatgttcttttgaatacaggctccttataaataagcacctcctgtacaaggcttaattttaaatagttgccctgagattcctttcttaaatttgagttttgagtctcttccattagggaagctactacgtcttccccagtttttattatagcaactgaaattatggaaggagttttattttgtgaaacagaggtcaaaaatgtttgctggattcttctctcatatattttttttccccagtcttcaggatgtgcttatgca

SEQ ID NO: 170177 - DNA, 601 bp, Human
ctaggtcaaatgaaaaagattttttttccttaaagtatttgcattgggtgtttttggagacctgtcttcctaacagtccaagttaaaatctaattgtacttggctggggctagagattggaagtagcttttaaggtcagataccactttaaaatttatttgtataattcacttcaatgaaaaaataagctctcagcaattagtagccaacctagatatgttcttttgaatacaggctccttataaataagcacctcctgtacaaggcttaattttaaatagttgccctgagattcctttcytaaatttgagttttgagtctcttccattagggaagctactacgtcttccccagtttttattatagcaactgaaattatggaaggagttttattttgtgaaacagaggtcaaaaatgtttgctggattcttctctcatatattttttttccccagtcttcaggatgtgcttatgcaggattccaggttatatctcatctttgagtttctttccatggatctgaagaaatacttggattctatccctcctggtcagtacatggattcttcacttgttaaggtaaaagcttaactaattttat

SEQ ID NO: 170178 - DNA, 601 bp, Human
agctagggtagtctggtctttctttggctgtcagatacatgtaaaacaaagtaatgaaagcctagggcagagtggtggttgtaggtgttttattccagttttgaacatgttttggtcaatttattgtagacatttattatatttcaggtaaattataaaattgtatagttttaagtactgaagtatataaaagtgtcttattcttgcaccagttctaccaaaccactctgcagaggtagcgctgttagttttatttgtaatcttacacttgtatgtatgttcactttgtatgtatataaakatttttttttttacacaaggtgggcttatttgcatatgtatatatacatattttcccttttttgtgtaaaacattatcaagacgtagatctacctatgtctatttacatttttgatataattaaaccacttccatattgatgaacatttaaattattttccaacttggttattgttgctcttattaacagtactgcactgaatgtccttatagatatttatctttgtatgcaactttataggataaatttttagaatgggaatgatggattgaagatgtttatttacattttgatagata

SEQ ID NO: 170179 - DNA, 601 bp, Human
gtagttttagtaagtcctgtcttccacacatactttttttgtcttaaattctgtattaagatttattttgacttaaaaactgggatacagattctgctttatctttttccaaatggctagccagttgttctaactggttttatgtacaggcaacaatggttttacttacaatttttcagttttacaatgaagcagaaatgatgcacattcactagaaaccatacttcatttacccatacaaccattctgttttttcactttcagtacagtattcaataaataatgaggtattcaacacttscaactatatgctaatgtaagtgttttgagcacaattaaggtgggctacgcttagctacgtttggtaggttaggtgtgttcaatgcatttcgacaaggtattttcaacttagaatgagtttaaccagatggatcatccgttttgttttgttttttgaacaccacttgtccctctaagatggagcatctgtattactttccaatttcaaactgtaagtcatttttctgtgtactttgtttttgtaatatccatgctacttcagatgtcaatgacattgtctttggcaacaaatgtcttgtaa

SEQ ID NO: 170180 - DNA, 601 bp, Human
ttatatggtagttctagtttgtagttttttgagcatcctctaaacagtttttcataatggctctactaatttaagagcccaccaacagtgcgtaaaaagttgccctttctctgcatccttatcagcacttattttttgtcttttgatgataattactctaactgggtgtgatagctcattgtggttttgatttgcatttccctgatgaatagtgatgttgagcactttttcatatacttgctggtctttgtatgtcttttgagaaagttttattcagattgtttgaccatttttaaaattsgattcttactattttttttattctggatgttaattctttgttgtatgaatgatttgcaaataatttctcccattctgcagattgttgcattattctgttattctgttcattctgtttcttttgctgtgcagaagctttttagttcgatataatcctgtttgtctatttgttattgctgagacagggtctttctctgtcacccatgctggaatgcagtggcgtgaacagggctcactgcaacctcaacctcctgggctccagtgatccttccacgtcagcctcctgagtaattgggcccat

SEQ ID NO: 170181 - DNA, 601 bp, Human
agctcattgtggttttgatttgcatttccctgatgaatagtgatgttgagcactttttcatatacttgctggtctttgtatgtcttttgagaaagttttattcagattgtttgaccatttttaaaattggattcttactattttttttattctggatgttaattctttgttgtatgaatgatttgcaaataatttctcccattctgcagattgttgcattattctgttattctgttcattctgtttcttttgctgtgcagaagctttttagttcgatataatcctgtttgtctatttgttrttgctgagacagggtctttctctgtcacccatgctggaatgcagtggcgtgaacagggctcactgcaacctcaacctcctgggctccagtgatccttccacgtcagcctcctgagtaattgggcccatacacaggcatgcaccaccatgctaggctgatttttaaattttttagagacggggctgtcagcatatttcccagactgttctcgaactcctgggctcatgcaatcctcccgctttggcctcccaaagtgttgggattataggcatgagctgctgcacctggcctcatttgtct

SEQ ID NO: 170182 - DNA, 601 bp, Human
agctgctgcacctggcctcatttgtctatttttgattttgttgcttgagcttttgaggtcttatccatatgatttttgtccagatcaatatcaataacagtgtttcctctgttttcttccaatagtttcatagtttaaggtcttatttaatccattttgagttgatttttgtgtatggttagatataggggtttagtttcattgttctgcatgtggattatccagtttttccagcaccatttattgaagagattggcttttccctagtgaatgttcttgtcatctttctcaaaaatgagtygactgtaaatacatggatttatttctggattctctattttgttctgttggtctctgcgtccttttttatactaatatcatgatgtttcggttactatagctttgtaatacatttttgaagtcaggtgatatgatgccttcagctttgttgtttttgctcaagattggtttagctattgtgggtcttttttggttctatatgaattttaggatttctttttatttctgtgaagaatgtccttggtattttgatggagattgcactgaatttgtagattgcattgggtggtaatatggtcat

SEQ ID NO: 170183 - DNA, 601 bp, Human
gtgtagagattatacatctcatttgttaaatttattcctaggttttttgtacctattgtacattagattgctttcttgatgttatttttcagctagttattggtgtatagaaactattaatttttgtatgctgattttgattttgtatactgcaactttgttaatcagttctaagagtttttggtggagtcttttaagtttttctatatataagatcatctctgcacacagggacaatttgacttcttccttggcaatttggatgccctttatttctttctcatgtttcttattcatgttrtaatggtactgttagtaccatcttagcaagtaagcagtacctgcactttgttcagtgtcaccccaaatctattatcaatgggtttggtttttcagtggggggaagataaggctgtataactgtcttgatctttagtgatttgaaaagcaaaaaaatatttattatgcttttatctgttttgtcttctaatgaatagaacttagaaatgaaatatttatcttcaattttgtgtacctttaattgacttaaacaatattattggtggcagtcatacaacctttaaaggacagccctaataaa

SEQ ID NO: 170184 - DNA, 601 bp, Human
attgacttaaacaatattattggtggcagtcatacaacctttaaaggacagccctaataaaaatataaatgtttaagtgtaggtaattttatgcaccacatttattcattgtaaaaatttgctttttaataggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcaggtagctattaaaaactgagataataaaggtaacatatatgtaacaatgagattacatttatgctttaagaaatttttgttttcctgttttttagagctttgggcactcccaataatgaagtgtggccagaagtggaatctttacaggactataagaatacatttcccaaatggaaaccaggaagcctagcatcccatgtcaaaaacttggatgaaaatggcttggatttgctctcggtaaggagtgcccttgatactgactttcaaattattgatgattctgaatatattcagttctttgttttg

SEQ ID NO: 170185 - DNA, 601 bp, Human
ctgggcctctcaaagtctgagccccgctccgctgatgcctgtctgcagaatccgcaccaaccagcaccatgcccatgactctggggtactgggacatccgtggggtaagcgagggtcctctggtgggtgggacagggggcggaggcggggatgtgtggagtagctgcaggactggctctagggaccgttcctcttcagggctgcccgcctcagaagggcctgtgcatgacgctgtgtgtgtgtttgggggtgggggcgggtagaggaggcgacgggtacgtgcagtatagactaggggctsgcctggtgcagagaaagtcaccaagtcagggaccctccatctctgacccgagccgcgggccatctctcccagctggcccacgccatccgcttgctcctggaatacacagactcaagctatgtggaaaagaagtacacgctgggggacggtaatggcaccctcgtgtccgggccctgcccactcacgctgagttggcaccaagcaacccatggtggccacctgtggctgcctctgcaggcctcccctgctggagctgcaggctgtcccttccctgagctcccgtgagtgagccctctggcc

SEQ ID NO: 170186 - DNA, 601 bp, Human
tctcaaagtctgagccccgctccgctgatgcctgtctgcagaatccgcaccaaccagcaccatgcccatgactctggggtactgggacatccgtggggtaagcgagggtcctctggtgggtgggacagggggcggaggcggggatgtgtggagtagctgcaggactggctctagggaccgttcctcttcagggctgcccgcctcagaagggcctgtgcatgacgctgtgtgtgtgtttgggggtgggggcgggtagaggaggcgacgggtacgtgcagtatagactaggggctggcctggkgcagagaaagtcaccaagtcagggaccctccatctctgacccgagccgcgggccatctctcccagctggcccacgccatccgcttgctcctggaatacacagactcaagctatgtggaaaagaagtacacgctgggggacggtaatggcaccctcgtgtccgggccctgcccactcacgctgagttggcaccaagcaacccatggtggccacctgtggctgcctctgcaggcctcccctgctggagctgcaggctgtcccttccctgagctcccgtgagtgagccctctggccttgcaag

SEQ ID NO: 170187 - DNA, 601 bp, Human
tgtgtggcaccacctgggtaccgggcctggggcctgcccctcactcacggggaaccatccctcacctgtgttgaagttgtttgagagcagcaaatcctactttagtacagatttggggatttgaggcattagtccaacaggcttctgagcctagaatctgtttccctttcccactccccatcaagaaatctgcttgctcagctagttcccatcagctctggttctggtccagcctgagcagccttggggttatgtaagaggtggtgggaggggagcggtggggaacagccgagggctgggkcatggagcctgcctgggcctggccctggccctttggggagagggagccctggatctctttgaattctttagaagttacatggtcattgaatcctggtaagattgtgtgcagcacacctgagtgtcatgtggcctggctagcagtagtagggctggagatgtgatgggggcacagggacatagggagatttagctcaggtaccaggtggagaagtttggactttatgctttaatgggaatgattagagcctggtctggccttcctttggtggttcacccttaccctattcagtttcatcca

SEQ ID NO: 170188 - DNA, 601 bp, Human
gctccggtgagcccaggtgatcccaggctcaggagctgacactgtcttcatgtcccccaggcagaggggcttccacacgtttgtgctgaggccacactgtggggaggctgggcccatccaccacctggtgtcagccttcatgctggctgagaacatttcccacgggctccttctgcgcaaggtcaggatctgcacccctagccttccctcccaattgttcaccttcctctgaaccattcgggccccttcagcaaccgatcctcctcccacccagccctcagattggattctgccttcccartgtaactacccttccccaccccagccttcagcctggggccccaacttggattttgactaattcaccctttgcacatcaggccaagcctggattcccctccccctgccctctgctgtggcctggacccccagaaccactgtgccctgcccagcctcggggccacctgacaggccctccctccctgttgcctgcccaggcccccgtcctgcagtacctgtactacctggcccagatcggcatcgccatgtctccgctcagcaacaacagcctcttcctcagctatcaccggaatccgctacc

SEQ ID NO: 170189 - DNA, 601 bp, Human
gcacgaccagtcgcggccagactgtgccagtctgccgcacaggcagcacccttcctgtgaaggctaggcccggggaggagagacgggccaagaccaggccgcagtccccagccgaccccgatttgaccactctaggttgaggcccagcctcagggccctcaaagggcgccagacacaaaagccgcgcttcttcgtcaggtctcagtgtggctccacagccctcggccgggtctgggcttcagggtaggtggcagttccagtccaacttcggcagagcatgctctctccttcccaggtccarctgctttcgggccccgactggactccgggccgtcgccactgcaccttccctcgacctcccgcctcccattcccgccgccgaggaacggtggttcaccctcccgccccacactggcctttgcctggcccgggccagcgccaacccggcttccgtggaagccgtggcgaaaggcgagaggggcaaaaagttgagaaataggcgagcgggagagataagcaggaaggcccgggtgggcccgggtaaggaagaagaagagagggtcgggctgcgcgctacgccccgcgccgcgcgttaccttcc

SEQ ID NO: 170190 - DNA, 601 bp, Human
cggtgccggatgcggcgcgcctagcagggacgcgggcctgggggggtggctcctgcccgacgcggagcgctgagccaggccgggtacctgtctctggcggtgctcaccgcactgcgcggcctctgccgtctggctgggatcagaggagccaggccaactgcttctcattaagtcccaactgtggtttttatcaggaaagcctctttcaaagggcacagacacgaagctccgcggactcgttcatttcctccgttgacccacacacacctccccgccctcccctacacattcccaccgcccyggctgggcgaaagccggagatgcccggccactccgtggaggcccgcgaggcgccagccgggcggcggcagggggttgaggcggatcttggaggatccagttctgggcctaggctgcgggatatggcagcgcagataaggtgggtgcagtgcggaagccgagacgccttacaggtcatagggtgcggcggacggccgcagagctgccgatcagcctgccaggcccctgccttcaggcgcattctcggatgccggcgcggtccagccggccttagcacagggcaccggcccgtgagcccgcg

SEQ ID NO: 170191 - DNA, 601 bp, Human
tgtggggtcactaagcgacctgcagaactcgctgaggcccaggctcctgcagctcccgccgaagactcaaagccagagtggacataaacgccgtgggcaggaccccggtgaggcctcggtgcccttcttgggggttctcagcgttggcccagaagcctcagcccgggtctaagaacttgggactctcctcgactttggcgatcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaaccgggaaataaggcgggttccctcttcgcccgccacttc

SEQ ID NO: 170192 - DNA, 601 bp, Human
tggtggatcgaccgacagagcatggtgaaaaataggtcactctgattgcccacaccctctccctctggcaaggacccccagcggtgtccccatgaaatccctcctcaacagtccactgggatggcagctgagacgccacaaagacgccccactgactcacacagcctcttgcctggctctgggcccatctccagtggaggcctggccctgaggaggcccagctagctggcacaagaggcagtgtcttcccaggacttggtgtcaggatcacagctgtggttgggggaggatgggactggasaaatgggcctctcaggatctgggtctggtgagtccctgtctgcactgtgaaggacaaatggggcagggtcctcctcagctggaaggtggtcagttactttccaggactacccaggccatgagataagctcctggtgtgtgtcctggaggactgggagagtcgagcagggctacctagccttggaccatgcccagcctgtacacaggcctgtacacaggtagcccacagctacagcccagggaccagggctccttcacaactcaggtggagcacaggggagaaagtgttccagtctctgac

SEQ ID NO: 170193 - DNA, 601 bp, Human
acagggcacagcccctgtccccatcattcccatcattgaccaccccctccttcctcaggagtttctaactgctcccccattgcctgtgtttaacaggcagggaaggacttgattacagactggaacagtttccagcagccccactctgacatgctaacccctactccagaagcttggcggagcctcaccatggtggatcgaccgacagagcatggtgaaaaataggtcactctgattgcccacaccctctccctctggcaaggacccccagcggtgtccccatgaaatccctcctcaacastccactgggatggcagctgagacgccacaaagacgccccactgactcacacagcctcttgcctggctctgggcccatctccagtggaggcctggccctgaggaggcccagctagctggcacaagaggcagtgtcttcccaggacttggtgtcaggatcacagctgtggttgggggaggatgggactggagaaatgggcctctcaggatctgggtctggtgagtccctgtctgcactgtgaaggacaaatggggcagggtcctcctcagctggaaggtggtcagttactttccaggactac

SEQ ID NO: 170194 - DNA, 601 bp, Human
gcaagatgggacaaagaagcttccagagggattgcttctctccattcctcctaaaattgtggtatctgggcaaggacttaagctccagcaatagagaagcagagctgagataggctgtgctcaaagaaggagagttggggaccagtgtcacaacagggcacagcccctgtccccatcattcccatcattgaccaccccctccttcctcaggagtttctaactgctcccccattgcctgtgtttaacaggcagggaaggacttgattacagactggaacagtttccagcagccccactctgrcatgctaacccctactccagaagcttggcggagcctcaccatggtggatcgaccgacagagcatggtgaaaaataggtcactctgattgcccacaccctctccctctggcaaggacccccagcggtgtccccatgaaatccctcctcaacagtccactgggatggcagctgagacgccacaaagacgccccactgactcacacagcctcttgcctggctctgggcccatctccagtggaggcctggccctgaggaggcccagctagctggcacaagaggcagtgtcttcccaggacttgg

SEQ ID NO: 170195 - DNA, 601 bp, Human
tcactaaccctgagacctcctgacagggaccctcccattctaggcagccacctcaggagcagccctgatgtgtgttcagcacttcaccgcttccaaaatgcggccatccctgtgatcctcaggatagtccctacgcagccagtcccatcattcccttttcctgaactgggaaactgagactgagagatctattaacataccccaaatcacctccagtaagtggtagactttaggactcccacacaggtgatggcttccagaggccatcgcccttatacccaggcataagcttcaatttggrccagaagagcctgtggctgcagcagagctgggcatgagggtgagcccaggaggggaaggctggtgcaggcccctgggaaaggtagctctgggaggcaccagtgcccacctctcccagcccttccagatcactttctggtcactgtgtgataggggcagccagagagccccatccttgcagtgccctcacctgtacccgggcctcagtcaggtctgtgcgcagggccagctgctcccgggcatacacatcaggatagtgggttttctggaagaccttctccagctcctccagctggaatgt

SEQ ID NO: 170196 - DNA, 601 bp, Human
agccagcctttcccagccagggtctgagcgctggcagggacccaaggtcggtggctcctgatgactttgagaatcactaaccctgagacctcctgacagggaccctcccattctaggcagccacctcaggagcagccctgatgtgtgttcagcacttcaccgcttccaaaatgcggccatccctgtgatcctcaggatagtccctacgcagccagtcccatcattcccttttcctgaactgggaaactgagactgagagatctattaacataccccaaatcacctccagtaagtggtagastttaggactcccacacaggtgatggcttccagaggccatcgcccttatacccaggcataagcttcaatttggaccagaagagcctgtggctgcagcagagctgggcatgagggtgagcccaggaggggaaggctggtgcaggcccctgggaaaggtagctctgggaggcaccagtgcccacctctcccagcccttccagatcactttctggtcactgtgtgataggggcagccagagagccccatccttgcagtgccctcacctgtacccgggcctcagtcaggtctgtgcgcagggcca

SEQ ID NO: 170197 - DNA, 601 bp, Human
tccaacccacccctcccagtgtctcctgcttggtatcgggaagcctgctttgatcgagccggttcagtgcaagccagtgaatggccatcttcctcttgggccagactcttactgaaactccttccccatccccagcctgcttgccaccttcatgtgcttgacacttccagcatgcttggacgtgggcttcccttgccttcctcccttctcagcatttacctacccacaggctgggctccccccatgtaaaactggccatggcccctctgggaagccctggcacctgatctccatgggggaktttgttaggatggggaagggctcccagccagcctttcccagccagcctttcccagccagggtctgagcgctggcagggacccaaggtcggtggctcctgatgactttgagaatcactaaccctgagacctcctgacagggaccctcccattctaggcagccacctcaggagcagccctgatgtgtgttcagcacttcaccgcttccaaaatgcggccatccctgtgatcctcaggatagtccctacgcagccagtcccatcattcccttttcctgaactgggaaactgagactgagagat

SEQ ID NO: 170198 - DNA, 601 bp, Human
ctcctctgcctaagaggtcacctcctcacctttccccagaactccaacccacccctcccagtgtctcctgcttggtatcgggaagcctgctttgatcgagccggttcagtgcaagccagtgaatggccatcttcctcttgggccagactcttactgaaactccttccccatccccagcctgcttgccaccttcatgtgcttgacacttccagcatgcttggacgtgggcttcccttgccttcctcccttctcagcatttacctacccacaggctgggctccccccatgtaaaactggccayggcccctctgggaagccctggcacctgatctccatgggggattttgttaggatggggaagggctcccagccagcctttcccagccagcctttcccagccagggtctgagcgctggcagggacccaaggtcggtggctcctgatgactttgagaatcactaaccctgagacctcctgacagggaccctcccattctaggcagccacctcaggagcagccctgatgtgtgttcagcacttcaccgcttccaaaatgcggccatccctgtgatcctcaggatagtccctacgcagccagtccc

SEQ ID NO: 170199 - DNA, 601 bp, Human
aggcctaggagaggagcagaggaagtgctctccacctcccacaaacacttgctttgggaagagctggttagaccacaccccggaggcctgctgaggtgactccatggtcctgattcccatggcttatatcatctggggttgccttgaatgccgggcctcttgccctgatgacctcagcccctggaggccttgggggacagtcttggaagtctgttttggctcctcggaggagcagggaggcaggagaacgcagcagagaaggggaaacagcccaagcctctctcatcctgttggatgcagycgtagggccttctctgttagatgacagctggcctctttatagactggcctgtcagtccccatatcctgccaggactatctcctgccctagtgccttcacaaagggtctctggaagggccccatgcagggtgggatagcatgagctttgttcctgctaagtctcctccatggtgggagagagactcctctgcctaagaggtcacctcctcacctttccccagaactccaacccacccctcccagtgtctcctgcttggtatcgggaagcctgctttgatcgagccggttcagtgcaagcca

SEQ ID NO: 170200 - DNA, 601 bp, Human
cctggctgtgtctagtaagggtgttgtgggggcatctgtgggcctcaggggccctaggtacttcctgggtatactgtgtacatgtgttgggtttctagtctccctgcctcatctccttttccaggctacccacctcatagcatccgaggaatcttagacatttctgttcaggtcatggtcctgtttaaaccctcagtgactccctggagaccttggtccagagcatagcttcttaacaaggcccctgcctctctgcacagcctcatatcctgccaggcaaacacatttattcttctggttrcctcccaagctcccgcccagctcttctgaaacactgctatcttgctccttccatcttttgcttaggttttctcttcctgggctactcatcccctcaacacatacatccacactgggcatcctccacaggacttccaaaataccctggacctctctttgtactcaccccattccattaccatgatctgttttggaatctgtttctcccatttatttgtgagcccttggcagataggggtggcacatctgtgtgttgtgcacatctgtgtacatatctgtgatgaattcgttgtttggtata

SEQ ID NO: 170201 - DNA, 601 bp, Human
tgtactcagtgtccctccccccaggtctgcaagccagtttcttggagaagctgtgcgtcaccctgctggtcctccgggtgaactcttaagagaaatagaaagggaaggcgagccttgagtttaggaattctccttagaaaacacttgctaaatgtaaatatttttggagctaaacagacatgacaacgaaatgcgatacccgcttattgaatatatcctagatcagaaaaaaaagttgtaaaagacagtttgtggggacagttggggaaatttgaatatggactgtataatacagaatacygtaccaaggttaacctcttggaacctcttccacaagagaatattcttaggagatacatgctaaagtattcaggagtaacatgacactatgctaccttctcccaatcggttccgtaaaataaacaagtgtatataaagaatgatagcaaaaagaaaatgtaaatgttctgaggaagggggaacagtactcattatttcccctgtcgggtcgaaggctgactgtttctaactggaaaggaaagtcagctggcagggtatgcggaatggccatctggtgagcaggctgggtggggagagatgc

SEQ ID NO: 170202 - DNA, 601 bp, Human
gcaaattgatgcagaaacaaccaaatactgcatgttctcacttataagtgggagctaaaaattgggtacatatggacataaagaggggaaccacagacactggggactacaagatagggagggaggagggttgaaaaactccctattggatgctgtgctcactatctgggtgaggggttcaattatactccaaatctcagcatcagacaatatgcctttgtaacaaacctacacatgtaccccctgaatctaaaataaaagttgaaatgtaatacaaaacagaaaaaaaacctctttcccyatgatataaaaccacttgtaatttttttttaacccctcagttacagatgaagtctgcctgatgcaactaaggacttagttacctggaaagcctgatctcagtgactgtggggtggccactcctagaactgtactcagtgtccctccccccaggtctgcaagccagtttcttggagaagctgtgcgtcaccctgctggtcctccgggtgaactcttaagagaaatagaaagggaaggcgagccttgagtttaggaattctccttagaaaacacttgctaaatgtaaatatttttggagcta

SEQ ID NO: 170203 - DNA, 601 bp, Human
gactgagcattctcaggtttaagagatgataggaagagtagatgactggattcaggaacacttctgtttgtttgttttgagagagtctctcatggttgcctaggctgcagtgcagtggcacgatcttggctcacttcagtctccacctcctgatttcaagcaattctcctgcctcagcctcccaagtagctgggactacaggtgcatgccactgcactcagctaatttttgtatttttgtagtgatcgggtttcaccatgttagctaggctggtctcgaactcctgacttcaagtgatccrcacacctaggcctcccaaagtgctgggattataggtgtgagcccccacacccagcccaggaacatttctgcttttgctctaggggcattttcaactttctcctgggttcggcatgggcctctgactttagcagtttttggcagctcctggccttgttcctgcccacccctccactcagatgccaaagatttcctaagtgatcctattcgtaggcagctctgagcctttctccagaaagcctgcttttaggcaataggaaagggggaaaaaagtgaattcttaccaggaaaaaatgaatca

SEQ ID NO: 170204 - DNA, 601 bp, Human
agctgtgtggggcatagctggggttcaccaacattctggaatgggcatgctgatgatgcagatcaccactgtcacacctcaacccctgggagggtgagggaaagaagttaatttaaaaaatggaatgcctcgtctagttgcttatgggtaaaggagaagaatcaggctcccccttcaaaatccttgtcctccctttccaaacacatcggaaatatagatagcataaactatagttagtggggatggattgggaagtagacagcaggccaaacagaggaaatgtccccaccccttatcggtrgaaggggctgtgcccacagtgttctatctatgctgggctgaactggggagatcacccccagagcactttttagcacctcccagtgctacttttgggatggttaaaagtatgattgtccccaaaccctaattgccatgcagccagtacagaactgctgattgtgactgagcattctcaggtttaagagatgataggaagagtagatgactggattcaggaacacttctgtttgtttgttttgagagagtctctcatggttgcctaggctgcagtgcagtggcacgatcttggctcacttca

SEQ ID NO: 170205 - DNA, 601 bp, Human
gatgttttcccaccatcctatttgtagaattcttagatatctgcatgtgaactataggattattagaaggcaccaagacctgtgctacctttccccgtgagctgcttactgtagggctgagtaggggggaagtgtcggcaagaaaagggtgtttttttttgagtgcatctcaaagttaatagaactctggaaacacttaagaattgtgcagctggtgccactctctggagagctgtgtggggcatagctggggttcaccaacattctggaatgggcatgctgatgatgcagatcaccactstcacacctcaacccctgggagggtgagggaaagaagttaatttaaaaaatggaatgcctcgtctagttgcttatgggtaaaggagaagaatcaggctcccccttcaaaatccttgtcctccctttccaaacacatcggaaatatagatagcataaactatagttagtggggatggattgggaagtagacagcaggccaaacagaggaaatgtccccaccccttatcggtagaaggggctgtgcccacagtgttctatctatgctgggctgaactggggagatcacccccagagcactttt

SEQ ID NO: 170206 - DNA, 601 bp, Human
taaaataacatattctagggggaaaatgagattgtttagtactgaagctaatgtttagcaagtactactattatgtgttaagagttttgtattacataaatcctggctggggacctctgcccctatcttgtctagcacgagggaggaggcctgatgttttcccaccatcctatttgtagaattcttagatatctgcatgtgaactataggattattagaaggcaccaagacctgtgctacctttccccgtgagctgcttactgtagggctgagtaggggggaagtgtcggcaagaaaaggktgtttttttttgagtgcatctcaaagttaatagaactctggaaacacttaagaattgtgcagctggtgccactctctggagagctgtgtggggcatagctggggttcaccaacattctggaatgggcatgctgatgatgcagatcaccactgtcacacctcaacccctgggagggtgagggaaagaagttaatttaaaaaatggaatgcctcgtctagttgcttatgggtaaaggagaagaatcaggctcccccttcaaaatccttgtcctccctttccaaacacatcggaaatatagat

SEQ ID NO: 170207 - DNA, 601 bp, Human
acaacttcttatcctgcgtccttttctagtatcaccctagctcctcctgaccttcacaggcaaacttctgtaaaaaatggtctattaggtatctccactttctgtcattctgctactccactgaaaactaaagttcactaactttggcccccactgctccactgtactagctcttatcaaggttattagatttctttgttgctaaaccaatagagtcttgttatttctctcctatttgacctctcagtagcatctgctcgtcacatttctctgaaatgcaaatctatcacatccctgcttratttttctcattagcttctcatagcctcaagagccattctcatctcttcagtttcatcaactatccccttcatccttatttgtttattcataaatgtgtgcagctatcaattcatccatccatctatccatccaccaacagtattttactgagtgcctactatgttccaggctgtatactggcactgggcttacggtaatgagcatatactcatgagcaatgcagacatagaccctgcccccatggaacattcagtctagtaagacagactgaatacagaaaacagtcatacaaatatat

SEQ ID NO: 170208 - DNA, 601 bp, Human
gcaggaacaccttaagcaggacttcccccacaccccacctccaataagagcttcctcactagatcattttaattattgtctgggaaaggagttggatcagcctcagtgacttattttcaatacaggcaccaggctttgtcagagttagttttatctaataacaacttcttatcctgcgtccttttctagtatcaccctagctcctcctgaccttcacaggcaaacttctgtaaaaaatggtctattaggtatctccactttctgtcattctgctactccactgaaaactaaagttcactamctttggcccccactgctccactgtactagctcttatcaaggttattagatttctttgttgctaaaccaatagagtcttgttatttctctcctatttgacctctcagtagcatctgctcgtcacatttctctgaaatgcaaatctatcacatccctgcttaatttttctcattagcttctcatagcctcaagagccattctcatctcttcagtttcatcaactatccccttcatccttatttgtttattcataaatgtgtgcagctatcaattcatccatccatctatccatccaccaaca

SEQ ID NO: 170209 - DNA, 601 bp, Human
aagcccaggtgtactctctgtctccaggggtttcgtagcgttggcttttcaaggccacttctgctttcaacctggccatgcattgcttatgaaccacaaaaccagctgggcatggaggctcctgcctataatcctagtactttgggaggccgaggtgggtggatcgcttgagcccaggagttcaagaccagcctgggcaacatggcgaaaccccgtctctacaaaaagtacaaaaaattagctgggcgtagtggtataacacctgtagtcccagctacctgggagggtgaggtgggaggawcacctgaacctgggaggtcgagggtacggtgagttgtgatcacactactgcactccagcctgggcgacagtgagaccttgtctcaaaattaataataataaaagaaccacaaagccttaggttccccttcattaattccactttctcggcccgcctgttacagttctgtactcatctcgcttgatatctgctccctggacaatcatttactctcaaggttttaattaccacctgcatacttatggtggtgtagctgaacagggttctgcaatcagtctgccttaacttgcatccaggctg

SEQ ID NO: 170210 - DNA, 601 bp, Human
tgagccagtttattaatctgggtggtgccagctgatccatcaaatgcagggcctgcaaattatctcaagcactgatcttaggtttcacaatagtgatgttatcccccgagcaatttggggagggtcagtcttgtggcctccagctgtatgactcctaaaccataatttctaatcttatggctaatgtgttagtcctacaaaggcaatctagtccccaggcaggaaggaagtgtttttttttttttttggaaagggctgttaaaaggaggttttttttttttttttttttttttttggaaasggctgttagtttctctttcaaagttaagctatcaactaagtttcccccaaagttagttcagcctacgcatgggaatgaacaaggacagcttggaagttagaagcaggatggatggagttggttaggtcagatctctgtcactgtaataattttctcagttataactgcaacagcagttccaagatcaggaaattgaagtttagagaggtaaaaagttgcttaaaataggggtactggaactgagatttgaacccagattagactgactctagacctggcactcttttactgccctcagta

SEQ ID NO: 170211 - DNA, 601 bp, Human
accagatgagccagtttattaatctgggtggtgccagctgatccatcaaatgcagggcctgcaaattatctcaagcactgatcttaggtttcacaatagtgatgttatcccccgagcaatttggggagggtcagtcttgtggcctccagctgtatgactcctaaaccataatttctaatcttatggctaatgtgttagtcctacaaaggcaatctagtccccaggcaggaaggaagtgtttttttttttttttggaaagggctgttaaaaggaggttttttttttttttttttttttttttggaaacggctgttagtttctctttcaaagttaagctatcaactaagtttcccccaaagttagttcagcctacgcatgggaatgaacaaggacagcttggaagttagaagcaggatggatggagttggttaggtcagatctctgtcactgtaataattttctcagttataactgcaacagcagttccaagatcaggaaattgaagtttagagaggtaaaaagttgcttaaaataggggtactggaactgagatttgaacccagattagactgactctagacctggcactcttttactgccc

SEQ ID NO: 170212 - DNA, 601 bp, Human
tcaagacaggaattgcaatagagaaagagttattcccacagagcccattgtgcaagagactggagtttattagaccaatcagtttccccgagcttttggggatcagagtttttaaggataatttggtgggtgggaggccagtgagttgggagtgctgattggttgggtcagagatgaaattctatcaaagctgcccttttgcgctgagtcacttctgggtggaagggtggagggggacccacaaccagatgagccagtttattaatctgggtggtgccagctgatccatcaaatgcagggyctgcaaattatctcaagcactgatcttaggtttcacaatagtgatgttatcccccgagcaatttggggagggtcagtcttgtggcctccagctgtatgactcctaaaccataatttctaatcttatggctaatgtgttagtcctacaaaggcaatctagtccccaggcaggaaggaagtgtttttttttttttttggaaagggctgttaaaaggaggttttttttttttttttttttttttttggaaacggctgttagtttctctttcaaagttaagctatcaactaagtttcccccaaa

SEQ ID NO: 170213 - DNA, 601 bp, Human
caataggcatatgaatacacacatatacatgtattttttccagtagtttaggattattttaatccaaatgtcttagttacaaagaaaattgtgagttgaatcattttttattcatttgtgaaaatttatagttgacattacataaactcttaaggaacatactctttttaccaaagtatttgtttcttttttatctatttcagtgagtccgatgggggaggagtttttttaaatgcagatttttgtcttaaagggaaaatgggaaaagtgagggtttttgatggggcgggggcggggggggaagggggaagccttatttccccagaagtatcgcttttactgcaagctgtttccagctgcacggaatgccctccatctcctcagacattgagccctatggtgaattctgagttgcttgtgtgagctggcaaagcctgcaagtatttcaagatctcttttgcgtatgtattctccagggaagagaagcatgtttactttagaaattatgctcatttcctctcttgcaataccttgtgaaatcgattgctctgaaagtcttaacttccatttctcaaagggagaaagctgaacgctaaatctt

SEQ ID NO: 170214 - DNA, 601 bp, Human
gatgacagatgctaatcttgcctttggagctgaatagttgcttgcattcagcgtgtcctgatcaaagctatgatttgtatggtgcttctaaagatagaatgggctataggttctgctatcctatcatggatttgtcagctggtcccattcaccatgagactactgaatagttaggaaagattcaacaaaactgccatgtagatagcaataggcatatgaatacacacatatacatgtattttttccagtagtttaggattattttaatccaaatgtcttagttacaaagaaaattgtgagwtgaatcattttttattcatttgtgaaaatttatagttgacattacataaactcttaaggaacatactctttttaccaaagtatttgtttcttttttatctatttcagtgagtccgatgggggaggagtttttttaaatgcagatttttgtcttaaagggaaaatgggaaaagtgagggtttttgatggggcgggggcggggggggaagggggaagccttatttccccagaagtatcgcttttactgcaagctgtttccagctgcacggaatgccctccatctcctcagacattgagccct

SEQ ID NO: 170215 - DNA, 601 bp, Human
acaaaaaatacaaaaaaattaattgatgtggtggtgtgcacctgtagtcccagttacttgggaggctgaggtgggaggatcgcttagcctgggaggtggaggttgcagtgagccggtatcatgccacagcactccagcctgaatgacaaagcgagagagcctgtctcaaaaaaaaaaaaaaagcagcgggagggaggaaggcatggatagcctttcatcccatgacattttttagatcttccttaaaagatgacagatgctaatcttgcctttggagctgaatagttgcttgcattcagcrtgtcctgatcaaagctatgatttgtatggtgcttctaaagatagaatgggctataggttctgctatcctatcatggatttgtcagctggtcccattcaccatgagactactgaatagttaggaaagattcaacaaaactgccatgtagatagcaataggcatatgaatacacacatatacatgtattttttccagtagtttaggattattttaatccaaatgtcttagttacaaagaaaattgtgagttgaatcattttttattcatttgtgaaaatttatagttgacattacataaact

SEQ ID NO: 170216 - DNA, 601 bp, Human
ggtgaaaacctgtctctacaaaaaatacaaaaaaattaattgatgtggtggtgtgcacctgtagtcccagttacttgggaggctgaggtgggaggatcgcttagcctgggaggtggaggttgcagtgagccggtatcatgccacagcactccagcctgaatgacaaagcgagagagcctgtctcaaaaaaaaaaaaaaagcagcgggagggaggaaggcatggatagcctttcatcccatgacattttttagatcttccttaaaagatgacagatgctaatcttgcctttggagctgaatrgttgcttgcattcagcgtgtcctgatcaaagctatgatttgtatggtgcttctaaagatagaatgggctataggttctgctatcctatcatggatttgtcagctggtcccattcaccatgagactactgaatagttaggaaagattcaacaaaactgccatgtagatagcaataggcatatgaatacacacatatacatgtattttttccagtagtttaggattattttaatccaaatgtcttagttacaaagaaaattgtgagttgaatcattttttattcatttgtgaaaatttatag

SEQ ID NO: 170217 - DNA, 601 bp, Human
tgtagtcctagcattttgggaggctgaggcaggcagatcacttgagcccaggagttcaggaccagcctgggcaacatggtgaaaacctgtctctacaaaaaatacaaaaaaattaattgatgtggtggtgtgcacctgtagtcccagttacttgggaggctgaggtgggaggatcgcttagcctgggaggtggaggttgcagtgagccggtatcatgccacagcactccagcctgaatgacaaagcgagagagcctgtctcaaaaaaaaaaaaaaagcagcgggagggaggaaggcatggwtagcctttcatcccatgacattttttagatcttccttaaaagatgacagatgctaatcttgcctttggagctgaatagttgcttgcattcagcgtgtcctgatcaaagctatgatttgtatggtgcttctaaagatagaatgggctataggttctgctatcctatcatggatttgtcagctggtcccattcaccatgagactactgaatagttaggaaagattcaacaaaactgccatgtagatagcaataggcatatgaatacacacatatacatgtattttttccagtagtttaggat

SEQ ID NO: 170218 - DNA, 601 bp, Human
ctggccaggtgctatggctcatacctgtagtcctagcattttgggaggctgaggcaggcagatcacttgagcccaggagttcaggaccagcctgggcaacatggtgaaaacctgtctctacaaaaaatacaaaaaaattaattgatgtggtggtgtgcacctgtagtcccagttacttgggaggctgaggtgggaggatcgcttagcctgggaggtggaggttgcagtgagccggtatcatgccacagcactccagcctgaatgacaaagcgagagagcctgtctcaaaaaaaaaaaaaaagcagcgggagggaggaaggcatggatagcctttcatcccatgacattttttagatcttccttaaaagatgacagatgctaatcttgcctttggagctgaatagttgcttgcattcagcgtgtcctgatcaaagctatgatttgtatggtgcttctaaagatagaatgggctataggttctgctatcctatcatggatttgtcagctggtcccattcaccatgagactactgaatagttaggaaagattcaacaaaactgccatgtagatagcaataggcatatgaatacacacatataca

SEQ ID NO: 170219 - DNA, 601 bp, Human
cctttcagttcacaatactgctttgtgttcataggctcagaagaggccccactggcatagcccattaattcttgaaaacattactttgtctccgatttgacttattagtcatatacactgctgtatccgtgtaataatgtagtgctttggagatagaaaaccagaaagctgcaccaatagatgggataaaaggagagatggtggttatttgtgttaaggggggtagggggggcaagtttttggagggagaggagagtgtttcaaatgctaaaaaattaaatagaaaatttaaatatcctgmagtgagagtacagatttaggtacagaaaaaatagaataagatgaaagaaatcatttggaaacagccttagaagaggggacagctggccaggtgctatggctcatacctgtagtcctagcattttgggaggctgaggcaggcagatcacttgagcccaggagttcaggaccagcctgggcaacatggtgaaaacctgtctctacaaaaaatacaaaaaaattaattgatgtggtggtgtgcacctgtagtcccagttacttgggaggctgaggtgggaggatcgcttagcctgggaggtgg

SEQ ID NO: 170220 - DNA, 601 bp, Human
gcctctggaccatgtgcagacaaactgctgcctttatctttaataccagaattgttctcacttttgatatggatgggtcttaagagcatactagaaggcaccaaattcaatgcgatagctccaaataatataagggctcctaaatagggagagattgagcaattaaaaatagcctttcagttcacaatactgctttgtgttcataggctcagaagaggccccactggcatagcccattaattcttgaaaacattactttgtctccgatttgacttattagtcatatacactgctgtatccrtgtaataatgtagtgctttggagatagaaaaccagaaagctgcaccaatagatgggataaaaggagagatggtggttatttgtgttaaggggggtagggggggcaagtttttggagggagaggagagtgtttcaaatgctaaaaaattaaatagaaaatttaaatatcctgaagtgagagtacagatttaggtacagaaaaaatagaataagatgaaagaaatcatttggaaacagccttagaagaggggacagctggccaggtgctatggctcatacctgtagtcctagcattttggga

SEQ ID NO: 170221 - DNA, 601 bp, Human
agaaatacagagcaggaggttgagccagggaagtcttgctccagaaccaatccttgagccactgcactgtgctgtctacctggggttttctgttccttatagtggctattgctattgagcatcagctttttgaaatttccgcatttatccaataaataatgtctactgtgtcaaacactgttatatgaagatgaataagacttgatttagggtccactgtctagtaggggagcctgtgtgcagtgacagagatctcttcctgggaaatgcccaggtgctccatctagcctcaaaaattttrctttctctggcccttctacaattcctcttttgtttttctttagctttttattaaaatgtaataagcttgtaaaattaagttgatctttccttttgggtaggaggctgatgtaggctttcttacctgctacagaaacaaggtaagaggcatccatgatgtcaatccccagtgttttggctctggctaccaggtgaaaggtagggatgaagtatgctaactgactgaggagaaaagaccaagtaaatatgtagaagaaaggatttctaaagagagaaatgtcaaacagttgtttgcagctcc

SEQ ID NO: 170222 - DNA, 601 bp, Human
attccttagctacaaataataaaacattattgaatgcttactacaggccaggcactattctaaactctacatgcattgcttttttgatcctgacaatcttatgagggtagatactattatccctatattacagatgaggaaatgaaggcaccatgaagcaaagtaacttgctgaagttcccacagttaagaaatacagagcaggaggttgagccagggaagtcttgctccagaaccaatccttgagccactgcactgtgctgtctacctggggttttctgttccttatagtggctattgcyattgagcatcagctttttgaaatttccgcatttatccaataaataatgtctactgtgtcaaacactgttatatgaagatgaataagacttgatttagggtccactgtctagtaggggagcctgtgtgcagtgacagagatctcttcctgggaaatgcccaggtgctccatctagcctcaaaaattttactttctctggcccttctacaattcctcttttgtttttctttagctttttattaaaatgtaataagcttgtaaaattaagttgatctttccttttgggtaggaggctgatgta

SEQ ID NO: 170223 - DNA, 601 bp, Human
actatgagttcaaggggaaaattccttagctacaaataataaaacattattgaatgcttactacaggccaggcactattctaaactctacatgcattgcttttttgatcctgacaatcttatgagggtagatactattatccctatattacagatgaggaaatgaaggcaccatgaagcaaagtaacttgctgaagttcccacagttaagaaatacagagcaggaggttgagccagggaagtcttgctccagaaccaatccttgagccactgcactgtgctgtctacctggggttttctgytccttatagtggctattgctattgagcatcagctttttgaaatttccgcatttatccaataaataatgtctactgtgtcaaacactgttatatgaagatgaataagacttgatttagggtccactgtctagtaggggagcctgtgtgcagtgacagagatctcttcctgggaaatgcccaggtgctccatctagcctcaaaaattttactttctctggcccttctacaattcctcttttgtttttctttagctttttattaaaatgtaataagcttgtaaaattaagttgatctttcctt

SEQ ID NO: 170224 - DNA, 601 bp, Human
ccagcaaagatggcaaagcagatggtgtaggtcataagtagtggaaatgtggtggctaaaggagcaagcaggttagtgatgccgcagaggatgaggtaagacttgtggtaatgatacttcttaatccagttttgatcagcaacccatccagaaataatctgactgaccgtctcaaggatacctggaacaatattgaaatctttttattttcctggtccctttgaaaaatgtgaatgcatacagcatcatttcccaagtaatatgatctcatcctgaggccaggatatgtgaggaaaaaaaygatttgatttgtgtaccagtaagctctattatatacttacctattccaaatacatttaataaaatagcaaaaaagtctccgctagagtagtgtagaagacccatgtagttagtgtttttttctgattgtgtttggaaagcttacgtcactacagtggtaatccctggttacagaggaccctgggcacagaaggccatgcagtctcttcgtctaagaggtcctgcaagtgagaaaatgaagtttctaaaagacaaatagaccttcaggtcagtgtcttggggaagtcatattgtagaagat

SEQ ID NO: 170225 - DNA, 601 bp, Human
gagatacttaacagataacaggcaatcttggacatccatatggcacatcagaagaacaaaagtgtcaggcctatacctttcaagctctataaaagtgactcatgtttagatacaagatgctagtcgttcattgttttttttgttttgttttgttttgttttttattttatagagacaaggtctgtctgttgcccaggctggtcttgaacccctcagctcaagtgatacccccgccttggcctcccagagtgctagaattacaggcgtgagcaattgctcccagccttttttttttttttttaaagcatcatgggtctttgaggctctgaaaaaactctggattgtctccccagacaagtagacatagatccagtgtctgccctacaactcccaagaatataagaatctgcttaaggcacatcttaagataatacaagaatctgagccttcagattttcctgcattggtggtggagtgagtagatataggaaaagcagaaataatctgtttcttttaacctgataccatcattacatgttaccattaatcctggatcagtttttctcttttattgctattgaaatttgttcagaatgtggtg

SEQ ID NO: 170226 - DNA, 601 bp, Human
ttctgaagatctaagtttggttgagaatttaatgtttcatcaccagtaaattcaattaaagacttttgattcaattaaagactcagttctgcctacacctgcaagaactgagttgatctgtacatcaacatttctgatgtttctttggtagttgctgctggagtcagaagttaggaacaaatctaatggcctttgtaatgtcctctgtcatttcacggaggaatgacttagaggaacaaagctttcctgtgatttctttcttcaacagatggctaatggcacagcattgcagttagaatcytgtttaagatactaggagcacgtcctggactaaaaatttctacataagctttagcaacaaccttatagcttcctttgacttttttgtagagcttacagaatgtatggctgcctaagtaatagtctctgaattaatgggtaaaaaatatattatgagttttttatcctcacgtatggtgctaggctatactggatttgggctaacaaaagcttgttaacttttttttgtctcattgacagaagtattttatatctcatattttacattacataggtgtgtgtgtgtgtatgaaataaaagt

SEQ ID NO: 170227 - DNA, 601 bp, Human
ttttaaaatgaaactgagccttgagcattttgagctttcatgtcaaatgccttgaatggaagagtaggaatttcatgtaagtagcttacatctgccctgtatgttggagaatgtgattagatatacttgcttttctgcccaaggcactatttttgtatttatattgctttttgcaggtttacttctgttaacaggggtctgtgagaaataaggcttaaaatatcaatacttctcatttttccacagccttccaaggcttccatctttgtgccagtgtgtggctctgggtgccatctaaccscaaaagcagcagttgggtttggatgagctgtgtgacatttggcctacacgtaggtctactcaccaccctggtcagggaacctggaacaatcctaaaactcacctactctaatgcaggccatattttttaattaaaattgaaattgtcactgagtattggaataagaagggactttggggtggagtgggtgagcagggcattgtcttacagaggaggtgtggggaccggtaagttttaactttcatcctttcaatctctcagtttcagcaaagatcttataaagaattttgttgctttctt

SEQ ID NO: 170228 - DNA, 601 bp, Human
atggggaaaataatcactagatacataaaatatttacttttttttagcctttttttccccccacagaacatatagaggacagggctttgctctgccttctcactttctccccactcacccccaacctccagagtgtgttttccaagtaaaattttaggccatagagaaattcgcaattgataggccaaggtgactgataaaactctagaggtcaggattggtaatagtggagcgaggaccagatggaatttttgtttaatactgtatctgaaattgaggatgggatagataggaaatgacytatcatttcatgaggagatgacttttctgtgataatgggacagagatgagcttagatgaatgaatatatattttagcacttacctttttccataaaacacaaatagacttggtgcaaaattaccagtctcactccatggtatttctgatgagatcggtaaataatagagagagacatacttctttaggagctagctgactttaacatatgctggagtacaattgacttacaactatttggcgttagaaatgatttttctagggcttggtgggggaaaaatactcgtgaaatacctgcctt

SEQ ID NO: 170229 - DNA, 496 bp, Human
atgtgttaggccatacatgtttcaaaaggaatttagcatcctgtctaaaaagtattcataccttcagacatctcagaatctcagaacttgattgttaagctaagttatgaatcttttttttttttttttgagatggagtctcgccctgtcgcccaggctgaaatgcagtggtgcaatctcggctcactgcaacctcctcctcctgggtttaagcgattctcctgccccaacctcccaagtagctgggattacaggtgcacaccactacgcccagctaatttttgtatttttagtagagacrgggtttcactatgttggtcaagctggtcttgaactcttgacctcgtgatctacctgcctcagcctcccaaagtgctgggattacaggcgtgagccactgtgcccagtcatgaatcatttttattaggattactatgtaagtttactattggttcatcttattgaaacttaacatggccgggtgcagtggctcaca

SEQ ID NO: 170230 - DNA, 563 bp, Human
tatttaatataggattctgaactcattttttaagtgttaatattttaaaactattccacattattttatgtgttaggccatacatgtttcaaaaggaatttagcatcctgtctaaaaagtattcataccttcagacatctcagaatctcagaacttgattgttaagctaagttatgaatcttttttttttttttttgagatggagtctcgccctgtcgcccaggctgaaatgcagtggtgcaatctcggctcactgcaacctcctcctcctgggtttaagcgattctcctgccccaacctyccaagtagctgggattacaggtgcacaccactacgcccagctaatttttgtatttttagtagagacggggtttcactatgttggtcaagctggtcttgaactcttgacctcgtgatctacctgcctcagcctcccaaagtgctgggattacaggcgtgagccactgtgcccagtcatgaatcatttttattaggattactatgtaagtttactattggttcatcttattgaaacttaacatggccgggtgcagtggctcaca

SEQ ID NO: 170231 - DNA, 601 bp, Human
cacagtaaaattattatttaacaataataattattgtatttgaagttactagtccagactcttttcttatatctatggctataggacttgttttaggcagaaatgtctagtaatgtttcctgtgataatttaaaacaaataggaagattgggctgagcttctttaaatactggtgcaaaccattttttttacagtcagttaaaaaggaataagaataatcattcaagttagatatttaatataggattctgaactcattttttaagtgttaatattttaaaactattccacattattttatgtgttaggccatacatgtttcaaaaggaatttagcatcctgtctaaaaagtattcataccttcagacatctcagaatctcagaacttgattgttaagctaagttatgaatcttttttttttttttttgagatggagtctcgccctgtcgcccaggctgaaatgcagtggtgcaatctcggctcactgcaacctcctcctcctgggtttaagcgattctcctgccccaacctcccaagtagctgggattacaggtgcacaccactacgcccagctaatttttgtatttttagtagagacgg

SEQ ID NO: 170232 - DNA, 601 bp, Human
cctattctatcaaaaattaaaattaaatttagaaaaatattggaaaagaataaagaaaaagttaaagaaaaaaaagccaggtgtcatggcacatgcctgtagtcccagctactcaggaggctgagttgggaggatcacttgagcccaggaggttgaggctacagtgagctgtgattgtgtcactgccctccagcctgggcaacagagggagagcctgtctcaaaaatttaaaatatatatatatagggagagagaacgagtgtctgattttattagatctctgtatttttttggtaacagkatgaaaaatctgttcagatgcacttcggaccctaaacggtttaatgcttctaagtaaatttttgttttttttgagaggaatctcactctgttgcccaggctggagtgcagtggcgcaatctccactcactcccagctccgcctcccggattcacaccattctcctgtctcagcctcccgagtagctgggaccataggcgtccgccaccgtgcccggctaattttttgtatttttagtagagacagggtttcaccatgttagccaggatggtctcgatctcctgacctcgtgatctgcccg

SEQ ID NO: 170233 - DNA, 601 bp, Human
agccactgcacctggtcctaagtgctttttaaaagcataagttggagggtcttcaaagtcttttggctaatggcacatactaaaacttaagcgaaacacttttttttcttttttttttttaactgagtaggtgatagcaaagaatatttatgctaaggcacatcattgcaaaagtcaacactgaaaaaagcaaataatgtccttagtattatcatgacaataattttggcctcctggacttcctaaagggtctcaaggatctctgggggtctgttgacctcactttgagaagttcttttcyaaagtatagtatgtatattatatctgatcacttattcaagaaatttcagtgctgtatggcagcacaggtctgggtttcagggatatacccctgaacaaaatagatgaaaatatctgccctcatggagcttacattgtgtctttgatttttcccttctatcttagatcatgatgcctcactggatatgtagagtataccctcccccacctttttcttctggtctgcttgtttcatctcctctttgttctgttatggacacagaggagatgagacaagcagaccagaaaaaattgacttaat

SEQ ID NO: 170234 - DNA, 601 bp, Human
ggaagttggagaaaattaggaacacataccgttttattttaccatgaattttattagaaggccgctattatgaagaaaataatcataaattattgttttccagagaaaaaaagaagtgataataatcagttttcttttttttcctttactaaacaaagacttgagtacttactatattcctgttaatattgctaggtgttgaggatacactagtgagccaaaacagatacggtccttgccctcacagaactttagtggggagataggtaccaaccacataaatgatatgtgataagtgctwtgaagggaaggtgcaggaggctatcagaagatatgagaaggaactgactgcttgatcacgtgggttaaacaatgacaagttcccccctgaaatctaaatgcttttttttttttttttttttttgagacagaggcttgctctgtcacccaggttggagtggtgtagtggcacgatctctgctttgcttactgcaacctccacctcctgggttcaagcagttctcctgcctcagcctcccaagtagctgggattacaggtgcccgccaccacacccggctaatttttgtgtttttagtagag

SEQ ID NO: 170235 - DNA, 601 bp, Human
agccattgtatgtctgggtataatcatataaccagcctggaaggaaggaatgatttctgttagggaaggaaattttgccattagtaactctcagccatgaatagctcctcaaagcaaggagcctcctgtattgtgacccatttgaacttagtgaagcttcttagctgccctatttttcactgatgaagttgaatcagctccacctgagttagggacttacaccatctccaatcttacagtggaagttggagaaaattaggaacacataccgttttattttaccatgaattttattagaagrccgctattatgaagaaaataatcataaattattgttttccagagaaaaaaagaagtgataataatcagttttcttttttttcctttactaaacaaagacttgagtacttactatattcctgttaatattgctaggtgttgaggatacactagtgagccaaaacagatacggtccttgccctcacagaactttagtggggagataggtaccaaccacataaatgatatgtgataagtgctatgaagggaaggtgcaggaggctatcagaagatatgagaaggaactgactgcttgatcacg

SEQ ID NO: 170236 - DNA, 601 bp, Human
ataatttttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtctgtgtgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaa

SEQ ID NO: 170237 - DNA, 601 bp, Human
taatttttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgygtgtgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaac

SEQ ID NO: 170238 - DNA, 601 bp, Human
aatttttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaact

SEQ ID NO: 170239 - DNA, 601 bp, Human
tttttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtctgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttc

SEQ ID NO: 170240 - DNA, 601 bp, Human
tttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtctgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttctg

SEQ ID NO: 170241 - DNA, 601 bp, Human
tagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttctggg

SEQ ID NO: 170242 - DNA, 601 bp, Human
gcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtctgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttctgggtt

SEQ ID NO: 170243 - DNA, 601 bp, Human
atactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtgtctgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttctgggttca

SEQ ID NO: 170244 - DNA, 601 bp, Human
actaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtgtgtctgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttctgggttcaat

SEQ ID NO: 170245 - DNA, 601 bp, Human
atttagttctctttcctcccgagacagtctcactctgttgcccagactggagtgtagtggcatgatcttggatcactgcaacctctgcctcccaggttcgagcaattctcatgcctcagccttctgcgtagctgagagtacaggtgtgcaccaccgtgcccagctattttttgtatttttagtagagacggggtttcaccatgttggccaggctggtctcaaacttctggcctaaagtgatctacccgcctcgacctcccaaaggctgggattacaggtgtgagtcaccatgcctcgccaytggtgaaactgttttgatgttctgaattggatatgatatgatcctctatttttgaaacctcatagtactttttatgccacttatagtctgccttatatatggttatttatatacttacctggtcctaaccatatggtcttttagggcaggaggactaagtatttctcatctttttgtctgttgcaggacttaatagaatgctaaagtgtttttgcccataaggaataggaacaccactcatacaagtcacaagtaaaagagaggtatattgaaaggacaaagtaggcaacttcataggtg

SEQ ID NO: 170246 - DNA, 601 bp, Human
gctacttgggaggctgaggcatgagaatcgcttgaacctgggaggcggacgttgcagtcagctgaggtggaatgactgcactctagcctgggcgacagagtgagactctgtctcaaaaaacaaaaacaaaaacaaaatttaaaaataaattgaagtagggtacaggattttaaagtcccattatcaacacattcaactcagaatagttaatgtaacctgaatttaattacctttgattttaatttaggaatgaattttttaaaatgcatataaccagctcagggtctgtgcttcatcatcwccctggctttttttttgtgctaatttttcctcttactacttttatgagtaccagaaaattatccaaagctaagagaagaaataaaacactgtttttgctccttattaataatttgcttctaagtttttgttagagagtaggtaaaaacgtttggcaaagtagattgctcatagagtttagctatccatgctttgtttttacctttagtttagttttatggcaggggaataggacttgttgaagggagtgggaaagaagggatgcaggtcttcataataaggaatgtcggccaggcgcagt

SEQ ID NO: 170247 - DNA, 601 bp, Human
ctccagaggctgagggggaaggatcgcttgagccctggggcggggcagaggttgcagtgagctgagatcatgccactgcactccagcctgggtgacagagcaagacactgtctcagaagacaaacaaacaaacaaaaaacgttgaggcagccagaggatgatccctgtccttgctcacaaatgactgctcccttaagcaatcaaaggcaaggaaggaactctacgtacttctccccctttaaatgataacattttgaggagagctgcttagctgagtgagctgccttttttttaaaaaaaactcaagccaacccttccttagatgatttatgaatgtaaaatgcttgttaactttctgctttatggtttatgatgcttgtaaaatgataggattattgtccatgtatgtaattggtgaaggatatgaaactcagaacaaaccatatagtgccatgtaagttatggacatattttagttgttagggcttttaaaaaacatctccccctctgtcattacatgttttaccctctggaaatgtttaatgaaacagtaactgatattgggagggacacacaggttgcttcaaagataaatggtaat

SEQ ID NO: 170248 - DNA, 601 bp, Human
tagaatatagaaaggtgtttgtgggaatacaggaagagctggagaatcaggccgcaagaactgatgcagctctgagactggccagactgttttctcttttttgtctgtttctgcctcttgctggcttcactatttctgcctttattttatttatttattttttttgctttcttacctttgcttgttcccgtctctttctctgtttccttggtcccatccgtttgtttttttttgttttttaaactgggtcaacaacctttgttgtaaaacaaaggtgcccttcccccattcattctgtttyctcacttacttgatgtctctttttttgtgagctctctcctttaagtcactgcatatttttctgttctcttctctccagaccaaccttcctctgaatcttttcctttgtgaccttgttgtgcatgaagctctataatggtagcctaggtttttttccacatgtatctcctagtgcagattcctcagataatccagttggtcctgctcatcttttagagctaggtcacataggccaccaacagcctgtgactaggtgactcctgtgttaggtatttaccctcgattcggtcacaggaaaggt

SEQ ID NO: 170249 - DNA, 601 bp, Human
ttaccctgtaaagccaggttgagcctggtcagggtgcccctgagggagaattacatagatatggaagggttttcaggttgtggcagaaagggtttcattactattttaatcaaaatcaagaaaaccagttagcagcttatgagaagcaaggagattaggagctaggaatatagtcaaataatttttttacagtagccagagctggctagagataaaatgaagtgaggtggctgggaaggacagtttgggggctagttttggaaattaacctcttgaactgatggtcaaagggaataatctrtgccagccaccagggtggaagtgataactgttcagaaagaatgaggagggcttcagcaaggagttgaagtctgagttgaataggggttttacggatgcttatagcatatgtagaggcttgtcatgtttagagggatagtgggctggctgaaaaactattttgagattgtaggctaaggaaacttagtaatttcacaagaaaaatagatctgtaacttctcccaccagaccgtaaagtccataaacttatttgtatttgaagtcaccatattcagcattttcaggcatgtaggagacatgt

SEQ ID NO: 170250 - DNA, 601 bp, Human
tgaaaggtgagaataagttagcaaaaaaatcaattttatttgctgatcaagctttcagcctgccatgagggaggggctgtctgtgcctattctagtcatatgttcctatatgtctgataatgggggcccgtagaagagagagtcttggtctagcactgactaaaaggttatctaaaaatagtgccatactgggacttggctgtccagacctctggaagagggactatactctaattataatcctgttattaaaaattttaagatttctatatagaaaccagtatttaaaaggaagaggagrtgtttcaggtacccctggaataactgctatctcaggtggtagtggtgcagagagacctgtgaggaaggttcaaggaaaagctatagaggtataaatggttgaaaaggagaggcgatagtagacaggaatatctggggctgaaaatacatttaaggaagagaatatttttgttcttcaggatagggtgaagaaaacgactaatgctctgatatattatagtttgctgtaacttttaggttataagttgcagtttaagtgtgtgaattcagattctatctaggattttattattatgaaacc

SEQ ID NO: 170251 - DNA, 601 bp, Human
ccaagttgttattactaaataaaactttgcgaggccttaacgttacttggtgatattctcaacattggaaatggcattcataaataatagctagctaacatttatggaacatttactatgtgccaggcactgttttaagcattttttattgacccccattcagatgaggaaattcattgtgcttgaaggcacagaaatagaaattcacatagtatactcatgtactttctttggactggctttagtcaaatgaaagagaaaaaagagaaggactcaggggatagtgtttttttttttttttgagaattagccatctgtcagggttaatttttaaaatcagtctgtatgtgagctgaatgagtttgctcatatgtgataatggtttatttgttttagcagttccaaattccaatcacttggggccttgtttaaaaattatcttgcaaagaaattatcaccatctctcactttgcatacccataatgtaatatatgttattgaggggtggagagcatatgctctggtacctgctcagagatctttttaaaaatacaattaagaacatgtgtctgggtgcagtggctcgcccctgtaataccag

SEQ ID NO: 170252 - DNA, 601 bp, Human
cccatgtttaggtaaatacagtgattctacattagagtacatattggtgaattttttttttggtctaacagtgttgatgattatgtatccaaactgtagataaacacagatgattttctttttctttttgccagaacaaggtcttgctctgtgcccaggtttgagtgcagtagcacagttgtaactcactgcaaccttgaactcctgggctcaagagattttcccaagtagctgggattacaggtgtgtgctaccaggcccagctaattttttgtgttattcttgttgtttgtttttttttggtagagatgaggtttgcctatgttgcctaggctggtcttgaactcatggcctcaagtgatcctcctgccttggcctcccagagtgatgggattataggtgtgaaccaaccattccctgtccccagatagttttctaaattaatcctctccctttattctctgcagattgccttgcctcttttattgagaatgaaactaacatggcttccttcctccttttattctcaaaaatctccgtgacttcacctctcatccttttctcctacttatataggatatcctttaaaggataaagcttc

SEQ ID NO: 170253 - DNA, 601 bp, Human
attgccttgcctcttttattgagaatgaaactaacatggcttccttcctccttttattctcaaaaatctccgtgacttcacctctcatccttttctcctacttatataggatatcctttaaaggataaagcttctgtgttgaacggatcctattgcctcctgtttctgggacctttccaactttttctcccctgtgtatcctaaccccctgcatagttccatcccttctgcatacagagtcctcttcagttcctcccttttgaagccatagctgctgtctttgcagtatcctttgcatctkcccattctttgtatttcaactattacttccctggtgtattgaagatgggcaactgaatctctccttaaacttgtgatacatttttgaaaaaagatagataaaagatgcagataaaattaggaagttctgaacaccacatgtgttgtggagtagggagatggaacataggaagcagcttggggaaaacgcaacaatgagatgttatgaaaagggagcttactgctagaacaatggagcacagagagttgaggtaaaagtgaagagcccagacctaataagaaagggttatagaaagtgttt

SEQ ID NO: 170254 - DNA, 601 bp, Human
agcaactggtgaatgttggtgccatttactggaatgagaagactgagggaggagcagggtttgttttgaggtgagagtgagttggggaatcagtatctcagttttgagcattttaggtttgtgaaatctaaatacctactagaaatctaatatcaggtagatggtttagatatatgaatctggagccaaggttagaagccaagattagagatctaaatttggaaatcattagtatagagacagtatacaccagctttggagccaaactgtgaatgcaaatttcagttctgccacttactamctgtgtaattataggcaagttacttgacatctgtctgcatcatttatctcatctgtaaaatgggggtaataatgtctacctcatagggttattgtgaggattaaattagttattacaaacaaagtgattagaacagtgtggccgagggtactcactagatgttaactgttaggatcagtttttgaatagtgtttaagccatgagattagggccgggtgcgattgctcacttctgtaatcccagcattttgggaggccgaggcaggtggatcgcttgagcccaggagttcgagagcagcct

SEQ ID NO: 170255 - DNA, 601 bp, Human
tgtaattataggcaagttacttgacatctgtctgcatcatttatctcatctgtaaaatgggggtaataatgtctacctcatagggttattgtgaggattaaattagttattacaaacaaagtgattagaacagtgtggccgagggtactcactagatgttaactgttaggatcagtttttgaatagtgtttaagccatgagattagggccgggtgcgattgctcacttctgtaatcccagcattttgggaggccgaggcaggtggatcgcttgagcccaggagttcgagagcagcctggcraacatggtgaaaccccgtctctactaaaaatacaaaaattagccaggtgtggtggcgtgtgcctgtagtcccagctactcaggaggctgaggcaggagaatcacttgaacctgggaggcagatgttgcagtgagccaagattgcgccactgcactccagcctgggtgacagagcaagagtctgtctccaaaaaataaagaccatgagattagataacttagagaatgagtttagatagggaaaagggccaaggagggacccctgaagcaatataacctttagaattcagaaactgggttg

SEQ ID NO: 170256 - DNA, 601 bp, Human
aggtggatcgcttgagcccaggagttcgagagcagcctggcaaacatggtgaaaccccgtctctactaaaaatacaaaaattagccaggtgtggtggcgtgtgcctgtagtcccagctactcaggaggctgaggcaggagaatcacttgaacctgggaggcagatgttgcagtgagccaagattgcgccactgcactccagcctgggtgacagagcaagagtctgtctccaaaaaataaagaccatgagattagataacttagagaatgagtttagatagggaaaagggccaaggagggasccctgaagcaatataacctttagaattcagaaactgggttgggtgcggtggctttcgcctgtaatactagcactttaggaggctgaggcgggcagatcacctgaggtcaggagtttgtgaccagcctggctaatatggtgaaaaaccctgtctctactaaaaatacaaaaatcagctgggtgttgtggcaggcgcctgtaatctcagctactcaggaggctgaggcaggagaattgcttgaacctgggaggcggaggttgcggtgagccgagattgtaccattgcactccagcctgggct

SEQ ID NO: 170257 - DNA, 601 bp, Human; identical to SEQ ID NO: 34643

SEQ ID NO: 170258 - DNA, 601 bp, Human; identical to SEQ ID NO: 34644

SEQ ID NO: 170259 - DNA, 601 bp, Human; identical to SEQ ID NO: 34645

SEQ ID NO: 170260 - DNA, 601 bp, Human; identical to SEQ ID NO: 34646

SEQ ID NO: 170261 - DNA, 601 bp, Human; identical to SEQ ID NO: 34647

SEQ ID NO: 170262 - DNA, 601 bp, Human; identical to SEQ ID NO: 34648

SEQ ID NO: 170263 - DNA, 601 bp, Human; identical to SEQ ID NO: 34649

SEQ ID NO: 170264 - DNA, 601 bp, Human; identical to SEQ ID NO: 34650

SEQ ID NO: 170265 - DNA, 601 bp, Human; identical to SEQ ID NO: 34651

SEQ ID NO: 170266 - DNA, 601 bp, Human; identical to SEQ ID NO: 34652

SEQ ID NO: 170267 - DNA, 601 bp, Human; identical to SEQ ID NO: 34653

SEQ ID NO: 170268 - DNA, 601 bp, Human; identical to SEQ ID NO: 34654

SEQ ID NO: 170269 - DNA, 601 bp, Human; identical to SEQ ID NO: 34655

SEQ ID NO: 170270 - DNA, 601 bp, Human; identical to SEQ ID NO: 34656

SEQ ID NO: 170271 - DNA, 601 bp, Human; identical to SEQ ID NO: 34657

SEQ ID NO: 170272 - DNA, 601 bp, Human; identical to SEQ ID NO: 34658

SEQ ID NO: 170273 - DNA, 601 bp, Human
caaccagaaggctggtctgagcattcctccttttcatcctttccattttattaaagtatttgtgggaatacttagtttgagagcaaaatatatttccgctttttaaacccacagacaaaaataaaattttgagtcgaagactgtacttcatcaatgaagtacccttctctacttgatctgtagaagttgctgctattaaatcacagccatttgcttcctgacccccaaatgacagcatctaaaaagcagtttcaattcagctttatgattcaacacctaaaaatcaaaacaaaattcctaktaaggcagtgcctcccaacccttcgcattaaaataccagctagggaagctgcggttggcgagcaggcttaggagtggagtcagctgggggcgagccttcagaaacgccactatcagaggttgcaggctccttttaattagggatccgggtgaggtatcacccaatcccctagaattcccgcagcccgggaggaagcttgcagcccttcaccgaatgtggcccccagtcctctctcggaaggggcagacggagggagttaactgtcaggctgcagcgtgcaaagcctcttccctccctttc

SEQ ID NO: 170274 - DNA, 601 bp, Human
agaagcaacgcggctctcctcccatacacattgccatccttgctgggtggccccttcacccaggccctctgcggggcagtactcactcgtgcagcagcaagtccttgaaatggatcatctccactatcacccgggtgttctcctgggcagccgcgcacaggtcgtgcttgaggtagcattcccgctgcaactgggacaccatttccctgatggccgggcacttccggcttatgcagccgaacctgtgccgcagagcgtgggccttacatttcaaggcgtctttgatgaatgacttgccctragaacacacaggccggggaagggagagaggggcagaaagcagaagacctcgttacatgcttggacatttcagcccttcttgggcttacacaggatatttctgacatcagaaccccaaggccccaccagagacggacgtcctcccaggtgacaggcaatgcgacatccggaggcacgtccagagtgacatgacacccccagcactgggcaacaagggatgttcattctgtagacgaacacatctccctccttcctccctggctactctgtgagtttccctccaacgggggcttccgtggct

SEQ ID NO: 170275 - DNA, 601 bp, Human
cccagtgcctggcgcttagtaaatattcaacaaatgttattagcaatttgctgtctgtaaggacacctctacagctactcagaatattctgagagctagtgggttcttggctaaggggaagatgaagagtattactgaatcgacacatttcattcttagtaaaacgatttcccatttctgttgcttgtgattttgagactgatgagggaattctctcttttcctaaaagccagcaggaaaggggccttttagtagagtcagtgtagctttctgaagtaaatggaagccttctccatttgamaggcattcagcctctagaagcaacgcggctctcctcccatacacattgccatccttgctgggtggccccttcacccaggccctctgcggggcagtactcactcgtgcagcagcaagtccttgaaatggatcatctccactatcacccgggtgttctcctgggcagccgcgcacaggtcgtgcttgaggtagcattcccgctgcaactgggacaccatttccctgatggccgggcacttccggcttatgcagccgaacctgtgccgcagagcgtgggccttacatttcaaggcgtctttga

SEQ ID NO: 170276 - DNA, 601 bp, Human
gtggctgaaatattttgtaagaaatgatgcatcctgaatttatcattgaatttcaagtcttgaaataagtaagttcacatttccttgttttggcatagaagtgtttagctgattaaagtttttggcacttgttttgcatttcctctgagagggcactaatgtatgagagaaggtaaaccgaaccttctaagggaaaggaaagttaaggaggcaggaaaagcatctatagctctgttttcgggatttaagagtataggttctggaggcagactgctcagcagactggagccaggtcccaagyctggctttgcctgtcactagctgtgtgagctctgccttagtgagtctcagttttctcatctgtcaaatggaggtgacgagggctgtggtgaggatcaagtgaaaaattcacaaggagcccttagcccagtgcctggcgcttagtaaatattcaacaaatgttattagcaatttgctgtctgtaaggacacctctacagctactcagaatattctgagagctagtgggttcttggctaaggggaagatgaagagtattactgaatcgacacatttcattcttagtaaaacgatttcccatt

SEQ ID NO: 170277 - DNA, 601 bp, Human
taatgacttgtactgaactggttggctagtggctttctttctgccctgtgtctcttaggaaagagccattgtcaatatttaaaaaaaaaatcttcaggggctcctggccctgcctcatgttaggaacaattgtgtaccaacatgctttaccatgctgcaaaatttaggatcctgtggctgaaatattttgtaagaaatgatgcatcctgaatttatcattgaatttcaagtcttgaaataagtaagttcacatttccttgttttggcatagaagtgtttagctgattaaagtttttggcayttgttttgcatttcctctgagagggcactaatgtatgagagaaggtaaaccgaaccttctaagggaaaggaaagttaaggaggcaggaaaagcatctatagctctgttttcgggatttaagagtataggttctggaggcagactgctcagcagactggagccaggtcccaagtctggctttgcctgtcactagctgtgtgagctctgccttagtgagtctcagttttctcatctgtcaaatggaggtgacgagggctgtggtgaggatcaagtgaaaaattcacaaggagcccttagccc

SEQ ID NO: 170278 - DNA, 601 bp, Human
caagggtgttgcaagatgcctatgaccttataaccaagtggaaagagacaggaggtgcttgctgttctctgtcatctaagtggtgttggtgtggtagggacataactggaagaaggttgtggcacaaactgaggatcaagagttcataaaattataccgatttggctcaatgagtcaccgtggagagaccaacagtgccatcaaactggtaatgacttgtactgaactggttggctagtggctttctttctgccctgtgtctcttaggaaagagccattgtcaatatttaaaaaaaaaatmttcaggggctcctggccctgcctcatgttaggaacaattgtgtaccaacatgctttaccatgctgcaaaatttaggatcctgtggctgaaatattttgtaagaaatgatgcatcctgaatttatcattgaatttcaagtcttgaaataagtaagttcacatttccttgttttggcatagaagtgtttagctgattaaagtttttggcacttgttttgcatttcctctgagagggcactaatgtatgagagaaggtaaaccgaaccttctaagggaaaggaaagttaaggaggcaggaaaa

SEQ ID NO: 170279 - DNA, 601 bp, Human
agcaagggtgttgcaagatgcctatgaccttataaccaagtggaaagagacaggaggtgcttgctgttctctgtcatctaagtggtgttggtgtggtagggacataactggaagaaggttgtggcacaaactgaggatcaagagttcataaaattataccgatttggctcaatgagtcaccgtggagagaccaacagtgccatcaaactggtaatgacttgtactgaactggttggctagtggctttctttctgccctgtgtctcttaggaaagagccattgtcaatatttaaaaaaaaaatcttcaggggctcctggccctgcctcatgttaggaacaattgtgtaccaacatgctttaccatgctgcaaaatttaggatcctgtggctgaaatattttgtaagaaatgatgcatcctgaatttatcattgaatttcaagtcttgaaataagtaagttcacatttccttgttttggcatagaagtgtttagctgattaaagtttttggcacttgttttgcatttcctctgagagggcactaatgtatgagagaaggtaaaccgaaccttctaagggaaaggaaagttaaggaggcaggaa

SEQ ID NO: 170280 - DNA, 601 bp, Human
caagaaggagacactagaacgccagagagctttaccttcttcttaaattaaggggagggggtgggacttccaaccttcagttttcccaaagaatacttttctccaagaaagatagaattcctgtgctccaggcatgcattatagccttataaactaggaatgggccccattccccaccgattcctgaggccagcaaactctctctaatgggggacagggctagaggcgagtgaagctcacggtgtttcctagccatggggcatttttctcttccagaggcacctgaaggaagggaattttmgagtgttctccttgtgtaatggggatatatttgataaaaggacaagaagcccaccacatgtggggagctgtgagccctttcaggtctaggagggagataataggctgggagcaggtttgaagtctattcctgatgactggcttcagtcatgtataccagcaattccgaagcttaaaagcaggaatcaaacctcagtccgagttctctaatctcttagcttcactttcctcctcttgggcatagtaatttctatcttgtagcatctttgggaaagataaatgagataacccatgtaaaggc

SEQ ID NO: 170281 - DNA, 601 bp, Human
tccctactgctgggctctgggaggtgatgtcctgcttccccgtggtgggccctggagagcttggttctgtccacctggggctggcgctcggggggcgccgtgggaggcttctggatggccgaggtgcagaagctcaagatggagcacaggcttccccagttctgctcacactgaacctgcacgctgtgggtgatggcctccttcacctcctccccacaggtcagcagcaagttcacgaggtccacgtagggtctaaagattgaaagcaaagagagagagagagagagagagagagagagaaaggctgggaatggagcaagtcccgaatggaccacagagggcaggggcaatgctgggaaggaggcatggccagtgcttgtcttgggttcggtggaagatctctctcaaatgacttcaagccttttctcatagtctatggagtactggcctcaaccaacacttattgggtggccactgtgtcccaggctcacaggtgcatagggtaagagcttaggaccctaaaaggaagaccctctggggatggtgagaaatccaggtggctgcgtgaataatggcaggagagctctgggtgcctttaggc

SEQ ID NO: 170282 - DNA, 601 bp, Human
tgtccatagataagaaaatggacggcgtggaggaaagatttcgtggccaggcctttcatttcacctccggatatcagaatactcagactgttcgtcttcccactcgctgcttccggaaggtccctgagccccaaggcccccgactctgcctcgggcatgggcgtttgggtggctcttgctacctcgctcacccttggcacctcggccagtctccctactgctgggctctgggaggtgatgtcctgcttccccgtggtgggccctggagagcttggttctgtccacctggggctggcgctcsgggggcgccgtgggaggcttctggatggccgaggtgcagaagctcaagatggagcacaggcttccccagttctgctcacactgaacctgcacgctgtgggtgatggcctccttcacctcctccccacaggtcagcagcaagttcacgaggtccacgtagggtctaaagattgaaagcaaagagagagagagagagagagagagagagagagaggctgggaatggagcaagtcccgaatggaccacagagggcaggggcaatgctgggaaggaggcatggccagtgcttgtcttgggttcg

SEQ ID NO: 170283 - DNA, 601 bp, Human
gaaccgcgaacaaagccgcgggtctggggcccccagcgcgcctaggggtggcgtgaggccgcatcgatcgggggatttcagcttctcccagagaggtgtcaccggcgagctaggcgggggcctagcacagccgcgcgtctccggcttgggtccgccgcccgccgaggcctggccgtgcaatggcggggcccagctaagagtgggcaagagggtagaggggaaacaggcacagaacggtcccggctccgctaggcgggctgggcctaggctgaggtcccggcggggaggaaggagtgcgccrccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcaggggggagggggcgacccagacagcag

SEQ ID NO: 170284 - DNA, 601 bp, Human
agaaaaaaggttgagggcgtctgtgaagccgggaggttcccaaacagggaagccagttccgcggcaggaaagcatacgtggaagagaaaccttttctctgagagctgaggctgggagggccctcggatcacgtgacactctagatcactgattgtctccgcggaagacaaggcctagggggcaggggtgattcgcccaaggtcactcagcaatttagtagcaaagctgggcctaaaacccgggctctctaactcctgggcctgttgcataacattcatagagaagtcttttaaaatcccasatgcaaggagaatagcagagtggtttacttactagcatatgaccttgggcaagtgactgtctgagactatcttcagctattaaagaggaatgagaagatcaataatacccacttcgatgagaatttaatgagagagccatgtaatgagcttagtggcacatagtaaatgctcaaaaaatggtagatcccatgactgctatcatactttctgtaaacttgtactggggacctgttatataccaggcactggctgtgcactggggaggcagagaagtagcttgaggaggtcacaggccagaa

SEQ ID NO: 170285 - DNA, 601 bp, Human
agagctgaggctgggagggccctcggatcacgtgacactctagatcactgattgtctccgcggaagacaaggcctagggggcaggggtgattcgcccaaggtcactcagcaatttagtagcaaagctgggcctaaaacccgggctctctaactcctgggcctgttgcataacattcatagagaagtcttttaaaatcccagatgcaaggagaatagcagagtggtttacttactagcatatgaccttgggcaagtgactgtctgagactatcttcagctattaaagaggaatgagaagatyaataatacccacttcgatgagaatttaatgagagagccatgtaatgagcttagtggcacatagtaaatgctcaaaaaatggtagatcccatgactgctatcatactttctgtaaacttgtactggggacctgttatataccaggcactggctgtgcactggggaggcagagaagtagcttgaggaggtcacaggccagaaaaggaaacaaacagttgcaatatgttatgataagtatcaaggcaactgggctgtgggatctcagaagcaggagtcacgaactgtaaggaaagaccaggaa

SEQ ID NO: 170286 - DNA, 601 bp, Human
taaaacccgggctctctaactcctgggcctgttgcataacattcatagagaagtcttttaaaatcccagatgcaaggagaatagcagagtggtttacttactagcatatgaccttgggcaagtgactgtctgagactatcttcagctattaaagaggaatgagaagatcaataatacccacttcgatgagaatttaatgagagagccatgtaatgagcttagtggcacatagtaaatgctcaaaaaatggtagatcccatgactgctatcatactttctgtaaacttgtactggggacctrttatataccaggcactggctgtgcactggggaggcagagaagtagcttgaggaggtcacaggccagaaaaggaaacaaacagttgcaatatgttatgataagtatcaaggcaactgggctgtgggatctcagaagcaggagtcacgaactgtaaggaaagaccaggaaaatgaccccaggcagacagagctgtgtgtcaaggccaagagatgtgaagtcccagccaccaaggcaatgtcactgtgccagagggtcctcaggatgtggactgaaagatgagagtggagagaaaggctggag

SEQ ID NO: 170287 - DNA, 601 bp, Human
aagatcaataatacccacttcgatgagaatttaatgagagagccatgtaatgagcttagtggcacatagtaaatgctcaaaaaatggtagatcccatgactgctatcatactttctgtaaacttgtactggggacctgttatataccaggcactggctgtgcactggggaggcagagaagtagcttgaggaggtcacaggccagaaaaggaaacaaacagttgcaatatgttatgataagtatcaaggcaactgggctgtgggatctcagaagcaggagtcacgaactgtaaggaaagacsaggaaaatgaccccaggcagacagagctgtgtgtcaaggccaagagatgtgaagtcccagccaccaaggcaatgtcactgtgccagagggtcctcaggatgtggactgaaagatgagagtggagagaaaggctggagccggtctccaaagagccttttatggatggaatccttcaaacatatttagaaaaatagaaagaatagtataataaccccccacatacccatcattcagcttcaacagttggccaattttgtttcatttatacccacacccactctcatcacacacacccacatc

SEQ ID NO: 170288 - DNA, 601 bp, Human
atcccaaagggacttggtgagcatctcctcttccttcaagacgcttactcattgaatggctattctgtgtcgggcaccattccaagtgatggtgatacagcagaacaaggcatgctaatctctgttctcatggggcttacagacccacagtaggcacagtcattgataacaattgaaaagcaaatgtgaaaatagacagacagagaaggcctgtgtgaactagtgacatggaattgaggcctgaatgacaagagtcagtcatgtgacaacgtggggcagcacactccaggcagaggaaatygctctggcagaggccctaatgtgagcctggactgcatggggacagatgggaggtggagtgagtgaggggagagcagcagccgccaggggcagggagggggcagagaggagatcatgcaggcccttctaggccatggtcaggattgaggcttttattctaaatgtaatagatagtagccagatggctttaagcagaggagtgttaaaaaaaaaaaaaaaaaaaaactgggttttaaaaaaatgcctctgttgctgtgtggagagtggatgatatgggggtgctgggctgagcactgaggca

SEQ ID NO: 170289 - DNA, 601 bp, Human
gcattgctgcatagggttcagaagttaatcttggtaaagtgcctggcagatgaaaactgttcctcagacattcagtgtggtaattgccaatgcggagaaaatgtatctccacgtttgcaagaggcaggcctttttgttccacaaaaaccagccattagaattcctgtctctgactcgtcggaagctgcgacagccaggagggcaagcagggtcttgcagttcaagcagcaaatggcaaaaggctccgaggaactcagccctggctctcacatcaggaacacctctgcagagtagggcatgrggccaggtgcttctccaacaggagagagcctcagccctgacccttcctagctggacgatcttgagcaagtcccaccatctataaaatgggggtaataccgccagggcccactgggtcattttgcacaatgacaggcacataccagatgctcaacaaatgtgcttccttccttcctttctttttttttattttccttttttttttgagacagagtctcgctctgtcacccagactggagtgcagtgtcatgatcttggttcactgcaacatccacctcccaggttcaagcaattctcctgc

SEQ ID NO: 170290 - DNA, 601 bp, Human
cctgcacacaggtggccccacctaaggacagggaagatgccatttgctcccaggtgctcattccctgggcagacagcaggctgcagcccacaggcgcctaccctttctccctccccagcaagctggaaacaggaacatctgccctgtttttaatccagttgctagttttaaattcaaatattgtcagctccctgagagcagggatcatgcctgcccttttcactgcagttgtcaccagcatttagaacacagcctggcagagtcattcacccacttactcattcattcattcattcattctctcaacatatacttatcaagtcctgctaaatgccaggctctggggaaaccactgggctcagccccaagaagctcctattccagcaaaggaagaggggagggaagtgggggtctgaggattgtgttaggaggtaaccatgcctggagtgggctgatccctgtgggaatccctgattcactctatactgtctccctgatctgggccaaccgttcatgcctctcatccttagtcctcacctctgcaagtgagacaatagtatctgcttcctggagccactgagagcagggctatggttactaa

SEQ ID NO: 170291 - DNA, 601 bp, Human
ttccctgggcagacagcaggctgcagcccacaggcgcctaccctttctccctccccagcaagctggaaacaggaacatctgccctgtttttaatccagttgctagttttaaattcaaatattgtcagctccctgagagcagggatcatgcctgcccttttcactgcagttgtcaccagcatttagaacacagcctggcagagtcattcacccacttactcattcattcattcattcattcactcaacatatacttatcaagtcctgctaaatgccaggctctggggaaaccactgggctcrgccccaagaagctcctattccagcaaaggaagaggggagggaagtgggggtctgaggattgtgttaggaggtaaccatgcctggagtgggctgatccctgtgggaatccctgattcactctatactgtctccctgatctgggccaaccgttcatgcctctcatccttagtcctcacctctgcaagtgagacaatagtatctgcttcctggagccactgagagcagggctatggttactaaaagaagaggaaatagagagctgggggaggaggcgacaggttgtcctgggaggacattgca

SEQ ID NO: 170292 - DNA, 601 bp, Human
tctgccctgtttttaatccagttgctagttttaaattcaaatattgtcagctccctgagagcagggatcatgcctgcccttttcactgcagttgtcaccagcatttagaacacagcctggcagagtcattcacccacttactcattcattcattcattcattcactcaacatatacttatcaagtcctgctaaatgccaggctctggggaaaccactgggctcagccccaagaagctcctattccagcaaaggaagaggggagggaagtgggggtctgaggattgtgttaggaggtaaccrtgcctggagtgggctgatccctgtgggaatccctgattcactctatactgtctccctgatctgggccaaccgttcatgcctctcatccttagtcctcacctctgcaagtgagacaatagtatctgcttcctggagccactgagagcagggctatggttactaaaagaagaggaaatagagagctgggggaggaggcgacaggttgtcctgggaggacattgcagccccttcagttgctggggccttggtgccccgcccagtgggggcctggctgcagcagagagcaagagctggagagag

SEQ ID NO: 170293 - DNA, 601 bp, Human
gcagtgtttgctgaagggaaaatgacccagaaagtacactgggaaatcaggcaagacctatagcctcaccatgcggagggcagccagcacagctcaggccccttggccagccccatcccaggccctgcccaccacagaatgcagccagcacctgagggagacaggaatgagaacaccagtgagcttcaggtgagcaggggctgctcacacgcttactgcacttgaccagtgtctgtctctcacacgggtctgggaacccaccaaaggaaatatgttgcgttcctatcatcccctttgtacyccctaaaaatctgggtacagattttagacatcagtgtttgatgagtgaataatcaggtcagagtaagatttagaaagccagtggaagatttcaagatggcaaaatggaaaatttcaagatttcaaggtggccaaggtccaaggtagagacgcctagccagaaaaaataacatagacccagaagctgcccctcaggaatttggctcatggaaaaataatgcactaaatggagccaagggacagggtggtgcaatgtgagcttgaaataatgttcctcagcatcctgggcttctaagaaggt

SEQ ID NO: 170294 - DNA, 601 bp, Human
caaaggaaatatgttgcgttcctatcatcccctttgtaccccctaaaaatctgggtacagattttagacatcagtgtttgatgagtgaataatcaggtcagagtaagatttagaaagccagtggaagatttcaagatggcaaaatggaaaatttcaagatttcaaggtggccaaggtccaaggtagagacgcctagccagaaaaaataacatagacccagaagctgcccctcaggaatttggctcatggaaaaataatgcactaaatggagccaagggacagggtggtgcaatgtgagctygaaataatgttcctcagcatcctgggcttctaagaaggttctcagggcccattatgggatgggtttggggaagagaaggcctcaaagaagaagccctagatcctccaaatccatttcaaccacaaaagcttcgcttttatctgttgtatatgttggatttcctcctaaatttttacttttaaagggttcttttgattttaaaaagtgcatttgggaaagtactggcattgaaagagcctatgcctttggaggtagactgggtccagatctcagctccatccctttccaccagtgggactt

SEQ ID NO: 170295 - DNA, 601 bp, Human
tgcatttgggaaagtactggcattgaaagagcctatgcctttggaggtagactgggtccagatctcagctccatccctttccaccagtgggacttggggcaagtgtccctttgagcctccacattctcagccacgagccaccctcccagggctgtatgagcacagctaagcggctctggtacctcccagaggctggcacacgtgtgattgattgatgctgtacaagatgactttagctggtatacagatgaacatttattattttaatagctcgcaagtgatgcgtgttagaaatatatarccagcacactaaactgtgatttatgaaaataatatggcatttcctctgaaaataaaattgtgatctttttaaaaaggcaaatcaatttaaagagaaatactaagtaagtgatagggcagaaatcatgaaggtggcacaggaatgactgaaatttgggggaaattgagagaatctatgtaaacaccaatcacagtgtctgtcacttaagaagggctcaaaaagttagttcttatatccttctattttagctccctggggtggttgaacctagaaccatgctcaaaaaacaaaacaaaacaa

SEQ ID NO: 170296 - DNA, 601 bp, Human
ccacgagccaccctcccagggctgtatgagcacagctaagcggctctggtacctcccagaggctggcacacgtgtgattgattgatgctgtacaagatgactttagctggtatacagatgaacatttattattttaatagctcgcaagtgatgcgtgttagaaatatatagccagcacactaaactgtgatttatgaaaataatatggcatttcctctgaaaataaaattgtgatctttttaaaaaggcaaatcaatttaaagagaaatactaagtaagtgatagggcagaaatcatgaakgtggcacaggaatgactgaaatttgggggaaattgagagaatctatgtaaacaccaatcacagtgtctgtcacttaagaagggctcaaaaagttagttcttatatccttctattttagctccctggggtggttgaacctagaaccatgctcaaaaaacaaaacaaaacaaaaacaaagcttcctgggacaaagtaggggcccaggcccagtcggtctggaacagtgtggggtgggcatgagacaggcagccatggatccagctctgatgggcagaagtggtcaagtgtggccagggagct

SEQ ID NO: 170297 - DNA, 601 bp, Human
aggaagaggctcagacttcagccggcaacagtaactagctggaagtggataaacgatgttttattttccatttatttgtttttaaccatggccttctatttacagaacaggatactgcactcctgttcatgagaaggatcttatgttctctttccaaatatatgtattaaaggtcaaaaaatgaacctgttactcttgctaagtataaagtgagtaatagtaaatgcaagatgtacatgaggaaaacagagagaagtggtgtatgactgaggcaagagtcacctggcaaaggtgttgcaasggcttccatggctccagagcccatgctgggcccagaggcaggaatgtctccaggccccaccacagcctccggggcagtcctcaccctggggagggcaaaggaggccccatcctaagaaggagggagattgctgggcaggtgacccagagcctcctgcctgagccgggagtgcagagaccaggacagcagcctggccagcagtcagtgaggtcagggctaccaccagagggtggatctgaaacagaccctaggcctctggtttctggcaaggttgattacatccagaagggggtcttaatt

SEQ ID NO: 170298 - DNA, 601 bp, Human
tgacttaatacaacaaagatttgtttctccttaacatgatgtcttctgtggagccagcagctctccaggcagcatccttccaatcggtgactccgggatctaggccggctccgccactatgcagcagcggaagagagtgagtggagaactcacagtcactcttttttttttttgagacagagtctcactctgtcgccaggctggagtgcagtggtgcaatctcggctcactgcaacctccagcttctgggttcaagcgattctcctgcctcagcctcccaagtagttgggattacaggccygcatcaccatgcccagctaatttttgtatttttagtagaggcggggtttcaccgtgttagccaggatggtcttgatctcctgaccttgtgatctgcccgcctcagcctcccaaagtgctaggattacaggcttgagccaccgcacccagccaacagtcactcttaatacctcagcccagaagtgacactgattgattcttctcacaggccgttggccaaaactagtcacatgacctatctcaccatcaggggcgggaaagaattcactgagttcacgttcttgcagcacaagccctgacc

SEQ ID NO: 170299 - DNA, 601 bp, Human
tgttagccaggatggtcttgatctcctgaccttgtgatctgcccgcctcagcctcccaaagtgctaggattacaggcttgagccaccgcacccagccaacagtcactcttaatacctcagcccagaagtgacactgattgattcttctcacaggccgttggccaaaactagtcacatgacctatctcaccatcaggggcgggaaagaattcactgagttcacgttcttgcagcacaagccctgacctgccgctggcagtgctggggagccaggggtccaaaaggaggacttgggctatgcrtggggcagaggcagccaggaaccagaggtgctcgagacacagaaacttgccagcatcactgagaaccagaggtgcctcatggctggtacatgaaagcacctcttaatttgcatgtttaactcaacacatcctaaaaagtgggaaaagagtggggagagaatttcattaacctgagctttccacctttccttatttttccaatcagtaaacactagcaaatgaaaatcaagttgatggaaaaatagaggtcaaatgccaatgggcaaactgttcagaaagaaattgccacctggtcccttc

SEQ ID NO: 170300 - DNA, 601 bp, Human
gatggtctcaatctcttgatctcatgatcggcccacctcagcctcccaaagtgctgggattacaggcgtgagccaccgcgcccggccccgacttctaatttcatagattcattggctgtttttgaacttcatataaatgaaatcacgccgtgttggacccctgctcagcgacgttggagagtctcttgagttgttgcatgtggttgtcattcattctcattgctggagtaaatctcatcgtgggactagaccaaaatgcagttctagtgttgatagccacttgggttgttttcagctttaractcttgggagaagcgctgccatgaagattcttgcacgtgtctttggaaaaacacatgtacacatttctagggggtttatgccaaggagtggagttgctgcatcacacgagatgcgggttcagctctagcagatactgtcaaatgtttcttccaaaatgatagtagcaatttacattccctactgtagctacttggtggaagtttcaggagctccaaaccctcaccaacatttggtattttccgtcttttccatttcagcgattctggtggatgtggagtggtgccgttggaatttttat

SEQ ID NO: 170301 - DNA, 601 bp, Human
tctggaggtgagtgtccccagcctgagactgtgttggaggcccagtgatgtgcagggagccaatttggtcagctcctgtctctgccaccacccaccgtgtggccctggactggtcacgtcacctccctgagccttaggctctttacctgtttcaataatcccttcctctgggccttgtggggagaaatcactgagggaaactgatgcagtgcccagcagggcgcctggcgtcatgagcccttagtttacttggcacacactcattccttcccccgacacttctgtgactagcggggctccrtgttctgcccaggccccctctccctgggtagcagggtcagcctcttcacgtctcatgcagccacaacaggccactggtgggttcctcactgcctgaaagcaggtgtggtgggccaggcatggcattccctcccgcatcaccttgtctccctgcagctgcccccactcaggctgacagccacacaatgagtcccagaagggcctttctcgtctcaaggactctcagctcagagcccagacgcctttattttaggagctgtggttagtaaagtgcttcatcaacgccacctccaagcagccc

SEQ ID NO: 170302 - DNA, 601 bp, Human
gtatgaacgatggacgattggttggataatgagtggatgaagggatgaataaatagatagatggatggatgaatggttcagagataactggtgagatcagtttggaatgggcttagcctgaactgcctgtaaacacaaacagagctgcccctcaagttgttgatagatgaaccccaagttcgggagagaggtctgggctggaaacagaggtttaggagctattaatacagagactataatggagtggatcaaggttacaggggaggcagcaaagtggggggagccaaaatcagacagcacytaagtgacacttgaacccagggctgtgtgatgatgtcagagcttgctttccttccttcattttatggcagcttggccactacttgaggtgacagcacagagttaatgtatctccctctcccctccctccccctcctcaaaccactcagccagaagggagcagctgcctgggaggacagagagacagattatgtaaactgtgattgccacccacaggaggaggaggagactgaataggtattgaaatgcgctttcaataatgcatgtcctcctccgcacaggcctggggcttgctggggag

SEQ ID NO: 170303 - DNA, 601 bp, Human
agagctttgatcagcaagaggtaagccacgaggtgaggtgatgtcattccaacccaaagctaagaaatatagcaagcaatattgttaggcaggccggccttgctgccagaaagtgccctcccttcttctaaccccagagatagaagagccccaggctggggaccagggaccctgcccaagtctctctcatttcccaaaggaggaaaccaaggcccagaaaggcaaatggacttgcccaaggccacaggatcagtgagacctaaaggccaaggtctggcctctgcagtttcaaatgacctakaacttggcagtgaaacaggccaagcaggggacctgaaagtcaagaggagggcaggagaaagagaagccatgagagccagcaccttcattgtgctcctactacgcaccagacccactagaaagtgtctaccaccttgttctcacacaacaactcggaaggctgagattgacattcccgttgcacagaggaagaaattgagcatcaaagaggatccgtggttttacatcatccactcagctgggaagtgaaggatcaggattccagcaggtgtgtccaaccgaccgtgaaactttttccacc

SEQ ID NO: 170304 - DNA, 601 bp, Human
caaaaacaaacaaaaagaaaaaaaaaaaggaaagaaaatggggcacaatacttagaaatggcatcctctcgctctattccctccttttctagtgaaaaacttccaagctggcagaagccagagtgtgagatctgattgcttctgtctctggggatctcctgggttgtagttcaggaaaactttaccctgttcttccactgctttcagttaaagggactgttttcctctggtccagtaattctaagacaagggttgagagtgggacgagagtctctgcctgtagcttgaatgctctcctggycaccaccatctgcttccacatctggttttattgctgggcgggagatagcttgaccattcccatcacactcctggaaactccgttgatttccccaaggcagccaaagaagctggagtggaaatctcagctcccagcagctagagagggtgaccctgctggacttgccacagttgctcctcctggaccaggcggaggtggagtaattgactctctggtttcccctggaagtggttttaaatgaataagtgcaaaaaaaaaaaaaaaaaaaaaaaaaagcctggtaactggggtggggcacta

SEQ ID NO: 170305 - DNA, 601 bp, Human
gggaggcattaccgtccccaacttctggggaggaaactgcggctcagcgaggccagcaattgtctgaaaccagctggtaaataagctgcagagagggcactggaccaggcccacctgctcagccatgctccctccctggggtcgcgcagaagctcacctcgggaagaaggccccgctcccccaggaagggcccccttgccaggacagtcatccagagccacacctgaccccagttcctgctgtcactctttgctaaaagatggaggggactaggtgggcctcgagctccaccttccctcgracttctgctgggtcttttggagaagccacttgccctctctgagcctctgcttcctacctaaggattccatcaatctaagtctctgcacccctatatctccatctgagtggggaataaaacttccggccacacagagtcacaaagcatcctctaccccttgtctgccctgatatgaccctgtaatgtggagagcagaagacccactgcacaaatgaagaaactgagagactttaacttgtgcccaagatcacacagttaggaagacacaaagccagagatgcggtcctgacccttactact

SEQ ID NO: 170306 - DNA, 601 bp, Human
gagaaataggtatgtcagacattgaaagagaaagggccttctaagctgggggcacgagttatgccaaggcaacttatccacttctgacactgttctaaagaggtccagctcttccctggtctaccctaggactctgctggctctgccctccatgtctcttgtctgtgctcctattatttccaccatctgggatttattcattcctttagcaaatatgtcctagccaccaaaaaggttcctggccctgaaagtggtacaggagataaagctgtaattttgagcatagtctccatgtctgacrgcaggagatgggggtagttaatcatcaaccagtcacagctcctcatttcctatgtgcctggccctgtgctcagtgccatgaggaatggagaagaccatgaaagctcattgagcaccatgcttgcaacaacacagagagttaagtcttgaaggccccatttctggaaaagaaagttgaagctcagagagatgacctgacttacctgaggttgcacacagtgctgagagccaaaccagctccgtgtgatgagtgtgggttctttctgccaggctgggctgcctgccttcacaaccagaaaca

SEQ ID NO: 170307 - DNA, 601 bp, Human
gtccccagacggaggggactctctccgccccttcctgccatagccaggccccttctttgaaaactttgcccagaccgcaggctcggctgctacctaccttctgttgcctgcctctggttttcctccctcacatcccctttcctggtgagctggggacccatctaacctggaggcccaggttcctgcagggcacttagtttccatgcatggctccagcccccatgggctcagcgttcctccctgaaacatcctctctggctgctgttttagcgcaagattttgcttcagggtaaatcctacrtttcccaaaccaacggcatcttggcgtgtaactgagatgcacagggaatccctggatttgaagtcaggaaggcctgcctctggatgccagctctgccactgatgtagcttggcaagttcctacgtgtctctggaccttgatgtccacaaatgtaaaatggggtaatgacaccaactgcacagaattactgtgaagattcaaatgaaaccctgcatgcgaaaactgctcagaaacggtccagagatgtgtagatacaggcaggtactactgctgtgaccctggtcacagaaatgtccattc

SEQ ID NO: 170308 - DNA, 601 bp, Human
gccccttcctgccatagccaggccccttctttgaaaactttgcccagaccgcaggctcggctgctacctaccttctgttgcctgcctctggttttcctccctcacatcccctttcctggtgagctggggacccatctaacctggaggcccaggttcctgcagggcacttagtttccatgcatggctccagcccccatgggctcagcgttcctccctgaaacatcctctctggctgctgttttagcgcaagattttgcttcagggtaaatcctacgtttcccaaaccaacggcatcttggcrtgtaactgagatgcacagggaatccctggatttgaagtcaggaaggcctgcctctggatgccagctctgccactgatgtagcttggcaagttcctacgtgtctctggaccttgatgtccacaaatgtaaaatggggtaatgacaccaactgcacagaattactgtgaagattcaaatgaaaccctgcatgcgaaaactgctcagaaacggtccagagatgtgtagatacaggcaggtactactgctgtgaccctggtcacagaaatgtccattcactcagcaagtgtttatccagggccc

SEQ ID NO: 170309 - DNA, 601 bp, Human
agagtgctccagagagggacaacaggaggggcaaaggccagggggcaggaccacagggttgatggggacatggcaaagagagggagctgaggctgtgaaggcaagcaggatacatcaattttaagatatgtttgaagttcatggtattttgttaatttatcttaaacagattgcaaacaatgtgttgattttttttgaaaaagtaaaaactgccacaccatcacatacgtttagatcatattacagttaccggagcctggagcagctaaaacaagaaaaaggttggaaaacacaacattgrgaaatagttcaatcaatgcataagacaggaatagtcagcaaaacagctccctttttaaaaaagtaatttatagcatcaaaaatctgaatcatgcctcactggtaaattctaccaaatatttaaggaagaaataataccaattctacacaaaatatttctagaaaataggagggaaccttcccaaatcattttaagaggccaggtaaattagcttgatacagaaaccagacaaaggtattacaagaaaaccacaggccaatatccctcatgaacacggatgcaaaaatcctcacaaaatat

SEQ ID NO: 170310 - DNA, 601 bp, Human
catcaaaaatctgaatcatgcctcactggtaaattctaccaaatatttaaggaagaaataataccaattctacacaaaatatttctagaaaataggagggaaccttcccaaatcattttaagaggccaggtaaattagcttgatacagaaaccagacaaaggtattacaagaaaaccacaggccaatatccctcatgaacacggatgcaaaaatcctcacaaaatattagcaaatggaatccaaccatctgcaccttatttccagatgctcacagctgagctcttcccagtgctgaaatcraagtttttgttgaaatcaaattatttatttaagtgagttagtaagagaagtcttggttgtaagtggtttttatttatttatttatttacttttttttttttttttttttttttttgagacaggatctcgctctgtcgcccaggctggagtgcagtggtgtgatcttggttcactgcagcctccacatcccgggttcaagtgattctcctgcctcagcctcctgagtaactgggactacaggtgtgcaccatcacgcctagctaagtttcatatttgtagtagagatggggtttccccatg

SEQ ID NO: 170311 - DNA, 601 bp, Human
tcctggcaacaaacccagtgtaatgcttggggcactccataagcattttttaaaaatgtttttagagacaagagtcacacgatgttgcccaggctggctttgaactcctggactcaagcattcttcccaccttagctcttgagtagctgggattataggcacgagccaccacattcagctttaagcatgtttttctttttaatttttcctcaaaaaagaatgatacaacttttattttccatgaatttttgtttttttgttttgtttgtttgtttgtttgtttttttgagaaggagtctcrctctgtcacccaggctagagtacagtggcgtgatctcggctcactgcaacctccgtctcccaggttcaagcgattctcctgcctcagcctcccaagtagctgggattacgggcatgcaccaccatgcccggctaatgtttgtattttaatagagatggggtttcaccatgttggccaggctggtctcgaactcctgacctcaggtgatccgcccacctcagcctctcaaaagtgctaggattacaggcgtgagccacctcatccggcctcaaccttaaacaattttaaggtgatatgttt

SEQ ID NO: 170312 - DNA, 601 bp, Human
ctaatgcaaaggcatgaagttctttgcaggattgacagggtctcacctcttctgtattaggctggtgccagggaaaagggcaggcatggagaggaagcaagaagactgtcttgcaaaaatgtcaaggaaacatcccctgtttgcacacatgtgggaaagcgagtgggccagcacatggtgtgacaagacttttttttatagcatgctcagctcaaagagcttcctctgtgctgggcacacaggtgtcctctgcaagccacacagcagcctgactatcctcatctcacagaggaaaccaggrcccaggaaagtgggtaattcaccagcctcccacaccacagttggggaaactgagatttgaactgagaactctctaactatgaagggctgtgccaggaatgttttaaggtagaaacaaggaaagcattgaccttcatgcttcaatccaagacacagagaccttgaggtgagtctaagacagtgattgctggaggctccagttcccatacataccctctggtgagcttctcagcatacatctcagcccactccagttccccacaccaccacatacatccccccaaaacctgcaaacccaaca

SEQ ID NO: 170313 - DNA, 601 bp, Human
ctatctagggaccatcttgaggatggaaggcactgcccaggtgggaatcaccaatgcccagccagaggccaaggaacacgccaagaggaacagccagaggctgcctggcagttttgaatgttagcagcgggatggagacaggggctcattcccagaaatggaggcacccagaaaggcaagaagtttctgtttcttcatcaggaaaatcagtgcctaccacacagaattggtcacgcattcattcaacaaacctttactgagctgctactgtgtaccaggcactgcggttagaggggccaayagggacagacaagagcctgctctcttgaggcttctgtctggtgggagaagacagacagtcaacaaggggacagatggaaaaaataaaacagagattgtcagctgtgacaaggagggtggcttgttgtataagcaaagtcagagagggtctctcttgggaggcagcctgaatttgtctggccacctgaaaaagaaaccaccagccatatgaagaacagagagaacagccatggggccgagggagcagcaagtgcgaagggccggaggctggcggagcttgctgcaactccacgaacagagg

SEQ ID NO: 170314 - DNA, 601 bp, Human
acagtcaacaaggggacagatggaaaaaataaaacagagattgtcagctgtgacaaggagggtggcttgttgtataagcaaagtcagagagggtctctcttgggaggcagcctgaatttgtctggccacctgaaaaagaaaccaccagccatatgaagaacagagagaacagccatggggccgagggagcagcaagtgcgaagggccggaggctggcggagcttgctgcaactccacgaacagagggatcctgtgaagtggaaataacgtgaatgagttttaaaaagcagggcgtggattyaaaaagtgcctttgcagggggaggaagggaccagatgatgtaggacattgtgaggacgaccaaacagcacgtttgtaaactccaagggctgggaagatgagtctttgtcgagggctggattgtatttctggaaagcacatttcaatgcaggagcctctagggtggatggaagacaccagaatagctacagaacagaggctctgtgagcttttggctgcccctctgcccagaacattccctaacaaggaccagttcttagaaggggaagccccaggcaggcccagatggtgacccaagaga

SEQ ID NO: 170315 - DNA, 601 bp, Human
tccacccctctggcttcatccccagcaatctgaaagatgcagatggcctgtcccctcacctcctgaaatcaatcagggcgagaccttagtgagggcactaaggtctgaccctcctgcccacaccgcacctgtggccttttccttccttcattttgaggcttggctggcaggtctccacttctggccatgcacacacacaaacacacacacccgcacccccctgcctggccaagtcctccccaagggtgggggtgaggcccagcactagccattctgcaccccctgattcctggtctgtgastccacaggacaggcatggcagatcagttctccctgccctgtaggttcccagggctcaagggcacctgtggtcagccccgcagtaggatgaagagtcaagagggctgcgtggagagtcagaggacctagactctagctctctccacctccctctgcctgtatgaccttgggcaggtcacttccatcccctgaggctcaatttcctcatctgtaaaatgaaaacagggtggatttaatggtctctgaggaatcttctaggttgaaagataaagattttttgggatgctggacatttattgaa

SEQ ID NO: 170316 - DNA, 601 bp, Human
gaagtttctgagcaggggagtgctgtgaggcgaggagtattttaagaagattcttctggcagcacaggccaggttgagttggaggagccgcgtgggggagtgcgagcggcgcccatgcctggaaaactttgcaaatgaggccccctcttggagcccttcaggatccaaggcaatctgagaagcaggggctgggtccgaggtctcacccccgacacaggttgcatctacaacctcagggccatcagcatccccagagcaactcagacaggctcctagtccatcacgacgtgccttcgctcamagcatgcgtggcccactcagagccgccgctaaagctaggatttgaagctgggtctgtaggacatcaagtccagcgctcttccatcagagttacacatactccaggaaccttgcctgagcctcagatgggcatcttactgccctcaactcagcccagggcaggattagagagaacgggaggtcctgcttagctgcagactcaacaactcctgcagggggcatgagaaggcggctgcagaacctgcccagaccacacacaggctccactacatggtgccagtcacaacagagttaaccctgg

SEQ ID NO: 170317 - DNA, 601 bp, Human
tcctagtccatcacgacgtgccttcgctcacagcatgcgtggcccactcagagccgccgctaaagctaggatttgaagctgggtctgtaggacatcaagtccagcgctcttccatcagagttacacatactccaggaaccttgcctgagcctcagatgggcatcttactgccctcaactcagcccagggcaggattagagagaacgggaggtcctgcttagctgcagactcaacaactcctgcagggggcatgagaaggcggctgcagaacctgcccagaccacacacaggctccactacrtggtgccagtcacaacagagttaaccctggcttccccgattctgctagtcaggcagccaccatggcagaggcaccaagagacactgcctgggacccccagcccctctcctccaatccacatgtctgtcagtccccccgtgaggttcaagctttctcagctgccggcgagttttatggcctctgatgctgacagtgctgttccaagtctctcacctaacagcttcatcacagggctaatggtcactgctattcattcaacaaacaatctgtgatgcttgctttgtgccaggccctggggcc

SEQ ID NO: 170318 - DNA, 601 bp, Human
ccatcacgacgtgccttcgctcacagcatgcgtggcccactcagagccgccgctaaagctaggatttgaagctgggtctgtaggacatcaagtccagcgctcttccatcagagttacacatactccaggaaccttgcctgagcctcagatgggcatcttactgccctcaactcagcccagggcaggattagagagaacgggaggtcctgcttagctgcagactcaacaactcctgcagggggcatgagaaggcggctgcagaacctgcccagaccacacacaggctccactacatggtgcyagtcacaacagagttaaccctggcttccccgattctgctagtcaggcagccaccatggcagaggcaccaagagacactgcctgggacccccagcccctctcctccaatccacatgtctgtcagtccccccgtgaggttcaagctttctcagctgccggcgagttttatggcctctgatgctgacagtgctgttccaagtctctcacctaacagcttcatcacagggctaatggtcactgctattcattcaacaaacaatctgtgatgcttgctttgtgccaggccctggggccaaagaga

SEQ ID NO: 170319 - DNA, 601 bp, Human
tgtgatgcaataggaaagggcggttctggaaccacacggccagagcacagatctcaggggcctctgacgactgagggccttgagcaagcggctgcacttccctccccagcttccccctctgtggagtgcgattgctgcaatgcccactttctaggtctgttgagaggctccctgagttcatgcagatgaagagcttacagcacccctggcccatggcaccccattcatggtacctgttcctccatggcaggcactggctagcaattcccagatgttatctcaagcctggcatcagcctggsaaagtgggctcagagaggcgcagtgccttgctctagatcacacagccagaaagtgctggggctgggtaggagcccaggttctccagcttcatgcccggtgccctgtccccagcacccctgagcccctacccatgtgtccttgtcctgaggcccccacttctcacagctcctccttcctttgaccagctcttttctccttttatcttccacagtgagaactcttttccttttgaccagggacagccaggccttcgtttgctggatcaatcttaaagctccctgctgaccccagccttcctg

SEQ ID NO: 170320 - DNA, 601 bp, Human
tccccctctgtggagtgcgattgctgcaatgcccactttctaggtctgttgagaggctccctgagttcatgcagatgaagagcttacagcacccctggcccatggcaccccattcatggtacctgttcctccatggcaggcactggctagcaattcccagatgttatctcaagcctggcatcagcctgggaaagtgggctcagagaggcgcagtgccttgctctagatcacacagccagaaagtgctggggctgggtaggagcccaggttctccagcttcatgcccggtgccctgtccccmgcacccctgagcccctacccatgtgtccttgtcctgaggcccccacttctcacagctcctccttcctttgaccagctcttttctccttttatcttccacagtgagaactcttttccttttgaccagggacagccaggccttcgtttgctggatcaatcttaaagctccctgctgaccccagccttcctgccacccttgctgcctgccatcccagcctaggtttcctccataaagtcactggggaagcaaggactcttgattgcatgacacagaaccctaactcaaactggggaggcgcaa

SEQ ID NO: 170321 - DNA, 601 bp, Human
cagtggagctcagaagaaaaattatattaggccataaaatgtctaccagaaaacagagcttagtctgagggtgtagccagcaaggcttctttcctgaggacctggggattaaagggcatgacagtcggcagggagagcagctggatgagagcaggagagtagacattacacacagtatttaggggtgacatctgccttctaccataaggcagagcagtcgaggttcagtccagagtcgaaatgtgtggagtctaatcccagctctaccatgtgctagccgtgacctctcagccaatataakacacctcttttagccctagttccttcatctgcgtaatgatcacaatgtcagtaccccactggattaagtgaaataacacatgtgaactacttagcacaatgccagtcaatcctattttagatgcaagtgatagaaaaacaaatgtaaatggtttaaggccaaaggagttatatttgttcatgtaactgataagttcaagggtagatctctggatttcaggaagggcttgatccaggagctcaaaaaatgtgaccgaggttcagcctctctctgtctatcagcacctcttctggcgtggct

SEQ ID NO: 170322 - DNA, 601 bp, Human
ataaaatgtctaccagaaaacagagcttagtctgagggtgtagccagcaaggcttctttcctgaggacctggggattaaagggcatgacagtcggcagggagagcagctggatgagagcaggagagtagacattacacacagtatttaggggtgacatctgccttctaccataaggcagagcagtcgaggttcagtccagagtcgaaatgtgtggagtctaatcccagctctaccatgtgctagccgtgacctctcagccaatataagacacctcttttagccctagttccttcatctgcrtaatgatcacaatgtcagtaccccactggattaagtgaaataacacatgtgaactacttagcacaatgccagtcaatcctattttagatgcaagtgatagaaaaacaaatgtaaatggtttaaggccaaaggagttatatttgttcatgtaactgataagttcaagggtagatctctggatttcaggaagggcttgatccaggagctcaaaaaatgtgaccgaggttcagcctctctctgtctatcagcacctcttctggcgtggctttcctttgcggcaggctctttccacactgtgac

SEQ ID NO: 170323 - DNA, 601 bp, Human
ttttaaggagaggagtgatgcagtcaactctgtgttttagaaagctctgattctcctacaggtctggaagccagttagaaagtaaagaagaaggtaagagcagaggcaggagaagtggtcccaggctggtggtgagaacagggctgagccaagctgactggaagtgcacaaaggcctaccccagagggaatttcttatgtaagtccttagggcacagctctgagccctgacctacagctccgtcacttttggtcaccttgagacctagaacacccagccccatcaaggatcagcccatggygaggtcgccatatagggtgccctagcaagatcacccaaactctgggactagttgccttgaagctgcagacccagggtcagcttctagaaacccccaatctccctcaggaaatgtggccacctggagagagacaccaagttcagatgctgttgctgctgcttcttggctgtgttatcctgaacaagggcttaacctctctgagtctgaatatccctctctgaatacaaagtggagataatgatatttaaggtaacggaggcgagggcctggggattaaatcagataaagattatgaatcac

SEQ ID NO: 170324 - DNA, 601 bp, Human
acttcttgtacacctttgcctaggagagctcctggggtgctgtaggctctccatatatgttagataagagaatgagtgagtgaaaaatgcttgctacatagggttgtcatatggcttaaagggttgacatccgtaatgtccctaaagcaatgcttggcacactggaggtgtttaggacgtgtggagctgggcgctgagttatacctaaaaaagaatacttacctagagtgagaagtttcattaacttgttatgtgaccttgagaaagtcctttcccctttctcaccctctgtttccccatycgtaaactgaggacactgggttagatgaccagaaatttctctcttcatcactgatttctttaatgcatgcctcattgcctcccttcatccaaccctcccccaaccacatactcacatgcacgcatgtgcgcgcgcgcacacacacacacacactcgtctattaatctccagtagcattcctctgccccttggcactctttctctttctttcatttcctcgaccagaggccccataagcttattaacctctgttgtccatgttcaaccaatatccttgctttaacaagacagcaataatgt

SEQ ID NO: 170325 - DNA, 601 bp, Human
gtaatgtccctaaagcaatgcttggcacactggaggtgtttaggacgtgtggagctgggcgctgagttatacctaaaaaagaatacttacctagagtgagaagtttcattaacttgttatgtgaccttgagaaagtcctttcccctttctcaccctctgtttccccatccgtaaactgaggacactgggttagatgaccagaaatttctctcttcatcactgatttctttaatgcatgcctcattgcctcccttcatccaaccctcccccaaccacatactcacatgcacgcatgtgcgcrcgcgcacacacacacacacactcgtctattaatctccagtagcattcctctgccccttggcactctttctctttctttcatttcctcgaccagaggccccataagcttattaacctctgttgtccatgttcaaccaatatccttgctttaacaagacagcaataatgtccttttgaattcatttttatcaacaagcaagatctgttttgtgggccagagtgtgctggttctaaatggaaagtagaagtcatttccagctcacttactccataaatgcaggggttctgccgactgcctctg

SEQ ID NO: 170326 - DNA, 601 bp, Human
aatgtccctaaagcaatgcttggcacactggaggtgtttaggacgtgtggagctgggcgctgagttatacctaaaaaagaatacttacctagagtgagaagtttcattaacttgttatgtgaccttgagaaagtcctttcccctttctcaccctctgtttccccatccgtaaactgaggacactgggttagatgaccagaaatttctctcttcatcactgatttctttaatgcatgcctcattgcctcccttcatccaaccctcccccaaccacatactcacatgcacgcatgtgcgcgcrcgcacacacacacacacactcgtctattaatctccagtagcattcctctgccccttggcactctttctctttctttcatttcctcgaccagaggccccataagcttattaacctctgttgtccatgttcaaccaatatccttgctttaacaagacagcaataatgtccttttgaattcatttttatcaacaagcaagatctgttttgtgggccagagtgtgctggttctaaatggaaagtagaagtcatttccagctcacttactccataaatgcaggggttctgccgactgcctctgca

SEQ ID NO: 170327 - DNA, 601 bp, Human
agctgggactcagaaatgaggatgcttggctggggtcattggctagctctagggagaggccatcagagaagagttcttaatggacgggtatatccaaacacatctcaaagagttgaaaggactgaggttggaggagaggagacagaagtcataaatgagagttggaaaaagaaccagaggcaagagaggaaagatttactaccaaaatattcttcctttgataggatgggggcaaggagactgcagactgatttgcagacatgaaaatgcaaggtttcaggaaagcacaggatgaggggarctaaccaagtggggatatacagggctacagtgtgggctgggagacgactgctttgacatgctaatgagtgcctgaatctgggagggtgggacgggatgaaggctggcagaggacctctgaggagctgctgggcagatgctgggctgggagagaggctctgagttaggggcagggctttgggatagggaggggctcccccagggaatttccacatggactccatgcacgaccaatgagtcagagttcatatgttgagcctggtaccctctttctgagaaaagtgaagaatgaacccaggta

SEQ ID NO: 170328 - DNA, 601 bp, Human
ctcagaaatgaggatgcttggctggggtcattggctagctctagggagaggccatcagagaagagttcttaatggacgggtatatccaaacacatctcaaagagttgaaaggactgaggttggaggagaggagacagaagtcataaatgagagttggaaaaagaaccagaggcaagagaggaaagatttactaccaaaatattcttcctttgataggatgggggcaaggagactgcagactgatttgcagacatgaaaatgcaaggtttcaggaaagcacaggatgaggggagctaaccawgtggggatatacagggctacagtgtgggctgggagacgactgctttgacatgctaatgagtgcctgaatctgggagggtgggacgggatgaaggctggcagaggacctctgaggagctgctgggcagatgctgggctgggagagaggctctgagttaggggcagggctttgggatagggaggggctcccccagggaatttccacatggactccatgcacgaccaatgagtcagagttcatatgttgagcctggtaccctctttctgagaaaagtgaagaatgaacccaggtatcatggct

SEQ ID NO: 170329 - DNA, 601 bp, Human
ctgccatcttccagagatagagaacccataaccccacacagggcagtctatcctatggctggacagctcctatggagagccagttcttcctctcagagcttctgcctgcttcctttacctttcccccattgccctaattctatcgccagcaatagaaaaagcaatagtactactcttccgctacaacagttattcatccattcaagcacttccttagcatctactttgccaggcacgttactaagcgggggaattataaattaagcaggaattgccagcccttaaagggttaatgccccctccgtgttctttcttccaggtgaaagatcctcaaatccttcaacctgccctcatttgacctgatttccaggtgcccaccaccaaactagccccttctcgagcttgacatactcacgtttgtcaaagtccatcttaaagtgtggtgtccataactgagctcagtattttccttaagcctcaactagatttgtagcccagctcagttgatgtccatgtcaaaagcaataccagttgtggaaaaactccaattgtaaccagagtgctgccagccaggtcccatttactgagaatattcttgaag

SEQ ID NO: 170330 - DNA, 601 bp, Human
aagatcctcaaatccttcaacctgccctcatttgacctgatttccaggtgcccaccaccaaactagccccttctcgagcttgacatactcacgtttgtcaaagtccatcttaaagtgtggtgtccataactgagctcagtattttccttaagcctcaactagatttgtagcccagctcagttgatgtccatgtcaaaagcaataccagttgtggaaaaactccaattgtaaccagagtgctgccagccaggtcccatttactgagaatattcttgaagcacatgaagaaagaggggacggrgaggactgtgcacttgaaatgacatgatgtcagatctccctgcccagaattcccctcaggcattagtggaaagtctaagtcactctaatcaaagagcctccctgccactgccatccccctcttagtatctgccctaggaaagggaagaaaaataaagaataagcattctatgctgatggcccaacacagtgctaaacatggaactcagccctaaaggaggggccttccttacacaagcctgtaaggggagaacagacatagacttcagaaggtgattctccaggtgacgaggatgggttc

SEQ ID NO: 170331 - DNA, 601 bp, Human
cctgtaaggggagaacagacatagacttcagaaggtgattctccaggtgacgaggatgggttcaccaatggcctctgactggtgggggggtctcctgctttaaggcctctgctgtgatcgtgtgtgaagggataagttctccctcattggaacaaaatcacatttctgcagctcttgttgccccttccttggaaggaagccatccccttagaaggagaagccatctccactctgacataccttgatggatgtgaaactcctgcagatctttcacaggccttgtgcaaggcccctcctctcygaagccattttcctacacatcgggctggagtaattgggagccgaaagatggcaggcagaataaaaaggctcattaggtgagagtaataaaacaaaacaaaacaaaacaaaaatgagtgcaaggggaagaggaaaggctgggggtgggagcagatgttgtcctgcctcttggaagtccttttactttcttgggcataggaggaaaagaaatggccttctagaataaattttgccagaggagtccttattcttcacaggatatcagatctcaaagggattggcgagtggcttgcctaaggtc

SEQ ID NO: 170332 - DNA, 601 bp, Human
tgcatttctgagaaagcatggaaagcctgttcctttttggcttgttccacaaatatgtagtcggcaacggctgacattttatgagttcctgcaacaccccaggcacttgaccggtatcattcattctccttcaaacgtccattcaagggcaaccttaatactcccccattttgcagggagcaaactgaagcttgcccagggacccccagccagtaagtatagctgcctggattttgaaccaggtgtgtctgatgccaaagcccctgggctgttttgtgttttgctttttttttttttttttcctacacatcatgactttctcttcccaaaacaacctatcagatgagatggtctgatcacgtagataagctcttgggccccatatcatgaaataatctcagtctaccgatatgacttctcatcttgagagaaatgaagaaaatctatcaaagaacaaccagtgaccctgaactcagccaggctgcaatatccagccttgaacccaacaaggttgcaacatctgccaccctttcccaggaaccctttttcttccttgcaaggctgtgtgggacaaaaggccttggggagcaggcctggcctc

SEQ ID NO: 170333 - DNA, 601 bp, Human
atctatcaaagaacaaccagtgaccctgaactcagccaggctgcaatatccagccttgaacccaacaaggttgcaacatctgccaccctttcccaggaaccctttttcttccttgcaaggctgtgtgggacaaaaggccttggggagcaggcctggcctcagcttaccatgaagctacttcacactttggatagctcacggatgtcccctctacacttgaaaagagatctgtgtctgttaaagaacagtggaactgaatggttaaaatacaaagaaaatctcaagttagagcactagggtwcagcttctcagggatgtagggggaagatggtaaggaggccaagggggaaggctcttcctcccccaccacctccactggaagagttccacttttacatattttgcatattgagaatcccattaagattttatttggagaacccttctgaggcaaaaacataataaaaaatataataaaaactgaaagccggtgatttaggaagaggagtagggtgctaatgtctgccgagtgcctgcaaggcccgtgctaggtagtttaaaagccctaagcccccagaagattataatgtctccaacactc

SEQ ID NO: 170334 - DNA, 601 bp, Human
ccttgctgaaggtcccatggcaaataaggaaatgacggtggcgttggaaaccagatctgcctgactccaagttccaggctctttccaatgctcctggcttcaatcaaatctgaacaatagggtcaagatgaaggctttaaaatagggaccaaaccgctttcaaaaagctatttggcagcacctacgtgtctgcccagtaaatcgctctcttccatctcctttctcctccagcagggcattgggtcttgacctcagagcgatgggtgcctggtgtctgaaccagggtgaggctgctgtctgyctagctcccccgccctgcctgtgcagaggcctctcccatctgactcccaattctcttctgcaggttgtcacatcttcccaagccaggccagccaggagcgctgcatgcaaattctgccgtgggctaaggcacgctaaccagagccggcggcatggacttcgtcatgaagcaggcccttggaggtgaggtccagcgcccctccgcgtgtcctcagccggtcccacccttgtgggaggtggcctcggcccacccggcccctctctccccagccctgacccctagctgaccccgccctctcct

SEQ ID NO: 170335 - DNA, 601 bp, Human
agcacgcgcgcatggaggcggagcgggagaaggtccggcagcagatccgagataaggtcagctccgcccgcccgcccgtcctggggagggccacaagcgggtaaaaccggtccagctaaagcccctgctggggctcccctggatcccagctctcaccttcgccctagttctgagcctcactcttctcatcagcaaaacgggtatcacaaggtcacctccctcaagggatccttttggggattaaataagagaatgcgcgtagtaggtactccaagagggtggaccctacggtccaccattycgtactgcagatctttgggaccaaaaatgagtgcagttctgaatttgggaatgttcgaaaaataccacagtgtcctaagcactttgtgctgtcagctgtcactcccagcgggtctggggctgccaccctactccagacagtccagtgcatgtctgttagtgcgtgcaataaataaaggctagaagtagtcttccattggttcaagtcagattcgtcaccaaaatttggctcaaaatatatgggcaaacgccatgtgttcagatctttgggggtttcaacacagcaggaagttctgatggg

SEQ ID NO: 170336 - DNA, 601 bp, Human
aattatatgtattttatatttgcatgctgttctacaagatactttataagagaccactgttagagtgaaatatattcaaacaatagtagataatctttgttatgtgaattatttgtatgttgatagcaagtgttaataccacattctgacttttaaaatgttggcagtttacaaatagctgttccttaaatgcttgataataactgaaaaaggaactaacacaggatcaccagttgattattaaatgagctcaaaccacaagacaaggctgtccgtgtcccaaaacacccattaaatatcttattttttcttcttttgctcatttgaaaatcaggaggcttgtcagaactttgagaaacagtatataatgtaatagggtgactatttcattattttcaagaacagttgtcctacaataatttcctactgtgatacaaggcatatcaggaacttagttttatataaattgatatcataagcaatttagaacactgtggcttatttaacaccttaataatcagtactgttttgtaacttaaaatgaaggattctaaacattgaatacacctagtagccaatattaaataacttgcaaataaaa

SEQ ID NO: 170337 - DNA, 601 bp, Human
gttcaacgaagttattggacaatatgaactctatttaaaatacatcaaagtccaggcctggcacagtggctcacgcctgtaatcccagtactttgggaggccaagacaggaggattccctaagcccaggagtttgaaattagcctgggcaacatcgcaagacccagactcttattaaaacacacacgcacacacacacacgcaagatacatcatagtcatgatactccatgaaataagctacctctgaaggaaaatactcaggtggggactgaatcaccaattattagaaatgtttagagractcctgtacaaaccaaaagtagagaatttcaaggttagaagaaaccttacaactcacccaactgagacctaagccctctctaatatattcctggacgaggtcgcccaaccgttttggtaatggagaactacccatggaaacaagtcacttcaacttaggccaaatatgatgcaaagttactttactgaagccacaccatcctctggtaactttcgtccactagtttcacctatcacttaagtgtccctcaaatattttggatagtgataatatgccccttaaatatcctgtcctccaaa

SEQ ID NO: 170338 - DNA, 601 bp, Human
atttttaataattttgtgcatgaaacaaagtttgtgtacatgaaccaaccatcaaaaagcaaaggtgccaagtgtggaatttttcacttgtggtgtcatgttggcgctcataaagttttggatttccgagcattctggatttttggattagggatactcaacctgtacaatcacatctttgatgagaaagaaaatttagctcatttataaagatctcttgactctggcagcctggagaaaatatatctagacttgaagtgaaaggagaaattaggttggtcctgaacttggagctaagtgycatctgtcaaagaggtgtggtgggaagtggaaaagattatctataaggttgtttcttgcgctaacgctgtaggggcttataacaaatttagaactagaatccttcagctttcaattcacataagcaagaaatttgtaaaaaatcggcaaacgggctgggcggggtggctcacgcctgtaaccccagcactttgggagaagaggcgggcggatcacaaggtcaagagatcgaaaccatcctggccaatatggtgaaaccccgtctccactaaaaatacaaaaaattagccgggcgtggtgg

SEQ ID NO: 170339 - DNA, 601 bp, Human
cttctataaaactttagtgccctagttttatttatttgttttttgagacagtgtctcactgccacccaggctggagtgcagtggcacgatcatggctcactgcagcctcaacctctcaggctaaggaatcttcctacctcagcttcccaagtagctgggactacaggcacacaccaccacacccggctaattttttgtgtgtagagacaggggctcactatgttgcccaggctggtctcgaaatcctgcgctcaagtgatcctcccaacacggccccccaagtgctgggattacaggcatragccaccacaacagtctctaatttttttttttatgtgtctgtgtccctctctactattgtaagctccctaaaggcaggtactggctcaatcatttttgtatattcacccagactaacatgttatttattacattatatttgaccaagtttcagaaaatatttaatctagcttggtgcctagcacacagtaggacttaacaggtatttatcaaacaaatttaccaaaaatgaggtcagtaaatgaaataacacatctaaaacagttacaacagtagctgaaacacagtgtagattccataa

SEQ ID NO: 170340 - DNA, 601 bp, Human
atctcagcagaatctggaaggataattcagctctgtgggctgcagatgcgtctaagtgtgtttctggttacaaaaattcatagaattgaatttggataagtctttaaagatcacctagtcctgaggctttccacctttattttaaactaataacatcttttcttcaaaagtctaattgaaactccagtatataaaacaggtaatatggaagaactgctcttctgaaaggggagggttattgaaaaacactgctgttctaaccaacccccttcgtttttaaaataagctgagacactaagaaggacaatgacttggcaaaagccatataaagacaaaaacgcaacaattttcaaagaacaactcttaagcattatctactctttgaagtctttcctttctcccccggtggaatttatcaatgtatttcattcctcaatatatctaggacatacctccgttatggcttctataaaactttagtgccctagttttatttatttgttttttgagacagtgtctcactgccacccaggctggagtgcagtggcacgatcatggctcactgcagcctcaacctctcaggctaaggaatcttcctacc

SEQ ID NO: 170341 - DNA, 601 bp, Human
atcccagcactatgggaggccaaggagggcagatcatctgaggtcaggagtttgagaccagcctaggcaaaatggcgaaatctcatctctacaaaagcttagctgggcatgatggcacgtgcctgtagtcccagctactggagagcctgaggtggaaggatcacctaagcctgggaggtcgaggctgcagtgagccgtgatggcgccactgcactccagcctgggttacaaagtgagaccctgcctcaaaaataaaaataaaaataaaaaataaatagaatacaccactactaatcctgcycaaccagaatttccactcaacaccaataaaaatttgaatatcaattcccaacctgaagtcccttaacccttccagaagggaagggaatcaatacttggtaagcatttaatacagatccctaaaaaagcataataggtgtcctggaaatatgcccaacatttcaaaaaagcggaatacaaattacacatatgctgaagtaaaattccgcaggctattaataaatgcagactggtaaatctttcaaggtattatttcaccacaatattcctctaaatgggtcctcctctggtacttattcaa

SEQ ID NO: 170342 - DNA, 601 bp, Human
ttactattcagaatgcaccacagccaggccaggtgcagtggctcacctgtgcctgtaatcccagcactatgggaggccaaggagggcagatcatctgaggtcaggagtttgagaccagcctaggcaaaatggcgaaatctcatctctacaaaagcttagctgggcatgatggcacgtgcctgtagtcccagctactggagagcctgaggtggaaggatcacctaagcctgggaggtcgaggctgcagtgagccgtgatggcgccactgcactccagcctgggttacaaagtgagaccctgyctcaaaaataaaaataaaaataaaaaataaatagaatacaccactactaatcctgcccaaccagaatttccactcaacaccaataaaaatttgaatatcaattcccaacctgaagtcccttaacccttccagaagggaagggaatcaatacttggtaagcatttaatacagatccctaaaaaagcataataggtgtcctggaaatatgcccaacatttcaaaaaagcggaatacaaattacacatatgctgaagtaaaattccgcaggctattaataaatgcagactggtaaatctttca

SEQ ID NO: 170343 - DNA, 601 bp, Human
cagatttgtataaggcttctgctcagtatacgtgctgccaaagtgagcaaaaggcttctgctcagaagtgagccacttcactagcaaactattcaggaagccaacaaatgttagtgttctcaatgcaactgttccactcactggaattgtgatcctcctcctgttccacagcatataatagtaaacaacataatattcagaaatagcctgtaccttattcagcacacacccacccattattttctataatatatggaatttttatttatttatttatttatttatttatttatttatttatgtttgagacagagtcttgctctgttgcccaggctggaatgcagtagcacaatttcagctcactgcaacctctgcctcccaagttcaagcgattcccctgcctctgcctcccaagtagttgggattacaagcacctgccactacaactggctaatttttttatttttagtagcgacagggtttcaccatgttggccaggctggtcttgaactcctgacctcagatgatccacccacctccgcctcccaaagtgctgggattacaggcgtgagcccccacgcccagcctgaaaatttattaa

SEQ ID NO: 170344 - DNA, 601 bp, Human
agcactttgggaggctgagacaggtggatcacctgaggtcaggagttcaaaaccagcctggccaagatgatgaaatcccctctctactaaaaatacaaaaataagctgggcatggcggcacatgcctgtaaccccagctgctttggaggctgaggcacgagaattgcttgaactcgggaagtggaagttgcagtgagccaagatcacaccactgcactccagcctgggtgacagagcaagactccatctcagtcaatcaatttctcactctccattcatccttaactcactacaacctggyttctgcctccataccattcctttgaaactgctttcaccagtaataatttctcgagtctccaaaagggattcagtcctagtactgcttgacctctcagttttatctatcatcactccttgcttcaagaattctcctccactggttcattaaaaaaaaaaaaaaaaaaaaaaaaaaaagccactatcacctgcttcccaactgctccttttcaatttcaattgtttataggttgctcttcttctgtgtccttatgaagatccttagccttagagacattagttaacttgctaaaggtcacat

SEQ ID NO: 170345 - DNA, 601 bp, Human
ctaaaatgtactggaccttgagtgaataaaacagacatgatctccgtactcacgggcatttagcctagcaaacatttaaagtgaattaagtggaaagcaaaaagaaaagtgaagaggggaacacatcagctacagaaagactagtaccatttgtgtcaacacaactgacacaattataactgactcttaagccagtcttccacatcctatagatttaaactactgctttattcttaaaatactgctttacttttatcattttcatgctcaagaacccacaaattttcttagtatttaccaygtatacacttcacccattttctacattagctatttcaaaccttcacactcaaggcttcccctatgcatcccactatttcccttagagttccccagaggaccacctaagtacatttcaatgactactttacaaataagaggggaaagtcaccctttcaagttttcactgcctgcatccatactcgttacttccttcactttaagtgaagatattttctcgtctctctaaaatgagcctctctgggtatgttcttaagattaatcctgtcacctcacaactatctaagaatctattattatt

SEQ ID NO: 170346 - DNA, 601 bp, Human
attttttgtagaggtagggtcttgttttgttacccaggctggcctcaaactcatgatctccaacgatcctcctgccttgacttaagatgctgggattacaggcatgaaccagcgcgcccagccaggaattcttaaattttctttttatctaaagttccttccctgtgatgaccacataatacttctttattgttatttaacacttatcttcttgtaattactaaaaaataaataaaacaaaagtcaaatctctccttcctttccccagagaaatgagcttgctgaataccatccctaatcrtttctgtacatatatatgaatacgtgaaaaactataatttaagtaaacatataacagtaatgttttttccttttaaaaatggaattatacattttgttttgccactagttttcattcaacaataaatcagagaagatctctctatttcaacatataaaatcacctatccttttttatagctatgtattattttcattgtaaaactgtaacataatttaatctttattcaaccaatggaaaataaagttgtaccaactttttactactacaaaaaatgctacaaagccagctttattcatg

SEQ ID NO: 170347 - DNA, 601 bp, Human
gagtgtaccggtgtgatcatggctcactacaacctcaaactcttgtgctcaagccatcctcctacctcagccttccaagtagctgggaccacaccagctttggtggtgcacaccaccaagcccagctaattttttaattttttgtagaggtagggtcttgttttgttacccaggctggcctcaaactcatgatctccaacgatcctcctgccttgacttaagatgctgggattacaggcatgaaccagcgcgcccagccaggaattcttaaattttctttttatctaaagttccttccctrtgatgaccacataatacttctttattgttatttaacacttatcttcttgtaattactaaaaaataaataaaacaaaagtcaaatctctccttcctttccccagagaaatgagcttgctgaataccatccctaatcgtttctgtacatatatatgaatacgtgaaaaactataatttaagtaaacatataacagtaatgttttttccttttaaaaatggaattatacattttgttttgccactagttttcattcaacaataaatcagagaagatctctctatttcaacatataaaatcacc

SEQ ID NO: 170348 - DNA, 601 bp, Human
gtagagataaggtcttaggagtacagactattcatttattactaacagaagagaaggtatgcaaagactcaaagaaacaaattctctcccttcaaaaaattcaacataatagcgtggaaagacaagtaataactacaaaaatatgaaatcgcttggaaaaaaaacattgctagagggccacacaagagtcactaactacatgtgggaagggacgattgaaagaaaacagaaaagagaggagatactcatgcatgaattcaaaaggcaaatatgaccaaagaaaacatgtgccaagaaaagragcacaaaatagcacaacagaagatgaagatgaagatagaacgttaagaacaaaatagaaggccttggacattacctgccattatgagaagtttgttagaaggaataaaatgagagaatacaatccatttatactctaattactgcttagtacctcctcagtaatgtattttcatagaatagcacttaaatctatcatgtagtaacagtactgtctggctgggcacagtggttcatacccgtaattccagcactttgggagatgaaggcaggaggatcacttgactctaggatccaggaa

SEQ ID NO: 170349 - DNA, 601 bp, Human
ctgtaacctcaaactcctgggctcctgcaatactcctgcctcagcctaccaaagcactgggattacaggcatcatgagccactgtgcccagcctaaacattatgttttgatccagacaaaaagcaagaaataaagtaaccaaaaaaaaagactgaaaagtatatccttatgtaacaagccaaaggagaaaaggaagaagacagaaatggaagcaagactttaaaacaggcactattctaggcactggcgatataagcagtaaacaaaactaattccttgcccttgtgatgaaacattccastgcaagagaaagacaatgcacaagtaaatttatgtcaaatgacaataagtgctataaaaaaaaagagtaagaaaaaacatggaggtaggaaaacaaaatttattttatacaggctgatatttaaagtcatgagaccggacaacatacagagtaagggtagatgagaagtctgaaaattgagccctagataatccaaaatttagaagtcagggaaataagaagagatctgtgaataagcaggaagagaactatgaacagtggtgacctgaaagtcaactgatcaaagcatttcaagaagaa

SEQ ID NO: 170350 - DNA, 601 bp, Human
agaggcaatataaagagggcttcagctgttatctgtaaggttttgtttctatatatatgtatgttttatatatacatatatgccatatatattcaaagacagagtctcagtctgtcgctcaggctgcagcacaatgatgcgatcatagcttactgtaacctcaaactcctgggctcctgcaatactcctgcctcagcctaccaaagcactgggattacaggcatcatgagccactgtgcccagcctaaacattatgttttgatccagacaaaaagcaagaaataaagtaaccaaaaaaaaagactgaaaagtatatccttatgtaacaagccaaaggagaaaaggaagaagacagaaatggaagcaagactttaaaacaggcactattctaggcactggcgatataagcagtaaacaaaactaattccttgcccttgtgatgaaacattccactgcaagagaaagacaatgcacaagtaaatttatgtcaaatgacaataagtgctataaaaaaaaagagtaagaaaaaacatggaggtaggaaaacaaaatttattttatacaggctgatatttaaagtcatgagaccggacaacataca

SEQ ID NO: 170351 - DNA, 601 bp, Human
aatacaattttccacagatagtaattttttttaaaacctaacaatatcgaccaagcatgatagctcacgcctgtattcccagcactttgggaggccaagagggcggatcaggaggtcaggagaacgagaccatcctggccaacatggtgagaccccatctctactaaatatacaaaaaaaaaaaaaattagctgggcatggtggcaggcacctgtagtttcagctactcaggaggctgaggcagaagaattactagaacccaggaggcagaggttgcagtgagccaagattttgccactgmacagcctgggcgacagagcaagactccatctcaaaaaaaaaaagaaaaatttcttaaaattagctgggcgtggtggcagtcccagccactccagaggctgaggcaggagggccccttgagcccaggacttctaggttacagtaagctatgatttcaccactgcactccagcctggataacagagtgagaccttatctttaaaaaaaagaaaagaaaaaaactaacagtatcaataactgctaaaaatgtaagaacgtaaagaagcaggaactctcatgttctattggtgtcaatgtaaaa

SEQ ID NO: 170352 - DNA, 601 bp, Human
aaaaaaaaaaaacaagcaataaccagaaaaagtagaaaatttaaaacaaagtatcacatcactgtagaatttcttcagagaagttcaaaatgaggccaggcatggtggctcacacctgtaatcccagcactttgggaggccaaggcaggcggatcacttgagatcaggtgttcaagaccagcctagacaacacagcaaaaccttgtctctgctaaaaatacaaaaattagctgggcatggtggcgtacgtctgtagtcccaactacttgggagactgaagcagaaggatcacttgaacccrggaggcagaggctgcagtgggccaagattgcactgctgtactccagcctgggtgacagagcacgactctgtctcaagaaaaaaaaaaattagcttttggtgcagatttaataatgtttctttaatgaactcaacctaaaattacaagacaaaacagcatttaagtcatttcaatcaagaatgatgtttgaatcacaagtaatggcaagctacgtcatatacttcctgtgctataaaaagttaaaacaagaagtaatacctccattcccccacaaactatagtttcagaagtgccttccag

SEQ ID NO: 170353 - DNA, 601 bp, Human
gtcaaagctctccatgagtccatggataacattggacttaatatcctcctaaatgccaattttgtctctccaatttagatgcatagaactgtttattagaatgagttatcataggtaatttgactttggaccatggagttcattcaaattgcgtatctaaacaatgttagtattagctgatttagcatgaaaatctggcatggttattttcttggtattcaattaaattttgtcctgcttgggttagcagttttagaattagtaaaaaatacatatatacgtatatagggctttcccccccgccaataaaagacatccatctagaagcagtggctcatgcctgtaattccaacactttgggcggcacaggcaggaggatcacttgagcctagaagttcgatgctgcagtgagctatgatggcaccactgcagtacagcctgggtgacacagtgagatcatctctctaaaaaagaaaaaaaaaaagaggctgagtgtggtggctcatgcttgtaatcccagaattttgggaggctgaggtgggaggattgcttgagcccaggagttcaagatcagcttgggcaacaaaaggagacctcatct

SEQ ID NO: 170354 - DNA, 601 bp, Human
actttaaatcaaaaccgaaaatatgtttattcacagtataaacttacgtgtctagaataataaggaacagagaagtgctacctacaagaaccttcctttctcttcttaccaccacctttataatatagtagctagaatattacaagagagatagtgtgggacactatcagccttaaaaacatctttattaattagacctattttacttttgttaatatttcccaattaagttgtccagagtatgaaaaattatatgcacaaagatgttccaagtggtattacttcttttttttttttttttgagacagagtctcgatctgtcacccaagctggaatacagtggcacgagcttggctcactgcaacctccgcctcccatggtgaagtgattctcctgcctcagcctcccgagtagctgggattataggcgggcatcaccatgcccagttaatttttgtatttttagcagagatggggtttcaccacgttggccaggctggtctcaaactcctgacctcaggtgatccacccaccttggccttccaaagtatgaggattacaggcgtgagccactgcacccggctgcccaagtggtattactt

SEQ ID NO: 170355 - DNA, 601 bp, Human
tggccatagtggtgtccaattatattataaattaactgatggatttatgctgccagatcctcagaatgtttgccttagaagatgacatctatgcttccccgatgcttattttattcatacaagattggatttgacacccatcagcatgcttcatctttcacctcagagatactcagagttgacttgggttgactagtcagggttgatttagatagggttgattttcccattccgtaagtttttctttctgaagaataaaacttccccagatagaattgttttttcttcaaaaatataggayagttgctctagaactttcttatctggagacagtttaactacagttgtatacagacttatgtctatcattcacactcatagctgcctctgtgttcattgctgctgcagctagctcattatagagactgccacctctttctcttactcgactctcccagtgccttctggccactacagctagcttaaaatggcatttcatacaccttggtcaccgggagagtttacttctatctactttttcatccccagtagaaagtaaaagctttcttccaattggtcttcctgttgcaattactattac

SEQ ID NO: 170356 - DNA, 601 bp, Human
aaacatcagaggggagggtacctgtgtcacagtttcaaagtctttacggtaacttaaaatacttctaagtattaaaacttaaaatatttctaagtatttagaaatgatgtagttagatgtaggagatgcacagcattctcagtttacctggatctcatggagcataaaaattggcatgaagtaaactgtgtaagattaccagagccccagcttatctgctttgtctgtaccgagacagaaggggaggggttacagactatggtgcctactcccatcactgcttccctcagccataacaggrcaagggggatcttgaaagcatcttgaaaattgtaaggtgatccagatttggccgtgtcttttactttggccatagtggtgtccaattatattataaattaactgatggatttatgctgccagatcctcagaatgtttgccttagaagatgacatctatgcttccccgatgcttattttattcatacaagattggatttgacacccatcagcatgcttcatctttcacctcagagatactcagagttgacttgggttgactagtcagggttgatttagatagggttgattttcccattccg

SEQ ID NO: 170357 - DNA, 601 bp, Human
cttcagaaatttgcagagatttttgtgttctacattctttttcttgtacccttaggtagggaaaaatcattaactaaattgatgaaggggatctgaggaccaaatccaggattctagggaaatattggatccttagtatctgaagaacaccgtattctaccttctagctataaggtagaatgtataaatattaggcctcagaagaaataactacttacagaaatggcaaaatctttgtaacttaaaattacaatggaccgttcctaatgaacaacacagcacttaaaaatgaggggtcctsaattagtcttcaaggatgcctattgatgtgcagaagcttctaaaaacatttcaatatttttattgctttattaaaagacttcataaaaggcaaatagggccaggtgtggtggctcatgcctgtaatcccaacacgttgggagatcaaagcaggaagatcgcttgagcacagcagttcaagacaagcctatgcaacatagtgagatctcctctctacaaaaaattaaaaatcagctggatgtggtggtgtacacctgtagttccagctactcaggaggctgaggtgggaaattcacttgag

SEQ ID NO: 170358 - DNA, 601 bp, Human
gtttttatggaaatttcaaaatatcagcattccttcctccaaggatagggtgggacgccctctgaggagggtcttataactcccaatcagaaaggcagggaagattatagggtcttgtcttggggcagatgagagatggataggagaaagtctgagaaattctgtttcctgaggcctgcccatgagacctgacacacccaacattgtaacaaaaagactttaacaagggctatgggagttacaagccaggaacaatggatgaaaaccaatatatgtaacatttgttaaattaagtctagayacatgagacctgacacacccaacattgtaacaaaaagactttaacaagggctatgggagttacaagacaggaacagtggatgaaaaccaatatatataacatctgttaaattaagtctaacctaaagccacctccttacatattttaagtttggcctaaaggtttctctgtacacagtgaactgaaacttaactagatgtataaacagatcgtaacctacttttgtgctaattaccgagtttcagtcaatcaaaggcagccaactgttcaaactatgttcaaatactccaaatgcccgaa

SEQ ID NO: 170359 - DNA, 601 bp, Human
tttattgtaaaggatattacagataaagagatgcacagagtgaggtatgggggaaggggcacagggcttctatgcccttcctgtgcaggccaccctccaagaacctccacgtgttgagccatcctgaagcttctggaacctagtcctcctgggtttttatggaaatttcaaaatatcagcattccttcctccaaggatagggtgggacgccctctgaggagggtcttataactcccaatcagaaaggcagggaagattatagggtcttgtcttggggcagatgagagatggataggagaargtctgagaaattctgtttcctgaggcctgcccatgagacctgacacacccaacattgtaacaaaaagactttaacaagggctatgggagttacaagccaggaacaatggatgaaaaccaatatatgtaacatttgttaaattaagtctagacacatgagacctgacacacccaacattgtaacaaaaagactttaacaagggctatgggagttacaagacaggaacagtggatgaaaaccaatatatataacatctgttaaattaagtctaacctaaagccacctccttacatattttaa

SEQ ID NO: 170360 - DNA, 601 bp, Human
cattcagtaatttcatttctaggtatttcatttctaggaaaaactctcaaacggtttttctttttctctcatactactacaatggtcagcaaccaaagtcttctgtgaccaaatccgtgcaattaattcttcagtggacaccaactgggtgtcctccaaatcagctccaacactacctggaaatagcatcagatcccccaggatgagggctcagtccccaagactgccctgccaacaaacaaacataccagtttcaagtccagacctctggaacttctgacttaccggctttcaagttggrgttcccacgacctcctctttgggtttgattaatttgctggagggctcacagaactttgggaaacacttacatttactggtttattgtaaaggatattacagataaagagatgcacagagtgaggtatgggggaaggggcacagggcttctatgcccttcctgtgcaggccaccctccaagaacctccacgtgttgagccatcctgaagcttctggaacctagtcctcctgggtttttatggaaatttcaaaatatcagcattccttcctccaaggatagggtgggacgccctctgaggag

SEQ ID NO: 170361 - DNA, 601 bp, Human
tgggaggccaaggtgggaggatcacttgaggccaggagttcaagaccagtctgggcaacatagcgagaccccatctctaacaacaacaaaaatagccaaggaagttaagagtcacaagaatgtttgcttccctataaaaactaaagataataccttaacatgtctccagttgtttttcagaaacctgtgcccacaccaaaaggatctgccagcacagcaacctcatatagagaggaactggggactgaactctgactccccttctttgttctaaatttctttctgaggggcctggagaagrttatacccatgagccagtgctaacattcttttctgctgatctcaaatttttagaaaaagctttgcctccttaaccaactgcaaatcagaaaatcttctactgtacctatgacctatacaccactgcttcaagatatcccaaccttttaggccaaaatcagtgtgtaaccctccatgtatggtttatgattttgtctgtaacttctgctatccagaaatttaccactgcctttaaaaacccttacctgcaaatcatcggggaggtcaggatttaagcattagctacctggtcctctttgcg

SEQ ID NO: 170362 - DNA, 601 bp, Human
ttacataaaagaattcctggccaggcacggtggctcatgcctataatcccagcactttgggaggccgaggcgggtagatcatggtgtcaggagttcgagaccagcctgaccaacatggtgaaaccctgtctctactaaaaatacaaaaaaattagccagatgtggtggcgtgtgcctgtaatctcagctactcggaaggctgaggcaggagaatcgcttgaacctgggaggcggaggttgcagtgagccaagacatggcactccagcctgggtgacagagggagactgtctccaaaaaaawatatatatatatatattatataaaagaattcctttattttggaagtcccttcacttgaagcttcaaacaaatttgccagaaataatgagactctgcctctatataaaaggcttacttgattttgcctcttgagaggagcaagagccctgctccctccttagaagtctgctctctaaacatgtcagaaatcccgtatcttagctgcaagtaaattaactcattaaaagtaaacaagtccacatactcactttgggatccacaaatctattcttgcccaggtactaaaaagatggatgcggg

SEQ ID NO: 170363 - DNA, 601 bp, Human
agttttaaactatatagtttatatagttttaaactatataaactatatagttttaaactagtttatatatagttttaaactagtttaaactatatagtttatgtagttttaaactatatagtttatgtagttttaaactatatagtttatgtagttttaaactatatagttttaaactatgtagttttaaactatatagttttaaactatgtagttttaaactatatagttcatgtagttttaaactatatagtttaaaactatatagtttatgtagttttaaactagtttatatttttttatatagtttaaactatatagtttttaatagttttatatatttatagtttttttaatagttttatatatagttttttatagttttttatgtgagcctccatgcccggccacttttcttattttctctgtctactactggcttagcaaattctgtgtgctgccctggagtcttaattacttcaggtgatcacactgaactataaatataattgcctttttgttatgcttccttgtggactttcatcctcccaaattaaaagggcaattttataattagaatttctgagacgttgacaaagac

SEQ ID NO: 170364 - DNA, 601 bp, Human
aaggtcagaatatcaagaccatcctggctaacacagtgaaaccccgtctctactaaaaatacaaaaaaagaaaattagacaggcgtggtggcaggcgcctgtagtcccagctactcaggaggctggggcaggagaatggcgtgaacccgggaggcggagcttgcagtgagccgagatagcgccacggcactctagcctgaatgacagagcgagactccgtctcaaaaaataataataataataataaggtacaaatatcgaaagctaaaacaaatcactgcaaaacatattattacctagracaagagaattaccaaaaacaaaacccaaaaactattattaataaatagaattcagcaaagtagccaaaatcaaagaactataaacaaaaatcagtagctttcctatacatcaaagtaagatttttttaaaatccctttggccaaagcaatataaactataaaatgcataaatatacctaataacaatagctcacatttttaatgtattaacttacatgtcttaacccagttaatcttcacaataatcctgatgagttattcccattttatggatgaggaaactgaagcacaaaaaaggt

SEQ ID NO: 170365 - DNA, 601 bp, Human
gtccccaccagatcagctagacacagagtgcagattggtgcatttacaaaccttgagctagacacagagtgctgattggtgaattcacaaaccctgagctagacacagggtgctgattggtgtgttcattaacctcgagctaggcacagagtgctgactggtgtatccacaatccccccagctagacataaaggttctccgagtccccactagactcaggatcccagctggcttcacccagtggatccagcaccgggccagcaggtggaactgcctgccaatcccctgccttgcgcccgcrctcctcagcccttgggcgatggatgggactgggcgccgtggagcagggggcggcgctcgttggggaggctcggggagtgcaggagaccacggcggggtgggaggctcaggcacggcgggctgcaggtcccgagccctgccctgcggggagtcagctaaggcccggcgagaaatcgagcgcagcgccagtgggctggcactgctgggtgacctgacgcaccctccgcagctgctggcctgggtgctaagcccctcactgccaggggccagcggccactctgagtgcgggcccgccaagccc

SEQ ID NO: 170366 - DNA, 601 bp, Human
tcacaaaaaaaagaaaagaaaagaaaagaaatgtcccgttttcagaaatgccttctctgaccacactacctaaaatagctctttcgcccatttctattctcttttatcctactttaaccttcttcgcaccatttatcattacttgattttattttctgcctgcaccattagaatgttatctctgaggacagagcttttctttccttcacagctatatcctgggacaacaccaggcatatatataccaaacatttaataaacagatattgaataaacaaaagaatgttaacgcctggagggracctgatacatagtaggtacttaatatctacttaatgaaacaaaatgagacaaaatctaacacctaatttaaaaaaaaaagaaagctatgtgtacaacatgtatccattaaatgcatataaagttacaacaacagaactaaaagtacacaaatcaaatggaatggtaatgtatatatctggggaaaggagaaaaactagagatacaaagatattttacactttataatttttttttttttgagaccaagcctcactctgacgcccaggttggagtgcagtggtgccgtctcggctcactg

SEQ ID NO: 170367 - DNA, 601 bp, Human
tgctctaaacaaatgactttattgttgtttcctaaacactgccaacagactctcagtccagggcctttgtgcttgctgttctgttggccttaggggcccttgacccagataaagtatgtgcccgactgctctacctctttcaagtctttcatgaaatgtctccttttggcccggccgcagtggctcacacccgtaatcccagcacttcggaaggccaaggcgggcagatcacttgaggtcgggagttaaagaccagcctggccaacaatggcgaaaacccgactctattaagaatacaaayattagcttgtgtggtggcatacgcctgtagtcccagctactcaggaagctgaagcaggagaatcactcgaacccgggaggcggaggttgcagtgagccaggattgcaccacagcactccagcctgggcgacagagcgagactccgtcacaaaaaaaagaaaagaaaagaaaagaaatgtcccgttttcagaaatgccttctctgaccacactacctaaaatagctctttcgcccatttctattctcttttatcctactttaaccttcttcgcaccatttatcattacttgattttatttt

SEQ ID NO: 170368 - DNA, 601 bp, Human
atcttgaacttctagaccccagagctgttatttaagctactctgtctttgatattttgttatggcagccttagcaaattaatacaaggccatttcccttttcaaaattcatcattggcttcccatcatacttaaaatccaaaatccttaccatggcctatacaatgctcaacatgatctcgttctcatttacctctccaaccttctttcccactactcttccttcattctgtttgctctaaacaaatgactttattgttgtttcctaaacactgccaacagactctcagtccagggccttygtgcttgctgttctgttggccttaggggcccttgacccagataaagtatgtgcccgactgctctacctctttcaagtctttcatgaaatgtctccttttggcccggccgcagtggctcacacccgtaatcccagcacttcggaaggccaaggcgggcagatcacttgaggtcgggagttaaagaccagcctggccaacaatggcgaaaacccgactctattaagaatacaaatattagcttgtgtggtggcatacgcctgtagtcccagctactcaggaagctgaagcaggagaatcact

SEQ ID NO: 170369 - DNA, 561 bp, Human
agggaggaaagaaggaaggaagcaaggaaggaaggaaggaaggaaggaaggaaggaaggaaggaaaccaaataggctgacagcttgatcttgaacttctagaccccagagctgttatttaagctactctgtctttgatattttgttatggcagccttagcaaattaatacaaggccatttcccttttcaaaattcatcattggcttcccatcatacttaaaatccaaaatccttaccatggcctatacaatgctcaacatratctcgttctcatttacctctccaaccttctttcccactactcttccttcattctgtttgctctaaacaaatgactttattgttgtttcctaaacactgccaacagactctcagtccagggcctttgtgcttgctgttctgttggccttaggggcccttgacccagataaagtatgtgcccgactgctctacctctttcaagtctttcatgaaatgtctccttttggcccggccgcagtggctcacacccgtaatcccagcacttcggaaggccaaggcgggcagatcacttgaggtcgg

SEQ ID NO: 170370 - DNA, 498 bp, Human
agggaggaaagaaggaaggaagcaaggaaggaaggaaggaaggaaggaaggaaggaaggaaggaaaccaaataggctgacagcttgatcttgaacttctagaccccagagctgttatttaagctactctgtctttgatattttgttatggcagccttagcaaattaatacaaggccatttcccttttcaaaattcatmattggcttcccatcatacttaaaatccaaaatccttaccatggcctatacaatgctcaacatgatctcgttctcatttacctctccaaccttctttcccactactcttccttcattctgtttgctctaaacaaatgactttattgttgtttcctaaacactgccaacagactctcagtccagggcctttgtgcttgctgttctgttggccttaggggcccttgacccagataaagtatgtgcccgactgctctacctctttcaagtctttcatgaaatgtctccttttggcccggccgca

SEQ ID NO: 170371 - DNA, 601 bp, Human
agggaaggggaactttacttggtctttgtaaggtgcattttttttccagcttaaatttttcataaacagaacagaaaaaatctaaaaatctactatcaaaataatcctatgcattctactttcaaaataaatcacaattctgataacttctcatcaactctacagctatttccttagagcatgttgtcatcgtgtctaatctcctcctaactctctgtttccattctaacctcaataccctggctatactcgcctccaccaccaccatcccccgacgccccaacacacctcaagtcaattmtcagcaggctaagtaaagcaaatgagccctgctatgggctgaaatgtgttccccccaaaatcctatgttgaatccttaaaccctactacctcaggatgtgattgtatttagagacagggcctttaaagaggtaattaagctaaacatcaggcctctaaagtaggtctgaatccaatctgaatggtatccttataaaatgaagaaatttggaaacacgatggtacaccagatatgtgtgcacacagagaaaagaccatgtgaggagataccaaggagaaggccaaccgcaagccagaaagg

SEQ ID NO: 170372 - DNA, 601 bp, Human
gaagcagtttgaggtagtcccaatatctgtatcagatatcaactcaggttgggggaaaaaaaaaaaaagccagggaaggggaactttacttggtctttgtaaggtgcattttttttccagcttaaatttttcataaacagaacagaaaaaatctaaaaatctactatcaaaataatcctatgcattctactttcaaaataaatcacaattctgataacttctcatcaactctacagctatttccttagagcatgttgtcatcgtgtctaatctcctcctaactctctgtttccattctaayctcaataccctggctatactcgcctccaccaccaccatcccccgacgccccaacacacctcaagtcaattctcagcaggctaagtaaagcaaatgagccctgctatgggctgaaatgtgttccccccaaaatcctatgttgaatccttaaaccctactacctcaggatgtgattgtatttagagacagggcctttaaagaggtaattaagctaaacatcaggcctctaaagtaggtctgaatccaatctgaatggtatccttataaaatgaagaaatttggaaacacgatggtacaccag

SEQ ID NO: 170373 - DNA, 601 bp, Human
cctttgcgttcccatataaagtgctaaatcaaactcaattatctaattatctatatagaagccacccatacaataactcttagagccctaggcccatgtaaagatttcacactagccccattcttttcttcttctttttccagtctcaccaaggataacatactcttatttctctaatccaggctaagaattctgcagctcctcatctaccagtatttgtttttaaaacatataatgtatacaaatacacataaattcaaatacctctgagtgttgattacctctgagagatatagctatrggtgatttttatatttttgttttctttatattccattagtttatataatgagcatttactacttttataattggaggaaaatgttttcaaaatgtaatcctgatacagaatagacctttactgaagaccaaaagataactatatacttcctttttgccattaaaaaataaagcttgagtttagaagttacccaaagaattcccaaattagaagaaaacagacatgactcgcacctgtttttcagtagttttttttctagcttctgctctctcttctaattcttccaattcattatcctca

SEQ ID NO: 170374 - DNA, 601 bp, Human
gtgctgggattacaggagtgagccaccgcgcccggccccgtgtaagttttatttaggtacattccaaattaaatgaaaagcttctattgttttgtttttatattaatcatgccttttgaatttctaggttttttttgtttcttgttttttttttttttttttttgagacagtcttgctctatcacccaagctggagtacagtggcacagcctcagctcactgcaacctctacctcccaggttcaaatgattctcttgcctcagattcccaagtagctgggactacaggtgtatgccaccaygcccaactaatttttgtatttttagtagagatggggtttcaccatgttggccaggctggtctcgaactcctgacttcaagtgatccacccacctcagcctcccagagtgctgggattacaggcgtgagccacctcacccagggaattcctgtatttctgatgtttggctgggggccttgctaaccctggaagggactgccctccccaggactggtcatttcctagaaaatggcaatcatctcctgatccgttggccttaacatagctcaacaatagtgacatctacagtttaaaagtttt

SEQ ID NO: 170375 - DNA, 601 bp, Human
ctactgctgttacaacttaatctcttcaattaaatttaaggagattaaaatttaagcacaaacatatgcagattaatggctactataaaaattcacaaagtaagaagtataccctcaaatactttagaaaaccagaccattaaaaaaagagtaatttaaaataaatatttgtaaaataaaaataaatatttgtaactatataacatccacatagagtttttttgtttgtttgtttgtttttgagctggagtctcgctccgtcacccaggttggagtgcaatggcgtgatctcggctcactrcaacctccgcctcttggattcaagtgattctcctgcctcagcctccagagcagctggaactctaggtgtgcgccaccatgcccggctaatttttgtgtttttgtagagatggagtttcaccatgttggccaggctggtctcgaactcctgacctcaggtgatccacctgccttggcttcccaaagtgctgggattacaggagtgagccaccgcgcccggccccgtgtaagttttatttaggtacattccaaattaaatgaaaagcttctattgttttgtttttatattaatcatgccttt

SEQ ID NO: 170376 - DNA, 601 bp, Human
taatgagtcaacagagaatacataattaataaaattaataaaacccaaaaggtgttgacttttattttaatctttaatacaaagactatatataatagaacaagagtcaaagtgtatttaacagtttaacagcttttttctccaaataaagttttgtttgagacagggtctcaaacaaactctgtcacccaggctggagtgcagtggtgtgactgtagctcactacagcctcgaattcctggacccaagcaatccttccacctcagcctcctgagtaccaaggactacaggcactcaccawcatgcttggctaattttttatttacttatttttgtagagacaggttcttactattttgcccaagctggtctcaaactcctggctttaagcgagccttctacctcagcctcccaaagtacttgagttacaggcatgagtcaccatgactggtccaagtaaagtattgtgacaattctactgtacaagaacactctatttacatttgcaaagtgccattagatcattaaaattaaagtatatttagagttagttacctatcaagagcttccttgaagtacttcctctggacatcaaactgaa

SEQ ID NO: 170377 - DNA, 601 bp, Human
tgaaattacacgcacatgctaccaagcccagctaatttttgtgtttttagtagagacagggtttcaccgtgttggccaggctggtctcgaactcctggcctcaagttatccgcccacctcggccccccaaagtgttgggattacaggtgtgagccaccacaccaggccaatttttaaaaaaaatattagatctctatcatgtttaaaaaaaattttttttggtcatttatcttttgattttatggtaatttttgctataaaggaactgcattaattcatttaacaaatctgagtatctacyaaattattgatttgcagatgtatcaacaaaaaatagataaaaattcctgctctgaaggagcttacattatactagacaaacgtgaggtttcttttttcttttacatttcaatcttgcatatatctagaattaggtataacttttttctacttttctacttttttccggggtagactttggtctgcaaccctgtaatctcaaacttctactattgtactgacaaactttctggaaaacaattttgcaatgaatttcaaaagcttaaagaaaaaaaaagtcttaaaaatatatttgcaaata

SEQ ID NO: 170378 - DNA, 601 bp, Human
tttccagatcaaattaatctcttaagaaaagagataatttctttttattttatcttttttattttattttgtttttgagacagagtcccactctgtcactcaggctggagtgctatggcatgatctcagctcactgcaacctccgcctcctaggttcaagcaattctcctgtctcagcctcccaagtagctgaaattacacgcacatgctaccaagcccagctaatttttgtgtttttagtagagacagggtttcaccgtgttggccaggctggtctcgaactcctggcctcaagttatcygcccacctcggccccccaaagtgttgggattacaggtgtgagccaccacaccaggccaatttttaaaaaaaatattagatctctatcatgtttaaaaaaaattttttttggtcatttatcttttgattttatggtaatttttgctataaaggaactgcattaattcatttaacaaatctgagtatctaccaaattattgatttgcagatgtatcaacaaaaaatagataaaaattcctgctctgaaggagcttacattatactagacaaacgtgaggtttcttttttcttttacatttca

SEQ ID NO: 170379 - DNA, 601 bp, Human
ggtattgctgatcctgtctaaatttataggaaagatcatctcaggcatcatttgcattgccttcattgatttatctttcttttttttttttttgagacagggtctcggtccatcacccaggctggagtacagtggtgcgatctcagctcactgcaacctccgtctcccaggttcaagcaattctcgtgcctcagcctcccaagcagctgggattacaggcctgcgccaccacacccagctaatttttgtatttttagtagagatggggtttcaccatgttggccaggctggtctcgaattyctgggctcaagtgatccacacaccttggcctcccaaagtgctggaattataggcatgaggctgcagtcagccgagatcacatcactgcactccagcctgggcaacagagtgagactgtctccaaaaaaaaaataaataaatagtggcatatgcttccaatttataggaatatgtccaaaggatttttccagatcaaattaatctcttaagaaaagagataatttctttttattttatcttttttattttattttgtttttgagacagagtcccactctgtcactcaggctggagtgctat

SEQ ID NO: 170380 - DNA, 601 bp, Human
ctttcttattgggtggctttctttttaaataaaaataaatgtgtaaggtgatattcttagatgctgaagcagtccttgtacaaaacatatttagaacaactctttaaaaggaaacaaaacaaatttcttaactacattttataccaaatttcatcatctctgagatggccagaatgtattcatatcatacataccatttgcctatcctttttcccaataaaatcagttatttttccttctttgtatatggacaaagctaaatataaagttgtaaaaattcaacttgtcttctgcttaagawttcttcacacatacaaagacctgtttggattctgtaaaacttaagagctgagaactctgtaacaagagtaaagatgcagttttcttcaaagttgtatggttaaagtctcctctgaaggtattgctgatcctgtctaaatttataggaaagatcatctcaggcatcatttgcattgccttcattgatttatctttcttttttttttttttgagacagggtctcggtccatcacccaggctggagtacagtggtgcgatctcagctcactgcaacctccgtctcccaggttcaagcaattct

SEQ ID NO: 170381 - DNA, 601 bp, Human
tttttaattatataaactgtgatgtatcaaattacatatacaaattaccacttatataaatacataatagcaatgcaattaaattgttaaaaattattcaaagattggtgtattggtgtttttccagcaaaatagaatgatttaaaaaattaatttcctaaaatgtttagtaaacttttttttttttttttttggatatagtgtctcactctatcactcaggctagaatgcagtggcacaatcactgctcactgcggcctcaaactgccgggttcaagcaatcctcctgcctcaacctccraagtagctgagactagagatgtgcactaccatttttttttaaatctttaaattttttatagagacagggtctccctatattgctcaggcttctttaaaaaacttttaacttttgcttgcaataaggtaacttttaacttaactacctgctagatatattggggcattttttttcttttcagtacttggtatgattaatgatgggttggataatttctgttgacttaaataatgaaactaattttatttaattctgtcacccagactggagtgtgtagtggcacatcacggctcactggag

SEQ ID NO: 170382 - DNA, 601 bp, Human
ccaccatccttttcatttacttcaaatctacactgaattagatgtttaatgacttcaggaacaaacataacacatatttcaatttagtcctttaaaatataaagataaaatggtctagagataaagaaggataaatgtaataagtaactggtttcatgaaggaaaaaactgtagttacacataaagtactcctcttaccactatcaacagcttcaacttcacggtcaattgcatctctgatcattagtgggtggatgaagaactgcgcccatctgaacaaaaaacaaaactggcatttccrtttttgttcactttcatcaatcaacatctattattttaattaagaaacttactaagttggagatttaattcacaatcctaagtatataaaatctaaataatctgcatttctatattttaaactaatatctacatgttactttaactttttcattgtgaaatatatttaataacaatcatacagaaaagttaacaaaacatgaacatataaactacacctgagtggcccacccaggtgaagaaacagaccatagtcaacactctagaagcacccagctcctacccttacctcaagaaatat

SEQ ID NO: 170383 - DNA, 601 bp, Human
taatatagcagacatgtaaacatatctacgaaaagtgatttaagaccccttgcaactgataaaaatagagtataaatatctgaacacttagagaccatatttggaaaggaaacaaacattaaaaatgaagaagtaagtaaataaaaatagagactgcactttgacacataattaagatttaaaaaggcattggacatgcctttcatctcaatcactaagacatactatgcaggcaattatatatgtttatgtgagtataaaccatcattaaaataaaaagtcaattattaaaaataatttmtcagccgggcgcagtggctcacacctgtaatcccagcactctgggaggccgaagcaggcagatcatgaacaaaagcacaacagaatttttactttagttcagcataaaccaaaactccatactgtgtgtgtatatacatatatatttctttcagcataatttttcaaagcataataaaatatattctggcttaaaattgtaaaatctaattaaaggtctgcttgtttaaacactggtgtcaacccactctagaaactgtataaagaaaaacatactagaaagcatttaagacacagataa

SEQ ID NO: 170384 - DNA, 601 bp, Human
atgatcaaatgaaataattcatgtagtgttagcacagtatctggcacttaaaaagcattcacaaaatgttaggtgttactcttgctatattcactgttagagaaccaaatagaggcatatttaacaacttcgcgtttgaaaggctaactagctatcctaaaaggtaaaaggtacctagggactctagctttataattttcaattctttatcaacttttcttattctaaatcttaactagaaaatatgaaataagatgatgtatttagtatcttaccccaaaaaaattttcccataggatgkccaggtctagcaaggcttccaaacaacatttcctttctgtttgcatcagaaggccttgcaagttgatattctgtcaattttaaataaacacataataaaacaaaattcagtatctcctttattatatggaaattcaaacttacagaacagaaagcaaggaattaacaaaattaacttcatgaatcacgtgttataagactgaagtgggaaactcaatgatccaggcctggctctatgacttaatatgacctgtaattttgggtaaatcaattcagcttaccagagtcttactcttatttt

SEQ ID NO: 170385 - DNA, 601 bp, Human
attttcccttaaactcttacctgtaatgttgctgttgaggaggaagtgcccatgtgatggtcagagcatgaatttttctgattggaacaactaaacaaaaatattttccagaagaacagatgtaagtgtttctctatgacttttactacaagaatgtttaaaattcaatatatttatcctccaataaacaaggaaaggttaagtacaatgcagttattgtttcaacttgccaattttccaactcgaataatgcaatttttgtaaatttcttttttatttggtttcagaggtagagaaagcmgggataaaagaactatgaggatatgaaatgctgctgtgtatggatctcttcttgcaagaaaggatacaaaactaggagtcaggagacccatggctgaaattcagtcctaccactatcttgctatatgtgcttacatgacctgagaaaatcacttgcatttaaatctttttgaatctgtttactcatagtaaaatgagtgagttgggttaaagtatctctaggattcttctcaatgctattattctatgaagaggaaacctaaaaccagaaagaatacaataaaaagtaagttgtctctgg

SEQ ID NO: 170386 - DNA, 601 bp, Human
aaatatagaggctttctatgtaaaatgtggaaatctcagcctttgaatgtaaacatatactttccaacagtaaatctaaaagtgcaaattttaaaagcacaaagcctcccaaggaattgtggtacatttaggaatcaccagaaggaaataacagtctttgtttaatgcaaatacgaatagatatggcaccataataaaacattaacagttttattaagccaaaaccattccttttgaagagaacagcacaaaatattcaaatgatggctgctggaaagcattttgcttaccttttcttttyttttttttttttttttaataaagacagggtcttacaatgttgcccagtctggtctcgaactcctgggctcaagcaatcctccacctcggcctcccaagtgctggaattacaggcgtgagccaccgcgcctggcctcaccatttttgaacctgtctcctaggagaagccttaagacacttctaaaacatacttacattgaatgtcaagtgagttctttgaggctgtcagctaacctacataggttgtctaagaaagaaataatgagactatacctttccctgactagattaattctgaaaa

SEQ ID NO: 170387 - DNA, 601 bp, Human
gtaatgaaattcattatcctcaattttccgaatctcttcaaaaattctgtgaaggagaaaactataattagaagatacattaaaatttctgcctacttgagggagaagggcgggaggagggagaggatcagaaaaggtaactattgggtagtaggcttagtacctgggtgacaaaataatctgtacaacaaaccaccgtgacacaagtttacctacataacaaacctgcacatatacccctgaacctagaataaaagtttaaaaaattctcaatagaagcatcaacaataaaagagaagcrtgaaaataaagggactgcccacatatgtgtaaagccttagtatacaatcacatgtagagggataaggatatggagtcaataaaggaaatagagcagaaaatgcctgaaaaaccatcaaggcaagactaaagcatgtctaccggcagcctgaagcctcaaatataccaggactggctcctggcctcattccaggaagtgtttattaccttttttctgggcctagcttctgcagcatttttaaatactgaaagacagtgtaagcaacctgaaaacaaaacatccaattagtcttttgcataa

SEQ ID NO: 170388 - DNA, 601 bp, Human
tataaattaccttatagaatgtcttcacaatatttgaattcccaaaatattaaataccataacaagtctccatgaatgtttattgaagggatagatggatgactatgtagataaatgattaccacacaacatcatctgtgtcatctgcttaatcctctcactgccttatcttactcaatataaatactcaaaaacccaatagttaattttcagatagcttcaaggccacctggagactcacatgacacagaatgacagaattaaaactccaccgacactttcaaaaagaggaacaatgtckacaccagcttcaactcagtcacagataacatgcaaaaagaatttgacttccagtacctgttcttggtaatgaaattcattatcctcaattttccgaatctcttcaaaaattctgtgaaggagaaaactataattagaagatacattaaaatttctgcctacttgagggagaagggcgggaggagggagaggatcagaaaaggtaactattgggtagtaggcttagtacctgggtgacaaaataatctgtacaacaaaccaccgtgacacaagtttacctacataacaaacctgcacatat

SEQ ID NO: 170389 - DNA, 601 bp, Human
atgctaccaaggactatgctcctaacagctatgttttgtatcacttcatatccaggaatcagtaaaacactgccaagatagggcctccttcagtaatcctccagctacaataaggactaaacagaattttgtggcttggtttggagccctaactactacttaaacaccatttatttaagtataaaacaacaaatggtggttcagaaaaaaacacaaccagccactaccaggcacaaccatcctagtgacatggcaagaatgtgtggttgttccttcctcctttacctttccctgtcctctktaaaattaatagtttaggaacgtctatgctaaaatatctcaaggaatgccctataatttcttaatctcagcactatgaacatcttgtgtcaaataactatggtaggatcctgccttctgcattataggacattgagcagcatccctggcttccacccactggatcccaggagcaccccacgccccaccctgagttgtgacaaccaaaatgtctccggacagtgataaatatcccctggaaggcaaaagtcacctctggttgacgcgcgctagcctgtatgaaacaaaatgacttattctc

SEQ ID NO: 170390 - DNA, 601 bp, Human
taatgccaacctcagaatgttactgggaatctcaaatataaattcctacgatactttgtaaaatataatgtgctatacaggtgcctattagcacatggatggattatgtataaaaattgctattttactgacctatgtacttgttttcagctggaagatgaagatctggatttaattcgaaattactattccacagttcagcccaagagttttcaatatctgtaaaggagaaaaataaactgacccaataaacaatgcaatgttcaacattctcttaataataaactagttatcaactggyttacaaatcaattatcctttctcaggaatactgtgactgacacatatccaggcattctagaatcgtgctactcaaagtgtggtcctagcagcactggcatcacctgggagattgtcagaaatgcagaatctggccaggcacggtggctcacacctgtaagctcaacacgttgggaggctgaggtgggtggatcacctaagatcaggagttcaagaccagactgaccaacatggtgaaaccccagacagatttctactaaaaatacaaaattagccgggcatggtggcatatgcctgtaat

SEQ ID NO: 170391 - DNA, 601 bp, Human
aatacttttttaaaaggctttttttccctaatgaaagggagattcacataacataaacttagctattttaaagtgaacaattcagaagcattaatacattcacgatgttgtgcaactaccacttctagctagttccaaatcattttcatcaccccaaaaggaaaccccctactccttaagagactgctcctcattacccactcacctcagcccctagcaatcatcaatctatgttctgtctctggatttatctattctgaatatttcgtatacatggacttatctgtgaccttttgtgtckagcttctttcacttagcatgatgtttgcaaggttcttccccattatagtatgtatcagtactacactttttatgagtaatattgtaaagtatgtatacatcacaatttgtttatacattcatccactgatggacatttgggctgtttccatcttttgagtattgtgaacagtgctctgtgaacatgaaggtccatgtatttgtttgagtacctgttttcaattattttgggtatatacttagacatgtaatgaatggcttggaaatacagtgttctgagtaaattacagttataagcaac

SEQ ID NO: 170392 - DNA, 601 bp, Human
tcctacgttcagacacatttcccaagtatctcctaggttcagacacatttcccaagtatccgctacgttcagacacatttcccaagtatctcctacgttcagatacatttcccaagtatctcctacgttcagacacatttcccaagtatctgctatgttcagacacatttcccaagtatctcctacgttcagatacatttcccaagtatctcctacgttcagacacatttcccaagtatctgctatgttcagacacatttcccaagtatctcctaggttcagacacatttcccaagtatcygctacgttcagacacatttcccaagtatctcctacgttcagatacatttcccaaatatctcctatgttcagatacatttcccaagtatctcctaggttcagacacatttcccaagtatctcctaagttcagatacatttcccaagtatctgctacattcagacacatttcccaagtatctcctaggttcagacacatttcccaagtatctcctacgttcagacacatttcccaagtatctcctatgttcagacacatttcccaagtatctcctaggttcagacacatttccgaagtatca

SEQ ID NO: 170393 - DNA, 601 bp, Human
gaagggaaacaagacacacatacttgaaacaatgaggagcataagatgaggaagtaagggcacaagcatttgagttctactctatttcaggcaaaacaccagtcaaatttgttattccacagccggcatggtggctcacgcctataatcccagcactttcagaggctgaggcaggcagatcacttgaggtcaggagttcgagatcagcctggccaacacggagaaaccccatctctactaaaaatacaaaaattagctgggtgtggtggtgcgtgcctgtagtcccagctactcagcaggmtgaggcatgagaactgattgaacccgggaggcggaggttgcagtgaaccaagatcacaccactgcattccagtctgggtgatggagtgagtatctgtctcaaaaaaaaaaaaaaaaggttattcctgtatggtaaaaaatttagctagaaccaatcctaaatgccagtgttggttgtggagaaactgacagcaaagggaagtgaaatcaatcctaaagcatgggctataatcccatgcactgccagtaattaatgaaacatatgttgttcttatggatagtcagtcacagttagaatagc

SEQ ID NO: 170394 - DNA, 601 bp, Human
aaaatattttttccaaaaaagtttttattttttcatcttactctaatagccagaacctctaaaacaataacagaataatagagatgattgtggattattcttggcttgttgctgatgtcagtgttcatcattttatcagttaatgtaatgtccgctgatagttctttacttgaggttttttgattttttttttgagatggagtcttcgctctattgcccaggctggaatgcagtggcgcgatctcggctcacttcaagctccgcctcccagggtcacaccattctcctgcctcagcctccmgagtagctgagactacaggcgcctgccaccacgcctggcaaattttttgtatctttagtagagacggggtttcactgtgttagccaggatgatctcgatctcctgacctcgtgatccgcccgcctcagcctctcaaagcactgggattacaggcgtgagccaccgcgccaggctgaggtttttatacttaattaatttccttccattcctatgtattaggaatgccaactcaaatttatcaaatgatttatcagcatttatcactatattcatacagtggctctcctttgacttgtgttg

SEQ ID NO: 170395 - DNA, 601 bp, Human
tctaagtgattactggtactatgggggagaaaaagccattgattctgatatactagtcttttgaccagccatatcacacctaattttttttttaattttagtggtatatgaggttttctaagaatacaatcatatcatctgcaaggaaaaatattttttccaaaaaagtttttattttttcatcttactctaatagccagaacctctaaaacaataacagaataatagagatgattgtggattattcttggcttgttgctgatgtcagtgttcatcattttatcagttaatgtaatgtccrctgatagttctttacttgaggttttttgattttttttttgagatggagtcttcgctctattgcccaggctggaatgcagtggcgcgatctcggctcacttcaagctccgcctcccagggtcacaccattctcctgcctcagcctcccgagtagctgagactacaggcgcctgccaccacgcctggcaaattttttgtatctttagtagagacggggtttcactgtgttagccaggatgatctcgatctcctgacctcgtgatccgcccgcctcagcctctcaaagcactgggattacagg

SEQ ID NO: 170396 - DNA, 601 bp, Human
ttctcctgcctcatactccggaggagttgggaccaccggcacatcccactgtgcctggcttccatttctaagtgattactggtactatgggggagaaaaagccattgattctgatatactagtcttttgaccagccatatcacacctaattttttttttaattttagtggtatatgaggttttctaagaatacaatcatatcatctgcaaggaaaaatattttttccaaaaaagtttttattttttcatcttactctaatagccagaacctctaaaacaataacagaataatagagatgaytgtggattattcttggcttgttgctgatgtcagtgttcatcattttatcagttaatgtaatgtccgctgatagttctttacttgaggttttttgattttttttttgagatggagtcttcgctctattgcccaggctggaatgcagtggcgcgatctcggctcacttcaagctccgcctcccagggtcacaccattctcctgcctcagcctcccgagtagctgagactacaggcgcctgccaccacgcctggcaaattttttgtatctttagtagagacggggtttcactgtgttagccag

SEQ ID NO: 170397 - DNA, 601 bp, Human
tacataagctgggtttagaaataccgtaacgctatgcacgggtctcctaaactagagcacgattcaaacacggatgaaaattagcactgcaactatagccttaacccccacacccacccactagggagagtaatactttcaggtcctcaaaatataagctcatctcatttatacccacttggccaaagtctcgggcttgatgaggatgttaaagtaggtcttcttcaactgctcagttatcattgtaaagacagctggtgtggaattgaactcagctaagtagtcaataatgagctgaaayagtagctaaaagaaaaagaaggaagcattttaagaagcatggaaatccactaggtattagggagggaaatgtttctctttggtttttaccaggtacccagcatggaactaggcattgtggggggacataagaaaattactaacaactcaatttgttcgtttgtttgtttgggtgttacctggagacaggatatcactggtcacccaggctggagtgcagtggtactatcgactgtaattcattataacctcgaatgcctaggctctagccatactcccacctcagcctcctgagtagctg

SEQ ID NO: 170398 - DNA, 601 bp, Human
gcctaaaactagcacttctttaacattcaggtataatgattggtgaaaacacccttccttacttttagtctctacagtaagctgctttcagtcccattcacagctagctacataagctgggtttagaaataccgtaacgctatgcacgggtctcctaaactagagcacgattcaaacacggatgaaaattagcactgcaactatagccttaacccccacacccacccactagggagagtaatactttcaggtcctcaaaatataagctcatctcatttatacccacttggccaaagtctcrggcttgatgaggatgttaaagtaggtcttcttcaactgctcagttatcattgtaaagacagctggtgtggaattgaactcagctaagtagtcaataatgagctgaaacagtagctaaaagaaaaagaaggaagcattttaagaagcatggaaatccactaggtattagggagggaaatgtttctctttggtttttaccaggtacccagcatggaactaggcattgtggggggacataagaaaattactaacaactcaatttgttcgtttgtttgtttgggtgttacctggagacaggata

SEQ ID NO: 170399 - DNA, 601 bp, Human
cagggtctatctctgtcatgcaggttggtgtgcggtggcatgatcatggttcactgcagcctcaacctcctgggctcaagcaatcctcccacctcagtctgccaagtagctgggactacaggcatgtgccaccacacccagctaattttttaattttttgtagagatgaagtcttgctatattgcccaggctagtcttgaacttctaggcttgtgatcctcccacctcagcttctcaaagtgctgggattacagatataagctaccatgcccggcctaaaactagcacttctttaacattyaggtataatgattggtgaaaacacccttccttacttttagtctctacagtaagctgctttcagtcccattcacagctagctacataagctgggtttagaaataccgtaacgctatgcacgggtctcctaaactagagcacgattcaaacacggatgaaaattagcactgcaactatagccttaacccccacacccacccactagggagagtaatactttcaggtcctcaaaatataagctcatctcatttatacccacttggccaaagtctcgggcttgatgaggatgttaaagtaggtc

SEQ ID NO: 170400 - DNA, 601 bp, Human
gatagagagaaaggggaggatagcagccacaatttcaagagtggccatttatatattccaatcaaagggccagccctgagaaactgggaaggcatggaggaggatggttaataacaaaacagttcagggagagaatcttgaacaagcatctgactgaggaaaaggccttagtcaggtacaaggccccacagacatttccaactaaatacgtatcagaacaaactcctcatatgctcccactcttactactgttcctgttccaccaacccactgcttcaagaaagaaatctgggcatcattytagactgccttctctctcactcccactgagtgaatttccatcatcttctatttcttaagcacttctttaaacaaacaaaaaaaaacaccagggtcttgctttattgcccaggctggagggcagtggcatgacctcagctcactgcagcctccacttcctgggctcaagcaatcctcccacctcagcccccaagtagctgagattacaggtgtgcattgctacacccagctaattttttttaatttttttggaagtggtgtctcactatgttgcccaggctggtctcaaactactgagctc

SEQ ID NO: 170401 - DNA, 601 bp, Human
aactgttgttataccatttatatactaggatttttaaaattaagtccctacttaagggcttttttattactttaaaaaaaaaaaagaatctgacaacatagtgagtgagtccctgtctctacaaaaaaattttaaaaattagctgggcatggcgatgcacacttgtagtcccagctactcaggaggctgaaatgggaggatcccttgagcccacaaggttgaggatgcagtgagcctgatcatgccactgtactccaacatgggtgacagagtgtgatcctgtctcaaaacaaaacaaaamaaaaaaaaaattcttgctaaactaaagcaagaaaaccagtataaagctgaattgctaaaagactattttaaatattcaaatcctatctcagtaaaataaaacctttatcatcaatagcactaactttgaacacacaattgtatcatccaagatattatcaaaggcactagagattcagaggcaaaaaccatggcttatatcctcaagaggcttactacttaagacaatggcatatgccgaaaaaaaagaacaaaaaatgtaagggagcgttggataggccaagcatctagtacatagaga

SEQ ID NO: 170402 - DNA, 601 bp, Human
tctacgcatgcttaactgggttagatcatttgtctaaataaaaaaagttcactttactgtaatacagcattcaatttacaagattcctcagattattaaaaacacctaataaatataattaatgaaggcataccttgttgattcaactgctttaaaaatgaaactccagcatatgaatttgcctaatgaactctgcctggagtaacttttcgtttattatttctaccagttctccaactaaccagatctctctcaggccatttacttggttttggtttccagagtactgattttttttttaaaaacttttattttaggttcaagggtacatgtgaaggtttattacatcagtggacttgtgtcataggtattaagcccagtacccaatagttatcttttctgctcccaattttattaagccccaaactcacaaacaagtatataaagtgctttttgtaattccctaaagaacaagtaaaatatcttagattaggcctttaaaatcacactattagagattgcagagattctgaactatgattcgttgctaatgatactcaatctttttctattacacgttagtctgttactagcattctgt

SEQ ID NO: 170403 - DNA, 601 bp, Human
acaacatgcttaagaggtctcaataatacccaagaagtctcagtagtttatttctaatatgcaaatgagtgcacttaagaggttaagtaatttgcccaagatcacagaactactcaggggcagaacaggtgtgctcttgcagttatattagtctgcctctgctcctgaagtttaaaaatctagattttgcagaagctctaagagaaaagactgacaaattaaacatataaaacaaatatttctacataatcaaaaaatgccaaaaacaaaaaaaaattcagagaaaaaaattttgcaaagrattttgcaaagaagggcaaatttcctaaatataagaagagttcttacaaatcagtgagaaagaagacaaacagcccatcaagagaacaggtaaaagactaaagcagtttataaaaaaagaaatacaaatggtttcaaaggaaaaaaaaataagttcagccttacccataaagaaataacaaactaaaacaatgaaattgtttgaaatctttctgattactggactgacaataatatacatgttgatcaagctgtggaggaaatgacactctcaaacatgtgtgctgctacagtgtttctg

SEQ ID NO: 170404 - DNA, 601 bp, Human
agatgtcacaaatggcagagctacaattcaatccaggtttgtcttgtactatatccagtgttcttcccactacgtaaaacttctctcagtgtccctgggatgagaatcttgacactctgttaaaatatatatataaaatattttacctactgttttggagtagatcacagatcttttgaagtctatccttgagtccccttcctatgctctatggtcaaagttaaaaattcttcctttattacaaaaaaaagataaaacaaggaatctcataagaaaattgatgttatatcccacaatatgractctatgcaccaaaatacaatttaacttgaatcaaatgttcctatagatttatgttatcctttcaagtacagtttaaatatcctctacagtaacaaccctggatcctataaaaccattaaataattaaaaactatattaccaccaaaagtttcatcataatcacagtattctctcatggcacccccttgccttacttctatcatcctttatcacagtacttgtcacacaagaaagtcagtgtttatctccctaaaaaaccaaaagctacttcagagcaaatgtcatggtcttattctgt

SEQ ID NO: 170405 - DNA, 601 bp, Human
atcagagaaatgaaaatcgaaaacacaatgagatactaaaaaaagtaagccaaaatcaaagaatcagctaataacaattactggagaggatgtggagaaatcctcatcccggtacactgctggtacaaatataaatggtgcagctgctctaaaacagtcagcagccgagcgtggtggctcacacctataatcccagtgctttgggcggccgaagcgggtggatcacttgaggccaagagtttgagaccagcccagacaacatggtaaaaccctgtctctactaaaaatacaaaaattagcygggtgtggtggtatatacctgtagtcccagctactcgggagggtgaggcaggagaatcgcttaaccgaggaggcagaggttgcagtgagccatgattgcgccactgcactccagcctgggtgaaagagtgagactgtgtctcaaaaaaaaaaaaatctgcagctcttcaaatgattaaacacagaatttccacatgaccagatatgtgcccaggagaagtgaaaacatatatttacacaaaaccttgtatatgaatgcttataaaagcattattcataacagccaaaaggtggaaaccac

SEQ ID NO: 170406 - DNA, 601 bp, Human
tttttaaaagaaaatctgtaggtcgggtgcagtggctcacgtctgtaatcccagcactttgggaggctgaggtgggaggatcacgaggtcaggagtttcagaaccagcctggccaacatggtgaaaccccatctctactaaaaacacaaatattagcagggcatggtggcacacacctgtaatcccagctacttgggaggctgagggaggagaatcacttgaacccgggaggtggaggctgaagtgagccaagatcgagccactgcactccagcctgggcaacaagagtaaaactccatckcaaaaaaaaaaaataaagaaagaaaattgacaatctctctggggtgtttcctcatatattaaaaaacacaaaagaaagaaaaaacgtactataaatagtctttgtgaaaattacatgttccataaatgtaaaaccttgtattggctgggtgtggtggctcacgcctgtaatcccagcactttgagagcccgaggcgggcagatcacctgagttcaggagtgggagaccagcctggccaacatggggaaacccgtctccactaaaaatacaaaaaattagccaggcatggtggcaggcccc

SEQ ID NO: 170407 - DNA, 601 bp, Human
tttgcccaattgtaggctaatgtaagtgttctaagcacatttagggtaggctagactaagctatgatgtttggtaagttaggcatgttgaatgcatttctgacatatgatattttccacttactatgggtttatcaggatgcaaccctattgtaagttgagaagcatctgtatttatttccagatttttttcatctttgtactcattatacaaaagcttctcactcctctctcccccagtcacctggtaaatacatttctatttctgtctttatgaatttgcctgttttgaataccttatygccacagtttgaatgtttgtgtccccaaaatattcatgttgaaacttaatctccaatgcaatagtattaagaggtggggccattaaggggtgataaagtcataagggctcctcccttgtgaatgcaatttaggtacgtatcaaagagtcctcccagcacttgcctttttttgcccttccttctcttctgccatgtgaggcacagcattcatcccttttacgcccttctaccatatgaggatgcagcaagaagcattatcttggaaggacaaagcagtccacatcagacactgaatctgct

SEQ ID NO: 170408 - DNA, 601 bp, Human
aaacacccacatacccatatatttcaaatggttcataaattttcattgatgatatgatcttaggtacggtgctcagtggtatcaatgttgtataaccatcaccagttggtccccaatttacaatggttcaacttaacaattttttaactttacaacagtacaaaagcagtaagcattcagtagaaaccatacttcgagtacccatacaaccattgtttttcactttcagtattcaataaattatatgagatgttcaaaattttattataaaacatgctttgtattagatgattttgcccaattgtaggctaatgtaagtgttctaagcacatttagggtaggctagactaagctatgatgtttggtaagttaggcatgttgaatgcatttctgacatatgatattttccacttactatgggtttatcaggatgcaaccctattgtaagttgagaagcatctgtatttatttccagatttttttcatctttgtactcattatacaaaagcttctcactcctctctcccccagtcacctggtaaatacatttctatttctgtctttatgaatttgcctgttttgaataccttattgccacagt

SEQ ID NO: 170409 - DNA, 601 bp, Human
acatggtgaaacaccatctctactaaaaatacaaaaattcgctgggcatggtggtgcgcgcctgtagtcccagctacttgggaggctgagacaggagaatcgcttgaacgcaggaggcagaggttgcagtgaggcgagattgtgccactgcactccagcctggcgacagagcaagaccccgtctcaaaaaaaaaaaaaaaactagtgtgtattgtgaagtataaaggtgatagattcaaataatgacatacagattcataattaggaaaaaaaacttaaaccccccttttccaactagtcrataagataacaatgtcacttctctatatttggattttatgcttttatcctcaaaaaattctgcctgaccattgataaattcacttatccaactcataaaaggtacaatggaacaaagagacctaaagaaacacccacatacccatatatttcaaatggttcataaattttcattgatgatatgatcttaggtacggtgctcagtggtatcaatgttgtataaccatcaccagttggtccccaatttacaatggttcaacttaacaattttttaactttacaacagtacaaaagcagtaag

SEQ ID NO: 170410 - DNA, 601 bp, Human
catccacagcctggcttcttacttccttgatctctttaacttcaagaacctctccaaaacacaggatcaacagtgaacacatatattatgtcccagtcaccctccttgtcccatagtaaaatccttccttgcccttctatcttcaaccaaaagtgctccacctccttaatcactatttcaagcaccttgtcctccaaccacaacctcttcttccagattataatcctttgacctctataaaacctcttatccatgggcccaatagactttgatccctcaggccctctctattttactttcycttccaccttattcagtttagattctacaattcatcatttcaataattctcctgccaataacctaaattcccttgctcctcttgtcttatgacaccaatatagcaaaatcccaaacctgaatgaaaccatctaaaaacttttctttgatgctgcagctgagaaagtcactcaacaaggtagaccactattataaattcatgatcactgtatcagttcacaagggccataacaaagtaccataaactagatggctcagaacagaaacttactgtctcacaatctggaagccagaaggcatt

SEQ ID NO: 170411 - DNA, 601 bp, Human
ctataagtgctttcaccacataaacaagtgatgaaatctggaagagaactagtgataattccatctttcttgttctgattctttacagattcaacaaaacaacttctttgcaaggggagtgcatagacttactgaaaagtatcctcagacttaagcaaccatgggcaattaactctgtatggtcttgcaaaatattaggagaaatatttgacactggtgctcctgttggttacctggtatgccaggcagtgcagtggcatgtacagtgaccacaagacacactaggccaccagctggctaygtcagtgggaaattgcaggttgggtgcaaatgaagtatgtgcaaagtcaatagtatgaaaactcttagatggttttgtcatttattgtattgtacaagtctacaactgtttatttattttgttgtttggtaaccattttattatttcataagccttttcaggagcaatgagctataaagacatcactgtatccaataaaaactaagctctaaattttcatttctccagaaaatagatgggcagacaatttgcagagaaccactgaggcagtttctatttatcatggagctctagtgacat

SEQ ID NO: 170412 - DNA, 601 bp, Human
gtacctgcccattagtcacttagtagccgactcagttatcaggctgacagatcacaaaaaggatgagtataatacaataagatatgttgagagagagagaaaccacattcacataaattttattacagcatattgttataattgtactatttcactattagttttgttgttaatcttactgtgcctaatttataaattaaactttatcacaggtatgacatacacacagatatatatattcgaactcaagactgcaagtgtgtgtgtgtgtgtgtgtgtgtgtgtgtgtgtgtgtgtgtggctcatactggttcagtttttctggagaaccctaatacatccagtctcagagaggttacctctccaggcctttaaaaggcagagtcagccaggcacggtggcatgtgcctgtaatcccagcactttgggaggccaaggtgggcggatcacgaggtcaggagatcaagaccatcttggccaacatggtgaaagcccgtctctacaaaaatacaaaaaattagctggacagggtggtgcatgcctataatcccagctacgtggaaggctgaggcaggggaattgcttgaacccgggaggtgga

SEQ ID NO: 170413 - DNA, 601 bp, Human
acacagagatagcagtatgcacaaaggcatgcgatcaacagaaaactcagttatgtctaaaaagaacagcaagaagttctgaacgataagagggatagggagataagattataaaattttgtagaagacaacttatgaagggtttcatctgccattgtagagtaaaaaaaaatgaagtcgcccaggctggagtacagtggcgtggcacgatctaggctcactgcaacctccgcctcccaggttcaagtgattctcctgcctcagcctcccaagtagcagcattacaggcgtgcaccaccaygcctggctaatttttgtatttttagtagagatggggtttcgccatgttgtctaggctggtctcgaactcctgatctcaagtgatccacccgttgtggcttcccaaagtgctgggattacaagcatgagccaccacacccggccttaggaagtaattttaatggtctggttgaggggctgaacattgacaatggcagaagagaagggtatggcttgaaaaaaagtttgtaacatagatttgacaggacttattaagtgggtgagggggaaggaaagcataattttaaaaatacataaaatg

SEQ ID NO: 170414 - DNA, 601 bp, Human; identical to SEQ ID NO: 23798

SEQ ID NO: 170415 - DNA, 601 bp, Human; identical to SEQ ID NO: 23799

SEQ ID NO: 170416 - DNA, 601 bp, Human; identical to SEQ ID NO: 23800

SEQ ID NO: 170417 - DNA, 601 bp, Human; identical to SEQ ID NO: 23801

SEQ ID NO: 170418 - DNA, 601 bp, Human; identical to SEQ ID NO: 23802

SEQ ID NO: 170419 - DNA, 601 bp, Human; identical to SEQ ID NO: 23803

SEQ ID NO: 170420 - DNA, 601 bp, Human; identical to SEQ ID NO: 23804

SEQ ID NO: 170421 - DNA, 601 bp, Human; identical to SEQ ID NO: 23805

SEQ ID NO: 170422 - DNA, 601 bp, Human; identical to SEQ ID NO: 23806

SEQ ID NO: 170423 - DNA, 601 bp, Human
taatttcctacaaatgtatttattattcaaaaattatttttaataaagctttttattaaaaaaaaaaaaggccagttacctgggaataggctccaggcatataagataaattgtgtttattcatttaccttagcatgcactactgtttatcaaatgatgacactactattccccatctactctaactatatttttgtcttgggcctgaagaggtggctcatgcctgtaatcccggcactttgggaggccgaggcgagtggatcacctattatcaggagctcgagaccagtctggcaaacayggcgaaacgctgtctctactaaaaatataaaaattagccgggggtggtggtgcatgcctgtaatcccagctcctcaggaggctgaggtggaagaataacttgaatccaggaggccgaggctgcagtgagctgagatcccgccactgcactccagcctgagtgacagagtgagactccgtctaaaaaaaaaaaaaatttgtctttatgagaaaaaaaatccctcattacatcgtaccatgcaaagattttgcaccaatattcttaccacaaaaaccatttatgagaagtttatgtgtaggg

SEQ ID NO: 170424 - DNA, 601 bp, Human
tacaatctttttaataattttgtgcatgaaacaaaagttttgactgtaacttatcacatgagaccaggagtggaattttccactttgtgggtcatgtcagtactcaaaagtttcagattttgaagcatttcaagttttggattttcagattagggatgctcaacctgtattaactatattaatgaaacaagacattataacaaaatttccacattaactgggaggcggggtaagggaatgaatcacaagttgataataagcaacagtaagaaacagagaaaataaaaatgtaaaataaatmggtaaagaagggaaaatcaaatcaatataagtgctattatcttaaaaactatccaattaggtaaagcattaaaatacagaaatctgccattttcaagagacatacacaacaaacataagaaatatcaggtaattcaaaaaaagagggaacaggagaagcagtattaaaatcacacaagctagagtttaaaactaggaaaaaattctgaagaatatggatacagggagaaagcaaatgtgacaaaatggttaacaagtaaatctaggagaagataaaggggtgtctactatttaaaacaaa

SEQ ID NO: 170425 - DNA, 601 bp, Human
aactatcttttagcatatgaaatcactcaaactaacttggaacctctagaaagagtccagcaaccacgaaaagaaagcttgcatgtttcttaaatttttatttctttttttttggttggtttgttttttgcccagcacagtgacgcaatcttggctcactacaacctccgtctcctgggctcaagccttcctcccacctcagtctcccaagtagctgggtctacaggtaaacgccaccaaacccagctaatttttttttttttaaagagatgaggattagccatgttgcccaggctggttkgtctccaacttctgagctcaagcgatccacccaccccagcctcccaaaatgctgggattacaggtgtgagccactgagcccagtctcttgttaaattttttcttccagagaaaatttgcatataatcatatattaagttttgtggggctttcacatatatttatatatttatttaatttgtttattttatttaataatttattgacaaaggctcactctgttgcccaggctggaatgcagtggcgagaacacagcttgctgcagcctcaacctcccaggctcaagtgagtctctcacctc

SEQ ID NO: 170426 - DNA, 601 bp, Human
agtatagtgttgaacagtgtgtttagtgggttatcttttgtggtaaggaggaaataattagttatatttgtttatatttgcattaagaaattctaagataggctgggcgtggtggctcacgcctgtaatcctagcactttgggaggctgaggtgggtggatcacctgaggtcaggagttcgaaaccagcctggccaacatggtaaaactccatctctactaaaaatacaaaaaaattagccaggcgtggtggcgcatgcctgtaatcccagctacttgggaggctggggcaggagaattgmttgaccttgggaggtggagactgcaatgacctgagattgtgccactgcactccagcctgggaaacagagagagactccatctcaaaaaaaaaaaaaaaaaagaaagaaagaaagaaaagaaaaaaaaagaaattctaagataaataagaaattaagaaaattaggcatagaatagggataaatggagcaattgagagcaggggtggaaatgagatttttttcactgtatatcttcttatattgattcttgaaccatgacaagtatttttaatacataaagcacttgcacaaaatgggaaa

SEQ ID NO: 170427 - DNA, 601 bp, Human
cataagggaggctccactgaagattcagtaggaaaattacatggcctcgctgtgagtgcctggcccgtggctggatgtcagatgctgctcttcttctctttcttactggatcactcaagagatggccaaggaggtattcctaatagctcagaatttggagaggatgtgttctggtatttttgggcttcagctagctgtggtgaaggattgggcacaacgtgggacataaggctcccaactgctaccctgcaggagccagggcactcctgggcagctcctaggatggaaaggccacactggsgggggctgtattttagtccgtttttgtattgctataaataaatacctaaggctgggtaatttataaagaaaacaggcttaactggctcacagttctgcagggtgtaccaagatggctccagcatctgcctctcatgaggcctcagggagcatccaatcatggcagaaggcaaagggggtgcagacgtgtcacatggcaagagcaggagcaagagcaaacctgagttgtaagccacctatttgacagttactcctttcctgagtttcttccatgtatatatgaaatatacatgttaataaa

SEQ ID NO: 170428 - DNA, 601 bp, Human; identical to SEQ ID NO: 23807

SEQ ID NO: 170429 - DNA, 601 bp, Human; identical to SEQ ID NO: 23808

SEQ ID NO: 170430 - DNA, 601 bp, Human; identical to SEQ ID NO: 23809

SEQ ID NO: 170431 - DNA, 601 bp, Human
gccacaaacgaaatctgtttattttttcctgttttgtagtcatactcatcacatccttatatattaataaaaaaattaaaggctgaagaattttaactttgcatggaaaaaacggttattcacaagaataaaaaccaaggtttttataatgtaataccttgaagacttggtgataatgacctaacacaactatttacaaaagcgtattttaacaactataattttagcatggggatgagtctgactatgacactaatggagttgacagattatataagtttgcctacactgtagatctcayctaaaataaaagtccagggaaaatattttcacaaacgtcaaatcatgtataaatataccgcacatttataaaatgtgactataccctaaaaactaacaaggttttgaaattctctgattttcctaataagatagtcacaaaatattagatatgttattttcatgctgtcagctgccatttactatataagactgccactggtacaacttaacattatagttactaaaagttattgaaagattagttgaccaaaatgtaacaaataatgttttcaacagtaagagcattttttctatgatg

SEQ ID NO: 170432 - DNA, 601 bp, Human
gaccttttagtgtcagtgtcacagatctttagagggtcacaaacacatcaagttggatcataagcaaaagagctccagatttgataatataagcaatgaactctccagacataatggtttctaatgatatttgaactgaactaaaacaaaaacatagaatttttaaaaatttgaaccatatgctaggatttagaaattttaaaaaatcggttcttgaatatgactgaagtagaggtctatatatttaggaacacagaatctggctacctggctacatagttccattcactcttcaactagwgaaagaaagttcattcagctactccaaccaatatttagtgaacagctattgagtaaatcctgtactctaagtgctgaactcggtgttggggatgatgatgataaatactaacatgtattgagaacttactatgttccaagcattgcgttaagcattgtacatggttattcatatttccattttacagataaataaactgaggtacagatagttaagtatatccaggtcatgtcaggcaatctggaaatctggttaaaaagcccatgctctgaaatactacactatattgcctcattagaa

SEQ ID NO: 170433 - DNA, 601 bp, Human
atgtatgtatgtatgtatgtatgtatgtatgtatgtatgtatgtatgtatgtatatatttaatagagacttgctttgttgcccagggtgatctcaactcctggcctcagcaattctcttgccttggcctcccaaagtcctgggattacagatgtgagccaccatgcccagcctaagtaatttttaaatgatctaacaggcacacattaaaaaataaaaagaaatgagtgaaatttattttaatgtaatatttcaaaatgtaataaagatgaaaaatactaagatattttacatttttttttcattctaaatctttgaaatccagtatattttatactaacaacacatcttaaattggactagccatatttcaagtgctcaatcaccacacagctagtggctactatactggacagcacaggttcagactttagcaaggaggttttcaagtaaggagagtctcccaaaacagaggttttaatgatgatctatacactttatgtgaaaatgaattaggctgcctccttactatcaaagaaatgcacaccgcaacctagagcttcaattatttaaccagtaataccattcttaaggcagagtca

SEQ ID NO: 170434 - DNA, 601 bp, Human
tcaacctatttatcatgcaaagaccatcccccacctccaacccttatataaattaagcaaattcaagaaatacaaaaacacggggaaaaatttctgaaaatacccaacaaattctgcaagctcaatcttggaaattttctttcctccttatgtgagcagatgaatgttttcagtcttgctgcagcatgttagagataagtcacatgaaaatctagcaccctccccccatcccaaatcctcagaggcattccacacaaggtcagtatcaactcagctcctggtttctgaaagtagataatamcaaaaatagaaaacactacagtgtcacagatcagcagtgcacacatttgtactgaattctttctgctctgctgctaactgctgtcactgacagtgtctgctcagatcaagtgtgcatgcaggaaaacagggctacaagaagccagtgagctgactcaaagtagccaaggcagaaagatgggagagcaaaggaaggaagctcacttggtgaaaatccaaaacagattacaaaggactcagctctaaacagcaaacacagtctatgtttgggtaaaatggaggaagcttgaggactacaaat

SEQ ID NO: 170435 - DNA, 601 bp, Human
cttaagattattcttggccctggggagaaaatgcacagtgtggtatgggcaagcagcagactgtacagggttgctacaaagataggaagggggggaaaatggccacacaaagcaataaaagtagagcaaaataagttggtagttaaagtggcagcaatagccaaggaaggggtattttcaaattgaagagtcctatgtccaagaggcctatgtgaagaaagagaagaaagagcttaaaggtgaagagaagataataaagagatgattgtagggtgcggaataatacagctagtaagaacayttactgaacacttaccaagtgccaatcactctgtgaggcactttactgcattatctcattttattcttacatcagctcttaagtgtttgttatttttattatcccatgttacagaagaggaaactaaagtatagaatggttaaattacttaagatcacaaacctaggaagtggcagagctaggaactgaattcaagtttgtttgacatcaaattgttgctataaagttctactcaaaactgaagaaaccaggcatatgagagtgaatttctaaaatatctgttgactactcagaagaaaa

SEQ ID NO: 170436 - DNA, 601 bp, Human
tgtacagagaatttaagatacagggacacttgatttctggaagaaaaacaatttctgtattttaattcagtccttattttaagagacttgaaattataatattgaaggagaagaaattttaaatgaggaaataagtacattttaaatcttagttaaatatgcttatgccccttctaaattgaatttttctttattgtattatatagagttttgctttgcctaggtttcttaagaatcagatgttctctcattaacccgtcaggaaacaacagaagctggagaggatgtggagaaacaggaacgcttttacactgttagtgggagtgtaaattagttcaaccattgtggaagacagtctggcgattcctcaaggatctagaaccagaaataccatttgacccagcaatcccattactgggtatatacccaaaggattataaatcattccactataaagacacatgcacacgtatgtttattgcagcactattcacaatagcaaagacttggaaccaatgcaaatgcccaccaacgatagactagataaagaaaatgtggcacatacatcccatggaatactatgcagccataaaaaagaatg

SEQ ID NO: 170437 - DNA, 601 bp, Human; identical to SEQ ID NO: 23810

SEQ ID NO: 170438 - DNA, 601 bp, Human; identical to SEQ ID NO: 23811

SEQ ID NO: 170439 - DNA, 601 bp, Human; identical to SEQ ID NO: 23812

SEQ ID NO: 170440 - DNA, 601 bp, Human
cttaataatgagggtataaaaagagcacatgtacttaaaaaatatgtaatttaaccactgttaatacaataagccttttagaagtctcacttgctctcattctaagtttctatttaaatcaatatccagcctacattaaatcttattttctacatatctcctttttgtattcctcactcttgctactcatgttgggagttaatttccaacccgaaaacaatgcactctgctaaatctcatcttgttacaatttgttcattataagaaacccaacctgttttttagagccagccttttttttggagacagagtctcactctgttgcccaggctggcgtgcaatggcacaatctcagctcattgcaacctccgccttctggcaattctcctgcctcagcctcccaagtagctgggattataggcacccaccaccatacctggctaatttttgcatttttagtggagacggggtttcaccatgttggccaggctggtctcgacctcaagtgatctacctgccttggtttcccaaaatgctgggattacaggcgtgagccaccgggcccaggctcctgtaaaggcatttctactattctttttct

SEQ ID NO: 170441 - DNA, 601 bp, Human
ttccactttgatatcattaatgatttatccttaacgtgatctccccttcctttaatctctgctggtttaattaactcttatggcacttaccatttccttggtgtgggcaatcataaacgtattaacctttcattttattctcttaggttatcctttttaattctatagtacccctagcaatataatcagcttaataatgagggtataaaaagagcacatgtacttaaaaaatatgtaatttaaccactgttaatacaataagccttttagaagtctcacttgctctcattctaagtttctrtttaaatcaatatccagcctacattaaatcttattttctacatatctcctttttgtattcctcactcttgctactcatgttgggagttaatttccaacccgaaaacaatgcactctgctaaatctcatcttgttacaatttgttcattataagaaacccaacctgttttttagagccagccttttttttggagacagagtctcactctgttgcccaggctggcgtgcaatggcacaatctcagctcattgcaacctccgccttctggcaattctcctgcctcagcctcccaagtagctgg

SEQ ID NO: 170442 - DNA, 601 bp, Human
atgcaatccctatcaaaaatcctaatgactttttcttttggcagaaatagaaaaattcatcctaaaattcatatggaatctcaaggaacctgaatagccaaagcagtctttttctttttctttctttcttttttttttttttttttttgagacagggtctggttctgtcacccaggctacagtgcagtggcatgatcttggctcactgtaatctctgcctcctcggctcaagtgatcctcccacctcagcttcccaagtagctgggagtacaggtgcatgccactatgcctggctaatttytgcatttttttgtagagacagagtctcactatgttgcccaggctggtcttgaactcctgaactcagtcattggccaggctggtcttgaactcctgagctcaggcgatccacccaccttgacctcccaaagtgctgggattacatgcatgagccactgtgcccagcccaaagcagtcttaaaaaggaacaacaaagttggtagtcaaactttctgatttcaaatcttatttcaaagctatagtaattaaaacagtgaggaactgcataaatacaaaccatatagatcaatggaacagaata

SEQ ID NO: 170443 - DNA, 601 bp, Human
agcaggagaatcgcctgaacccaggaggcagacgttgcagtgagccgagactgcgtcactgcactccagcctgggcaacaagagcaaaactctgcctcaaaaaaaaaaaggaaaaaaaagaaatgctaaagggagtcattcaagttgaaatgaaaggatgttagacaccaaatgaaaatataaagttttctctgataaaggtaaatatcaacatatggacaaatataaaaaatagtattactataatactggctcacaactcaactttagaagtaaattgtgactttcaaccacataaagkggggagtggagctgtaaaggagtggttttggatccaactgaaattaaatcttatcagtttaaaatagactgttataattgtaggatgttttgtgtaatctccatgaaacacagagaaaagagtaaaaggaaatgaggagggaataaaaaatgtcactacaaaaaatcaactaaacataaatgaagaccgtaatagaggaaataagggacataaaactataggacatacagaaacaaacagcaaaatgacaataataagtccttccctatcagtaattactttaaatgtgaatggattaaa

SEQ ID NO: 170444 - DNA, 601 bp, Human
tcagtcggcagccaccaatatcgaggcaagattctccaccaccaagaagattacaatttgttgaaggctcaaataatcattagctttttttttttttttttgagatggagtttcactcttgttgcccaggctggagtgtaatggcactatctcagctcactgcaacctcagcctcctgggttcaagcaattctcctgcctcagcctcccaagtagctgggattacaggcacccgccaccacgcctggctaattttttgtatttttagtagagacgtggtttcaccatgttgcgcaggctgktcttgaactcctgacctcaggtgattcacccaccccggcctcccaaagtgctgggattacaggtgtgagccactgtgcccgatcattagcattttttttttttaaagcaatgaagcattttctaattaagacacgtgcattttttagacatgttactgcacacttaatagaccagagtatagtgaaaacagaacttttatatgtgacttcttttattgcaatatttgctttattgtggtggtatggaaaagaacccatgctgggccaggtgcagcggctcacacctgtaatcctagcact

SEQ ID NO: 170445 - DNA, 601 bp, Human
tcttgctctgttgcccaggctggagtgcggtcgtgcgatctcatctcactgcaacttccacctcccgggttaaagcgattcttgtgcctcagcctccgagtagcttgcattacaggtgtatgccaccacacccagctaattttttttgtattttttagtagagattgagtttcaccatgttggccaggctggtctcgaactcccaacctcaatccacccaccgtggcctctcaaagtgctgggattacaggtgtgagccactgtgcctggccaatcgttattttagtgttcaccttctacwtatacaacaaataagttaattgaaaaagagcctcaggcaggtccttcaggagatataccagaagaaggcattgttatcgtaagagatgacagcttcatgtgtttgactgcccccaaagaccttccagggggacaagatgtggaggtggaagacagtgatattgatggtcctgaccccgtgcaggcctaggctcatgtttgtttgtgtattaattttttttccttttttctcttttgcatcttacatttaagaaaaaagtttaaaagttaaaaaaaaaaagaaaaaaaaaatttaaaagta

SEQ ID NO: 170446 - DNA, 601 bp, Human
cagccttccaaagtgctgggattacaggcataagccaccatgcccaccctattttggtttttttgagatggaatcttgctctgttgcccaggctggagtgcggtcgtgcgatctcatctcactgcaacttccacctcccgggttaaagcgattcttgtgcctcagcctccgagtagcttgcattacaggtgtatgccaccacacccagctaattttttttgtattttttagtagagattgagtttcaccatgttggccaggctggtctcgaactcccaacctcaatccacccaccgtggcytctcaaagtgctgggattacaggtgtgagccactgtgcctggccaatcgttattttagtgttcaccttctacatatacaacaaataagttaattgaaaaagagcctcaggcaggtccttcaggagatataccagaagaaggcattgttatcgtaagagatgacagcttcatgtgtttgactgcccccaaagaccttccagggggacaagatgtggaggtggaagacagtgatattgatggtcctgaccccgtgcaggcctaggctcatgtttgtttgtgtattaattttttttccttttt

SEQ ID NO: 170447 - DNA, 601 bp, Human
tgacaaataactttctcagatactgatcatggttgatttgaggcagaggcccgttcagaaagcaggactcaatgagttcaacttgttcagatcacgcgtaagatacctgctggggggagttccagaaacacttttagagaaaccatgcaggtgactttcttcctcttggtgtacacaggggctatgagccagcagaactgggctttagctgcacttatgacctcattagtaccgcctttccccaaagaataaaggtaatgaatgctttggaaaaatatataaaagtataatttaaaaatcrtccctaaatctcactatcagaaataacccttatgaatatttcagcatacttctttaacagcctttattcctggtatttttttcttacatatttgagatcatgctatgctgatacggttttttgtgaaggtgtacatgaaaaagctacattttaggtatatcactttttatcccttaccctgatttaatcacagtactcatcagtatttgacatatatttgttcattgcctatctttcttatacaaactctatgaagacaggaactttgttttgttcacagctgtatcctcaaggcctagc

SEQ ID NO: 170448 - DNA, 601 bp, Human; identical to SEQ ID NO: 23813

SEQ ID NO: 170449 - DNA, 601 bp, Human; identical to SEQ ID NO: 23814

SEQ ID NO: 170450 - DNA, 601 bp, Human; identical to SEQ ID NO: 23815

SEQ ID NO: 170451 - DNA, 601 bp, Human; identical to SEQ ID NO: 23816

SEQ ID NO: 170452 - DNA, 601 bp, Human; identical to SEQ ID NO: 23817

SEQ ID NO: 170453 - DNA, 601 bp, Human; identical to SEQ ID NO: 23818

SEQ ID NO: 170454 - DNA, 601 bp, Human; identical to SEQ ID NO: 23819

SEQ ID NO: 170455 - DNA, 601 bp, Human
ttcttcagtaatttttcttgttcttcattgtcaccctagaatttcaaatagagacaaaagttaagcaacttcagagccttgcttaaatagtatttctaagtacggtagagacattcattaattctggtttggaaatcaacttctctcatcccagcctaccagaaatcccttgcccaaaaagggggatgtcgaccttctgtgaagcacttatgcgaagtccagactcttagtagagacagggctcaaaagttataccacatacaacaaagtcacttctacgcccgactgccacgcaagcggyttcccttttccctgcacacaccatatcctcagcagtgcatcctttaaacccaagtgtagactctggaccttgacccaatatatgacaaagggcccttttatccttcgtagtgaaaaataagtgggttttcagagagagagagagttcctctttaataaccccctagagactgttgaaagccacaaccttgatgctttacgtgctcatagatctttctctgagtttaggggaaaatgtagtgatcactaaaaacaaaacagagctcactttcttaatgggcttccaaattgggatgacagg

SEQ ID NO: 170456 - DNA, 601 bp, Human
tgggctcaactgatcctcctgcctcagcttcctgagcagctggcactacaaacaccagccaccatggccagctgtacagctattttaaaaaaagacctacatatgctgaaatggaacaataaaaaataaaaaaatgattttaaaaacagcacatgaaatacactaccgcacacccacagggttacttcttgaaagacgcccaagaaactgctaactgactgcctctggcaaagggcattaggggtttagaacagtacgagatttttgtattttcaccacattctttggaatttttttttttacgtgaagggcaaacattcttgaaaaactttttgttaaagaaccataaagcatggatttcagaagagaatataaatagtatcagctttacagtataagggcagagacacactgggtggaaagtaggagggagatgaaggaaaacgtagggacgagtgcagggacgcttgtgagctaccactctcagctctaccctggttcagcagctacattagatccatgggaaggatactccacaaaacagaatccacatgctgttttcttcattttatccagacccataatgattttctttatgtca

SEQ ID NO: 170457 - DNA, 601 bp, Human
ccttgaaatcttgggctcaactgatcctcctgcctcagcttcctgagcagctggcactacaaacaccagccaccatggccagctgtacagctattttaaaaaaagacctacatatgctgaaatggaacaataaaaaataaaaaaatgattttaaaaacagcacatgaaatacactaccgcacacccacagggttacttcttgaaagacgcccaagaaactgctaactgactgcctctggcaaagggcattaggggtttagaacagtacgagatttttgtattttcaccacattctttggawtttttttttttacgtgaagggcaaacattcttgaaaaactttttgttaaagaaccataaagcatggatttcagaagagaatataaatagtatcagctttacagtataagggcagagacacactgggtggaaagtaggagggagatgaaggaaaacgtagggacgagtgcagggacgcttgtgagctaccactctcagctctaccctggttcagcagctacattagatccatgggaaggatactccacaaaacagaatccacatgctgttttcttcattttatccagacccataatgattt

SEQ ID NO: 170458 - DNA, 601 bp, Human
aacacagtcacaactcagtgcagccttgaaatcttgggctcaactgatcctcctgcctcagcttcctgagcagctggcactacaaacaccagccaccatggccagctgtacagctattttaaaaaaagacctacatatgctgaaatggaacaataaaaaataaaaaaatgattttaaaaacagcacatgaaatacactaccgcacacccacagggttacttcttgaaagacgcccaagaaactgctaactgactgcctctggcaaagggcattaggggtttagaacagtacgagatttttrtattttcaccacattctttggaatttttttttttacgtgaagggcaaacattcttgaaaaactttttgttaaagaaccataaagcatggatttcagaagagaatataaatagtatcagctttacagtataagggcagagacacactgggtggaaagtaggagggagatgaaggaaaacgtagggacgagtgcagggacgcttgtgagctaccactctcagctctaccctggttcagcagctacattagatccatgggaaggatactccacaaaacagaatccacatgctgttttcttcat

SEQ ID NO: 170459 - DNA, 601 bp, Human
tttacttaaaagtttttttctttaaagatggggtcttaacccgtcacccccgctggaacacagtcacaactcagtgcagccttgaaatcttgggctcaactgatcctcctgcctcagcttcctgagcagctggcactacaaacaccagccaccatggccagctgtacagctattttaaaaaaagacctacatatgctgaaatggaacaataaaaaataaaaaaatgattttaaaaacagcacatgaaatacactaccgcacacccacagggttacttcttgaaagacgcccaagaaactgstaactgactgcctctggcaaagggcattaggggtttagaacagtacgagatttttgtattttcaccacattctttggaatttttttttttacgtgaagggcaaacattcttgaaaaactttttgttaaagaaccataaagcatggatttcagaagagaatataaatagtatcagctttacagtataagggcagagacacactgggtggaaagtaggagggagatgaaggaaaacgtagggacgagtgcagggacgcttgtgagctaccactctcagctctaccctggttcagcagctaca
